United States Patent
Petsch et al.

(10) Patent No.: US 11,602,557 B2
(45) Date of Patent: Mar. 14, 2023

(54) BUNYAVIRALES VACCINE

(71) Applicant: CureVac SE, Tübingen (DE)

(72) Inventors: Benjamin Petsch, Tübingen (DE); Edith Jasny, Tübingen (DE)

(73) Assignee: Cure Vac SE, Tübingen (DE)

( * ) Notice: Subject to any disclaimer, the term of this patent is extended or adjusted under 35 U.S.C. 154(b) by 0 days.

(21) Appl. No.: 16/641,064

(22) PCT Filed: Aug. 22, 2018

(86) PCT No.: PCT/EP2018/072675
§ 371 (c)(1),
(2) Date: Feb. 21, 2020

(87) PCT Pub. No.: WO2019/038332
PCT Pub. Date: Feb. 28, 2019

(65) Prior Publication Data
US 2021/0030864 A1    Feb. 4, 2021

(30) Foreign Application Priority Data
Aug. 22, 2017   (WO) .................. PCT/EP2017/071167

(51) Int. Cl.
*A61K 39/12* (2006.01)
*A61K 9/00* (2006.01)
(Continued)

(52) U.S. Cl.
CPC ............ *A61K 39/12* (2013.01); *A61K 9/0019* (2013.01); *C12N 7/00* (2013.01); *A61K 2039/53* (2013.01);
(Continued)

(58) Field of Classification Search
None
See application file for complete search history.

(56) References Cited

U.S. PATENT DOCUMENTS

2005/0032730 A1   2/2005   von der Mülbe et al.
2005/0059624 A1   3/2005   Hoerr et al.
(Continued)

FOREIGN PATENT DOCUMENTS

WO   WO 2012/039607   3/2012
WO   WO 2013/143700   10/2013
(Continued)

OTHER PUBLICATIONS

Lombe et al. (Viruses. 2022; 14(544): 1-12).*
(Continued)

*Primary Examiner* — Shanon A. Foley
(74) *Attorney, Agent, or Firm* — Parker Highlander PLLC

(57) ABSTRACT

The present invention is directed to an artificial nucleic acid, particularly to an artificial RNA, and to polypeptides suitable for use in treatment or prophylaxis of an infection with a virus of the order Bunyavirales, particularly Severe fever with thrombocytopenia syndrome virus (SFTSV), Rift Valley fever virus (RVFV), or Crimean-Congo hemorrhagic fever virus (CCHFV), or a disorder related to such an infection. The present invention further concerns a Bunyavirales vaccine, particularly a SFTSV, RVFV, or CCHFV vaccine

(51) Int. Cl.
 *C12N 7/00* (2006.01)
 *A61K 39/00* (2006.01)
(52) U.S. Cl.
 CPC .............. *C12N 2760/12034* (2013.01); *C12N 2760/12234* (2013.01)

(56) References Cited

U.S. PATENT DOCUMENTS

| | | |
|---|---|---|
| 2005/0250723 A1 | 11/2005 | Hoerr et al. |
| 2006/0188490 A1 | 8/2006 | Hoerr et al. |
| 2008/0025944 A1 | 1/2008 | Hoerr et al. |
| 2008/0267873 A1 | 10/2008 | Hoerr et al. |
| 2009/0324584 A1 | 12/2009 | Hoerr et al. |
| 2010/0048883 A1 | 2/2010 | Ketterer et al. |
| 2010/0189729 A1 | 7/2010 | Hoerr et al. |
| 2010/0203076 A1 | 8/2010 | Fotin-Mleczek et al. |
| 2010/0291156 A1 | 11/2010 | Barner et al. |
| 2010/0305196 A1 | 12/2010 | Probst et al. |
| 2011/0053829 A1 | 3/2011 | Baumhof et al. |
| 2011/0250225 A1 | 10/2011 | Fotin-Mleczek et al. |
| 2012/0021043 A1 | 1/2012 | Kramps et al. |
| 2012/0258046 A1 | 10/2012 | Mutzke |
| 2013/0129754 A1 | 5/2013 | Thess et al. |
| 2013/0142818 A1 | 6/2013 | Baumhof et al. |
| 2013/0259879 A1 | 10/2013 | Baumhof et al. |
| 2013/0280283 A1 | 10/2013 | Lorenz et al. |
| 2013/0295043 A1 | 11/2013 | Kallen et al. |
| 2013/0336998 A1 | 12/2013 | Kallen et al. |
| 2015/0037326 A1 | 2/2015 | Butler-Ransohoff et al. |
| 2015/0050302 A1 | 2/2015 | Thess |
| 2015/0057340 A1 | 2/2015 | Thess et al. |
| 2015/0093413 A1 | 4/2015 | Thess et al. |
| 2015/0118183 A1 | 4/2015 | Baumhof |
| 2015/0118264 A1 | 4/2015 | Baumhof et al. |
| 2015/0165006 A1 | 6/2015 | Thess et al. |
| 2015/0184195 A1 | 7/2015 | Thess et al. |
| 2015/0218554 A1 | 8/2015 | Thess |
| 2015/0306249 A1 | 10/2015 | Baumhof et al. |
| 2015/0320847 A1 | 11/2015 | Thess et al. |
| 2016/0130345 A1 | 5/2016 | Fotin-Mleczek et al. |
| 2016/0166668 A1 | 6/2016 | Kallen et al. |
| 2016/0166678 A1 | 6/2016 | Kallen et al. |
| 2016/0166710 A1 | 6/2016 | Baumhof |
| 2016/0166711 A1 | 6/2016 | Schnee et al. |
| 2016/0168207 A1 | 6/2016 | Kramps et al. |
| 2016/0168227 A1 | 6/2016 | Kallen et al. |
| 2016/0235864 A1 | 8/2016 | Schlake et al. |
| 2016/0304883 A1 | 10/2016 | Grund et al. |
| 2016/0304938 A1 | 10/2016 | Wochner |
| 2016/0311891 A1* | 10/2016 | Weiner ............... C07K 16/1081 |
| 2016/0326575 A1 | 11/2016 | von der Mülbe et al. |
| 2016/0331844 A1 | 11/2016 | Fotin-Mleczek et al. |
| 2017/0014496 A1 | 1/2017 | Fotin-Mleczek et al. |
| 2017/0029847 A1 | 2/2017 | Thess |
| 2017/0114378 A1 | 4/2017 | Wochner et al. |
| 2017/0252430 A1 | 9/2017 | Fotin-Mleczek et al. |
| 2017/0326225 A1 | 11/2017 | Rauch et al. |
| 2018/0044687 A1 | 2/2018 | Thess et al. |
| 2018/0125952 A1 | 5/2018 | Fotin-Mleczek et al. |
| 2018/0126003 A1 | 5/2018 | Hoerr |
| 2018/0142275 A1 | 5/2018 | Roos et al. |
| 2018/0147146 A1 | 5/2018 | Eber et al. |
| 2018/0148727 A1 | 5/2018 | Grund et al. |
| 2018/0201967 A1 | 7/2018 | Eber et al. |
| 2018/0208957 A1 | 7/2018 | Roos et al. |
| 2018/0214537 A1 | 8/2018 | Mutzke et al. |
| 2018/0237786 A1 | 8/2018 | Schlake et al. |
| 2018/0237817 A1 | 8/2018 | Roos et al. |
| 2018/0243219 A1 | 8/2018 | Ketterer et al. |
| 2018/0296663 A1 | 10/2018 | Hipp et al. |
| 2018/0298372 A1 | 10/2018 | Funkner et al. |
| 2018/0312545 A1 | 11/2018 | Baumhof et al. |
| 2018/0371392 A1 | 12/2018 | Mayer et al. |
| 2019/0010485 A1 | 1/2019 | Yazdan Panah et al. |
| 2019/0017100 A1 | 1/2019 | Wochner et al. |
| 2019/0024096 A1 | 1/2019 | Schmid et al. |
| 2019/0040378 A1 | 2/2019 | Fotin-Mleczek et al. |
| 2019/0049414 A1 | 2/2019 | Wochner et al. |
| 2019/0083602 A1 | 3/2019 | Roos et al. |
| 2019/0100784 A1 | 4/2019 | Eber et al. |
| 2019/0125857 A1 | 5/2019 | Rauch et al. |
| 2019/0133950 A1 | 5/2019 | Eber et al. |
| 2019/0160164 A1 | 5/2019 | Rauch et al. |
| 2019/0177714 A1 | 6/2019 | Kunze et al. |
| 2019/0185859 A1 | 6/2019 | Fotin-Mleczek et al. |
| 2019/0194760 A1 | 6/2019 | Koch et al. |
| 2019/0225971 A1 | 7/2019 | Williams |
| 2019/0241633 A1 | 8/2019 | Fotin-Mleczek et al. |
| 2019/0249219 A1 | 8/2019 | Reichert et al. |
| 2019/0336608 A1 | 11/2019 | Baumhof et al. |
| 2019/0336611 A1 | 11/2019 | Baumhof et al. |
| 2019/0343933 A1 | 11/2019 | Horscroft et al. |
| 2019/0343942 A1 | 11/2019 | Fotin-Mleczek et al. |
| 2019/0351044 A1 | 11/2019 | Jasny et al. |
| 2019/0351047 A1 | 11/2019 | Jasny et al. |
| 2019/0351048 A1 | 11/2019 | Rauch |
| 2019/0381180 A1 | 12/2019 | Baumhof et al. |
| 2020/0023076 A1 | 1/2020 | Fotin-Mleczek et al. |
| 2020/0085852 A1 | 3/2020 | Fotin-Mleczek |
| 2020/0085944 A1 | 3/2020 | Heidenreich et al. |
| 2020/0149026 A1 | 5/2020 | Horscroft et al. |
| 2020/0163878 A1 | 5/2020 | Baumhof et al. |
| 2020/0179526 A1 | 6/2020 | Baumhof et al. |
| 2020/0318097 A1 | 10/2020 | Funkner et al. |
| 2020/0392572 A1 | 12/2020 | Yazdan Panah et al. |
| 2021/0030864 A1* | 2/2021 | Petsch .................... C12N 15/67 |

FOREIGN PATENT DOCUMENTS

| | | |
|---|---|---|
| WO | WO 2014/028511 | 2/2014 |
| WO | WO 2014/132013 | 9/2014 |
| WO | WO 2016/203025 | * 12/2016 |
| WO | WO 2017/137095 | 8/2017 |
| WO | WO 2017/140905 | 8/2017 |
| WO | WO 2017/191258 | 11/2017 |
| WO | WO 2018/172556 | 9/2018 |
| WO | WO 2018/211038 | 11/2018 |
| WO | WO 2019/077001 | 4/2019 |
| WO | WO 2019/092153 | 5/2019 |
| WO | WO 2019/193183 | 10/2019 |
| WO | WO 2019/202035 | 10/2019 |
| WO | WO 2020/002525 | 1/2020 |
| WO | WO 2020/002598 | 1/2020 |
| WO | WO 2020/127959 | 6/2020 |
| WO | WO 2020/128031 | 6/2020 |

OTHER PUBLICATIONS

Tipah et al. (BioResearch Open Access. 2020; 91: 137-150).*
Rodriguez et al. (Antiviral Research. 2022; 199: 105244).*
Sequence alignement of instant SEQ ID 589 with UniProt db access No. C7F6X7_9VIRU 2009.*
Hinkula et al., "Immunization with DNA Plasmids Coding for Crimean-Congo Hemorrhagic Fever Virus Capsid and Envelope Proteins and/or Virus-Like Particles Induces Protection and Survival in Challenged Mice," *Journal of Virology*, 91(10):e02076-16, 2017.
PCT International Search Report and Written Opinion issued in International Application No. PCT/EP2018/072675, dated Nov. 20, 2018.
Schnee et al., "An mRNA Vaccine Encoding Rabies Virus Glycoprotein Induces Protection against Lethal Infection in Mice and Correlates of Protection in Adult and Newborn Pigs," *PLOS Neglected Tropical Diseases*, 10(6):e0004746, 2016.
Farzani et al., "Immunological analysis of a CCHFV mRNA vaccine candidate in mouse models," *Vaccines*, 7:115, 2019.

* cited by examiner

A rabbit a-CCHFV
Gn antiserum mouse a-alpha
tubulin Ab

B mouse a-CCHFV
Gc Ab rabbit a-beta
tubulin Ab

BUNYAVIRALES VACCINE

This application is a national phase application under 35 U.S.C. § 371 of International Application No. PCT/EP2018/072675, filed Aug. 22, 2018, which claims benefit of International Application No. PCT/EP2017/071167, filed Aug. 22, 2017, the entire contents of each of which are hereby incorporated by reference.

INTRODUCTION

The present invention relates to an artificial nucleic acid and to polypeptides suitable for use in treatment or prophylaxis of an infection with a virus of the order Bunyavirales, particularly for use in treatment or prophylaxis of an infection with a virus of the genera Orthohantavirus, Orthonairovirus, Orthobunyavirus, or Phlebovirus, more particularly for use in treatment or prophylaxis of an infection with Severe fever with thrombocytopenia syndrome virus (SFTSV), Rift Valley fever virus (RVFV), or Crimean-Congo hemorrhagic fever virus (CCHFV) or a disorder related to such infections. In particular, the present invention concerns a vaccine against a virus of the order Bunyavirales, particularly a vaccine against a virus of the genera Orthohantavirus, Orthonairovirus Orthobunyavirus, or Phlebovirus, more particularly a vaccine against SFTSV, RVFV, or CCHFV. The present invention is further directed to an artificial nucleic acid, polypeptides, compositions and vaccines comprising the artificial nucleic acid or the polypeptides of the invention. The invention further concerns a method of treating or preventing a disorder or a disease associated with a Bunyavirales virus infection, first and second medical uses of the artificial nucleic acid, polypeptides, compositions and vaccines. Further, the invention is directed to a kit, particularly to a kit of parts, comprising the artificial nucleic acid, polypeptides, compositions and vaccines.

The Bunyavirales order encompasses nine families of enveloped viruses containing a single-stranded negative-sense RNA genome divided into three segments. The small (S) and large (L) segments encode proteins participating in genome replication in the infected cell cytoplasm. Typically, Bunyavirales are vector-borne viruses transmitted mostly by arthropods bites (Mosquitoes, ticks, flies) or livestock animals, with the exception of the viruses from the Hantaviridae family, which are transmitted by infectious excreta or bites of rodents and other small mammals. In certain cases, human-to-human transmission can occur resulting from close contact with the blood or other bodily fluids of infected persons. Bunyavirales are found throughout the world and are known to resist to adverse climate changes allowing for seasonal and persistent occurrence of the diseases. Bunyavirales are endemic in certain regions of the globe, such as Africa, the Middle East and Asia. In addition, outbreaks of Bunyavirales are often reported in both animals and humans.

Several viruses of the order Bunyavirales are described human pathogens, particularly viruses of the genus Orthohantavirus such as Andes hantavirus (ANDV), Black Creek Canal hantavirus virus (BCCV), Dobrava-Belgrade hantavirus (DOBV). Haantan virus (HTNV), Laguna Negra hantavirus (LANV), Longquan hantavirus (LQUV). Puumala hantavirus (PUUV), Sangassou hantavirus (SANGV), Seoul hantavirus (SEOV), Sin Nombre hantavirus (SNV). Thailand hantavirus (THAIV), Tula hantavirus (TULV), or New York hantavirus (NYV)), viruses of the genus Orthonairovirus such as Crimean-Congo hemorrhagic fever virus (CCHFV), Dugbe virus (DUGV), or Nairobi sheep disease virus (NSDV), viruses of the genus Orthobunyavirus such as Bunyamwera virus (BUNV), Ngari virus (NRIV), Bwamba bunyavirus (BWAV), California encephalitis virus (CEV), Jamestown Canyon virus (JCV), Keystone virus (KEYV), La Crosse virus (LACV), or Oropouche virus (OROV), and viruses of the genus Phlebovirus such as Heartland virus (HRTV), Punta Toro virus (PTV), Rift Valley fever virus (RVFV), Sandfly fever Naples virus (SFNV), Toscana virus (TOSV), and Severe fever with thrombocytopenia syndrome virus (SFTSV).

When infecting humans, viruses of the order Bunyavirales cause a broad spectrum of clinical illnesses, ranging from self-limited febrile disease and respiratory and pulmonary syndromes to encephalitis and life-threatening hemorrhagic fevers.

Notably, viruses of the order Bunyavirales are currently amongst the most concerning emerging infectious diseases. From the ten pathogens listed in the WHO priority list of emerging diseases (Meeting Report; WHO; 2015) requiring urgent research towards the development of a vaccine, three are members of the order Bunyavirales (that is, Rift Valley fever virus (RVFV). Severe fever with thrombocytopenia syndrome virus (SFTSV), and Crimean-Congo hemorrhagic fever virus (CCHFV)).

RVFV is a member of the Phlebovirus genus. RVFV is a viral zoonosis that primarily affects animals but also has the capacity to infect humans e.g. through the contact with infectious animal blood and organs, the virus can cause meningoencephalitis or haemorrhagic fever. Frequent outbreaks of RVFV have occurred in the past decade in Africa. According to the WHO, between 2006 and 2007, Sudan, Kenya, Somalia and Tanzania have reported together more than 1400 cases, including 464 deaths. The most recent outbreak occurred in 2016 in the Republic of Niger, where the Ministry of Health reported 105 suspected cases from which 28 were fatal. To date, no safe human RVFV vaccine is available to the public that efficiently protects against RVFV infections. Since the 1960s, formalin-inactivated vaccines have been used to protect laboratory workers from accidental exposure (e.g. NDBR 103 and TSI GSD 200). A significant drawback of formalin-inactivated vaccines is that the development of an adequate immune response requires 3 inoculations, making this impractical for use as a broadly applicable vaccine. To overcome this, several live-attenuated vaccines, such as MP-12 and Clone 13, were generated and tested in the 1980s and 1990s. Protection of experimentally inoculated animals from virulent challenge was achieved, but there is a potential for teratogenic effects in pregnant animals. Another disadvantage is that use of live-attenuated RVFV vaccines during epizootics have shown the potential for reversion to virulence and spread from animal to animal. More recently, reverse genetics has allowed generation of rationally designed live attenuated vaccines. A recombinant virus with deletions in the NSs and NSm proteins (termed ZH501-DNSs/DNSm or D/D virus) showed efficacy in rat and sheep models and had no apparent adverse effects on fetal animals. Other approaches have removed the NSm protein from the MP-12 virus (termed MP-12/DNSm). Other vectored, replicon, subunit vaccination, or DNA vaccination strategies have been tested in laboratory animals (see for example Bouloy and Flick, 2009, or WO2011/095760), but a vaccine that has demonstrated sufficient safety and efficacy in human use is still not available. Summarizing the above, to date, no safe and efficacious vaccine is available to protect against RVFV infections.]

CCHFV is a member of the Nairovirus genus. CCHFV was first reported in the Crimean region as an acute hemorrhagic fever. Both, wild and domestic animals can serve as natural viral hosts. CCHFV have been associated with outbreaks of severe and fatal cases in Europe, Middle East, Asia and Africa. From 2002 to 2008, more than 2500 cases were reported only in Turkey. According to the WHO, CCHFV outbreaks have a fatality rate of up to 40%. Cases have also been associated with human-to-human transmission. A vaccine based on CCHFV, amplified in suckling mouse brain and inactivated by chloroform treatment, has been used in Eastern Europe, but is unlicensed by the European Medicines Agency or US Food and Drug Administration. A recent study found that it elicited both a cellular and humoral response to CCHFV, but neutralising antibody titres were low, even in people who had received 4 doses. Controlled studies on protective efficacy have not been reported with this vaccine and, due to its crude preparation which raises concerns due to possible autoimmune and allergic responses induced by myelin basic protein; it is unlikely to gain widespread international regulatory approval. Several different vaccination approaches have been used for CCHFV such as inactivated virus vaccines, modified Vaccinia Ankara (MVA), Adenovirus-based vaccines, DNA vaccines, transgenic plant vaccines, recombinant protein based vaccines, virus like particles (VLP) based vaccines, but a vaccine that has demonstrated sufficient safety and efficacy in human use is still not available. Summarizing the above, to date, no safe and efficacious vaccine is available to protect against CCHFV infections.

SFTSV is a member of the Phlebovirus genus. SFTSV virus is transmitted to humans by Ixodid ticks bites and had its first case identified in China in 2011. Since then, South Korea (2012) and Japan (2013) have also reported numerous cases, many of them, fatal. Symptoms and physiological alterations include vomiting, fever, thrombocytopenia, and leukocytopenia. In severe cases, multiple organ failure occurs and 6% to 30% of the patients die. The recently identified SFTS virus has been reported to be endemic in China and Japan. Summarizing the above, to date, no safe and efficacious vaccine is available to protect against SFTSV infections.

Accordingly, to date no effective antiviral therapies have been approved for either the prevention or treatment of diseases caused by Bunyavirales virus infection in humans. A major drawback of current approaches is that vaccines based on live attenuated viruses have the enormous risk for reversion to virulence via genetic reassortment with wild type viruses. In addition, vaccine development using attenuated viruses typically requires work under biosafety level 2 which additionally impedes the development of effective vaccines against Bunyavirales. Moreover, the use of DNA as a vaccine may be dangerous due to unwanted insertion into the genome, possibly leading to interruption of functional genes and cancer or the formation of anti-DNA antibodies. Moreover, protein-based vaccines are extremely expensive and time consuming in production. Given the high variability and fast infection rates of potential new outbreaks of viruses of the order Bunyvirales, fast adjustments of a vaccine might be necessary. Furthermore, given that outbreaks have so far mostly been restricted to developing countries, vaccines must be cost effective and the number of vaccines doses required to induce protective immune responses should below (preferably 1 dose).

Thus, there is a significant unmet medical need to find agents that can prevent Bunyavirales infection, shorten the duration of Bunyavirales-induced illness, lessen the severity of symptoms, minimize secondary bacterial infections and exacerbations of underlying disease, and reduce virus transmission, e.g. for infections caused by ANDV, BCCV, DOBV, HTNV, LANV, LQUV, PUUV, SANGV, SEOV, SNV, THAIV, TULV, NYV, DUGV, NSDV, BUNV, NRIV, BWAV, CEV, JCV, KEYV, LACV, OROV, HRTV, PTV, SFNV, or TOSV, in particular for infections caused by SFTSV, RVFV or CCHFV. A prophylactic vaccine should be protective against a wide variety of virus isolates of said pathogenic viruses of the order Bunyavirales to reduce the number of infections, hence, reducing the risk of a global pandemic threat.

Accordingly, the underlying object of the present invention is to provide an effective vaccine against viruses of the order Bunyavirales, e.g. against ANDV, BCCV, DOBV, HTNV, LANV, LQUV, PUUV, SANGV, SEOV, SNV, THAIV, TULV, NYV, DUGV, NSDV, BUNV, NRIV, BWAV, CEV, JCV, KEYV, LACV, OROV, HRTV, PTV, SFNV, or TOSV, particularly against SFTSV, RVFV, or CCHFV. It is a further preferred object of the invention to provide a Bunyavirales vaccine which may be produced in a fast manner at an industrial scale under conditions that do not require specific biosafety containment. Further object of the underlying invention is to provide nucleic acid sequences, particularly mRNA sequences coding for antigenic peptides or proteins derived from a virus of the order Bunyavirales, e.g. derived from ANDV, BCCV, DOBV, HTNV, LANV, LQUV, PUUV, SANGV, SEOV, SNV, THAIV, TULV, NYV, DUGV, NSDV, BUNV, NRIV, BWAV, CEV, JCV, KEYV, LACV, OROV, HRTV, PTV, SFNV, or TOSV, particularly derived from SFTSV, RVFV, or CCHFV or a fragment or variant thereof for the use as a vaccine for prophylaxis or treatment of infections associated with those viruses. Furthermore, it is the object of the present invention to provide an effective Bunyavirales vaccine which can be stored without cold chain and which enables rapid, scalable, cost-effective, and fast-adaptable vaccine production which is a significant aspect in the context of pandemic outbreaks. Accordingly, the underlying objects of the present invention are of major importance for the global health.

The object underlying the present invention is solved by the claimed subject-matter.

DEFINITIONS

For the sake of clarity and readability the following definitions are provided. Any technical feature mentioned for these definitions may be read on each and every embodiment of the invention. Additional definitions and explanations may be specifically provided in the context of the invention.

The term "adaptive immune response" as used herein will be recognized and understood by the person of ordinary skill in the art, and is for example intended to refer to an antigen-specific response of the immune system. Antigen specificity allows for the generation of responses that are tailored to specific pathogens or pathogen-infected cells. The ability to mount these tailored responses is usually maintained in the body by "memory cells" (B-cells). In the context of the invention, the antigen (e.g. Bunyavirales peptide, protein, polyprotein) is provided by the artificial nucleic acid coding sequence encoding at least one antigenic peptide, protein or polyprotein of the invention.

The term "adaptive immune system" as used herein will be recognized and understood by the person of ordinary skill in the art, and is for example intended to refer to a highly adaptable system typically regulating the adaptive immune response by providing the vertebrate immune system with the ability to recognize and remember specific pathogens (to generate immunity), and to mount stronger attacks each time the pathogen is encountered. The system is highly adaptable because of somatic hyper mutation (a process of accelerated somatic mutations), and V(D)J recombination (an irreversible genetic recombination of antigen receptor gene segments). This mechanism allows a small number of genes to generate a vast number of different antigen receptors, which are then uniquely expressed on each individual lymphocyte. Because the gene rearrangement leads to an irreversible change in the DNA of each cell, all of the progeny (offspring) of such a cell will then inherit genes encoding the same receptor specificity, including the Memory B cells and Memory T cells that are the keys to induce long-lived specific immunity.

The term "antigen" as used herein will be recognized and understood by the person of ordinary skill in the art, and is for example intended to refer to a substance which may be recognized by the immune system, preferably by the adaptive immune system, and is capable of triggering an antigen-specific immune response, e.g. by formation of antibodies and/or antigen-specific T cells as part of an adaptive immune response. Typically, an antigen may be or may comprise a peptide or protein which may be presented by the MHC to T-cells. In the context of the present invention, an antigen, e.g. a Bunyavirales antigen, may be the product of translation of a provided inventive artificial nucleic acid of the, preferably of the mRNA as specified herein. Also fragments, variants and derivatives of peptides, proteins, or polyproteins of a virus of the order Bunyavirales comprising at least one epitope are understood as antigens in the context of the invention.

The terms "cellular immunity" or "cellular immune response" or "cellular T-cell responses" as used herein will be recognized and understood by the person of ordinary skill in the art, and are for example intended to refer to the activation of macrophages, natural killer cells (NK), antigen-specific cytotoxic T-lymphocytes, and the release of various cytokines in response to an antigen. In more general terms, cellular immunity is not based on antibodies, but on the activation of cells of the immune system. Typically, a cellular immune response may be characterized e.g. by activating antigen-specific cytotoxic T-lymphocytes that are able to induce apoptosis in cells, e.g. specific immune cells like dendritic cells or other cells, displaying epitopes of foreign antigens on their surface. In the context of the invention, the antigen (e.g. Bunyavirales peptide, protein, polyprotein) is provided by the artificial nucleic acid coding sequence encoding at least one antigenic peptide, protein or polyprotein of the invention.

The term "derived from" as used throughout the present specification in the context of a nucleic acid, i.e. for a nucleic acid "derived from" (another) nucleic acid, means that the nucleic acid, which is derived from (another) nucleic acid, shares at least 50%, preferably at least 55%, preferably at least 60%, preferably at least 65%, preferably at least 70%, more preferably at least 75%, more preferably at least 80%, 81%, 82%, 83%, 84%, more preferably at least 85%, 86%, 87%, 88%, 89% even more preferably at least 90%, 91%, 92%, 93%, 94%, even more preferably at least 95%, 96%, 97%, and particularly preferably at least 98%, 99% sequence identity with the nucleic acid from which it is derived. The skilled person is aware that sequence identity is typically calculated for the same types of nucleic acids, i.e. for DNA sequences or for RNA sequences. Thus, it is understood, if a DNA is "derived from" an RNA or if an RNA is "derived from" a DNA, in a first step the RNA sequence is converted into the corresponding DNA sequence (in particular by replacing the uracils (U) by thymidines (T) throughout the sequence) or, vice versa, the DNA sequence is converted into the corresponding RNA sequence (in particular by replacing the thymidines (T) by uracils (U) throughout the sequence). Thereafter, the sequence identity of the DNA sequences or the sequence identity of the RNA sequences is determined. Preferably, a nucleic acid "derived from" a nucleic acid also refers to nucleic acid, which is modified in comparison to the nucleic acid from which it is derived, e.g. in order to increase RNA stability even further and/or to prolong and/or increase protein production. It goes without saying that such modifications are preferred, which do not impair RNA stability, e.g. in comparison to the nucleic acid from which it is derived.

The term "epitope" (also called "antigen determinant" in the art) as used herein will be recognized and understood by the person of ordinary skill in the art, and is for example intended to refer to T cell epitopes and B cell epitopes. T cell epitopes or parts of the antigenic peptides or proteins may comprise fragments preferably having a length of about 6 to about 20 or even more amino acids, e.g. fragments as processed and presented by MHC class I molecules, preferably having a length of about 8 to about 10 amino acids, e.g. 8, 9, or 10, (or even 11, or 12 amino acids), or fragments as processed and presented by MHC class II molecules, preferably having a length of about 13 to about 20 or even more amino acids, wherein these fragments may be selected from any part of the amino acid sequence. These fragments are typically recognized by T cells in form of a complex consisting of the peptide fragment and an MHC molecule, i.e. the fragments are typically not recognized in their native form. B cell epitopes are typically fragments located on the outer surface of (native) protein or peptide antigens (e.g. Bunyavirales antigens), preferably having 5 to 15 amino acids, more preferably having 5 to 12 amino acids, even more preferably having 6 to 9 amino acids, which may be recognized by antibodies, i.e. in their native form. Such epitopes of proteins or peptides may furthermore be selected from any of the herein mentioned variants of such proteins or peptides. In this context antigenic determinants can be conformational or discontinuous epitopes which are composed of segments of the proteins or peptides as defined herein that are discontinuous in the amino acid sequence of the proteins or peptides as defined herein but are brought together in the three-dimensional structure or continuous or linear epitopes which are composed of a single polypeptide chain.

The term "fragment" as used throughout the present specification in the context of a nucleic acid sequence or an amino acid sequence may typically be a shorter portion of a full-length sequence of e.g. a nucleic acid sequence or an amino acid sequence. Accordingly, a fragment, typically, consists of a sequence that is identical to the corresponding stretch within the full-length sequence. A preferred fragment of a sequence in the context of the present invention, consists of a continuous stretch of entities, such as nucleotides or amino acids corresponding to a continuous stretch of entities in the molecule the fragment is derived from, which represents at least 5%, 10%, 20%, preferably at least 30%, more preferably at least 40%, more preferably at least 50%, even more preferably at least 60%, even more preferably at least 70%, and most preferably at least 80% of the total (i.e. full-length) molecule from which the fragment is derived. The term "fragment" as used throughout the present specification in the context of proteins or peptides may, typically, comprise a sequence of a protein or peptide as defined herein, which is, with regard to its amino acid sequence (or its encoded nucleic acid molecule), N-terminally and/or C-terminally truncated compared to the amino acid sequence of the original (native) protein (or its encoded nucleic acid molecule). Such truncation may thus occur either on the amino acid level or correspondingly on the nucleic acid level. A sequence identity with respect to such a fragment as defined herein may therefore preferably refer to the entire protein or peptide as defined herein or to the entire (coding) nucleic acid molecule of such a protein or peptide. In the context of antigens such fragment may have a length of about 6 to about 20 or even more amino acids, e.g. fragments as processed and presented by MHC class I molecules, preferably having a length of about 8 to about 10 amino acids, e.g. 8, 9, or 10, (or even 8, 7, 11, or 12 amino acids), or fragments as processed and presented by MHC class II molecules, preferably having a length of about 13 or more amino acids, e.g. 13, 14, 15, 16, 17, 18, 19, 20 or even more amino acids, wherein these fragments may be selected from any part of the amino acid sequence. These fragments are typically recognized by T-cells in form of a complex consisting of the peptide fragment and an MHC molecule, i.e. the fragments are typically not recognized in their native form. Fragments of proteins or peptides (e.g. in the context of antigens) may comprise at least one epitope of those proteins or peptides. Furthermore also domains of a protein, like the extracellular domain, the intracellular domain or the transmembrane domain and shortened or truncated versions of a protein may be understood to comprise a fragment of a protein.

The terms "genotype" or "genotype of a virus" as used herein will be recognized and understood by the person of ordinary skill in the art, and are for example intended to refer to the genetic constitution of an individual virus or a group or class of organisms or viruses having the same genetically consistent structure. Genotyping means determining differences in the genetic of an individual, e.g. a virus. In the context of the invention, virus genotype has to be understood as a virus having the same genetically consistent structure, e.g. a genotype of a virus of the order Bunyavirales has to be understood as a virus having the same genetically consistent structure.

The term "heterologous" as used throughout the present specification in the context of a nucleic acid sequence or an amino acid sequence refers to a sequence (e.g. DNA, RNA, amino acid) will be recognized and understood by the person of ordinary skill in the art, and is intended to refer to a sequence that is derived from another gene, from another allele, from another species. Two sequences are typically understood to be "heterologous" if they are not derivable from the same gene or in the same allele. I.e., although heterologous sequences may be derivable from the same organism, they naturally (in nature) do not occur in the same nucleic acid molecule, such as e.g. in the same mRNA.

The terms "humoral immunity" or "humoral immune response" will be recognized and understood by the person of ordinary skill in the art, and are for example intended to refer to B-cell mediated antibody production and optionally to accessory processes accompanying antibody production. A humoral immune response may be typically characterized, e.g. by Th2 activation and cytokine production, germinal center formation and isotype switching, affinity maturation and memory cell generation. Humoral immunity also typically may refer to the effector functions of antibodies, which include pathogen and toxin neutralization, classical complement activation, and opsonin promotion of phagocytosis and pathogen elimination.

The term "identity" as used throughout the present specification in the context of a nucleic acid sequence or an amino acid sequence will be recognized and understood by the person of ordinary skill in the art, and is for example intended to refer to the percentage to which two sequences are identical. To determine the percentage to which two sequences are identical, e.g. nucleic acid sequences or amino acid sequences as defined herein, preferably the amino acid sequences encoded by the artificial nucleic acid sequence as defined herein or the amino acid sequences themselves, the sequences can be aligned in order to be subsequently compared to one another. Therefore, e.g. a position of a first sequence may be compared with the corresponding position of the second sequence. If a position in the first sequence is occupied by the same component (residue) as is the case at a position in the second sequence, the two sequences are identical at this position. If this is not the case, the sequences differ at this position. If insertions occur in the second sequence in comparison to the first sequence, gaps can be inserted into the first sequence to allow a further alignment. If deletions occur in the second sequence in comparison to the first sequence, gaps can be inserted into the second sequence to allow a further alignment. The percentage to which two sequences are identical is then a function of the number of identical positions divided by the total number of positions including those positions which are only occupied in one sequence. The percentage to which two sequences are identical can be determined using a mathematical algorithm. A preferred, but not limiting, example of a mathematical algorithm which can be used is the algorithm is integrated in the BLAST program. Sequences which are identical to the sequences of the present invention to a certain extent can be identified by this program.

The terms "immunogen" or "immunogenic" will be recognized and understood by the person of ordinary skill in the art, and are for example intended to refer to a compound that is able to stimulate/induce an immune response. Preferably, an immunogen is a peptide, polypeptide, or protein. An immunogen in the sense of the present invention is the product of translation of a provided artificial nucleic acid comprising at least one coding sequence encoding at least one antigenic peptide, protein or polyprotein derived from a virus of the order Bunyavirales as defined herein. Typically, an immunogen elicits an adaptive immune response.

The term "immune response" will be recognized and understood by the person of ordinary skill in the art, and is for example intended to refer to a specific reaction of the adaptive immune system to a particular antigen (so called specific or adaptive immune response) or an unspecific reaction of the innate immune system (so called unspecific or innate immune response), or a combination thereof.

The term “immune system” will be recognized and understood by the person of ordinary skill in the art, and is for example intended to refer to a system of the organism that may protect the organisms from infection. If a pathogen succeeds in passing a physical barrier of an organism and enters this organism, the innate immune system provides an immediate, but non-specific response. If pathogens evade this innate response, vertebrates possess a second layer of protection, the adaptive immune system. Here, the immune system adapts its response during an infection to improve its recognition of the pathogen. This improved response is then retained after the pathogen has been eliminated, in the form of an immunological memory, and allows the adaptive immune system to mount faster and stronger attacks each time this pathogen is encountered. According to this, the immune system comprises the innate and the adaptive immune system. Each of these two parts typically contains so called humoral and cellular components.

The term "innate immune system" (also known as non-specific or unspecific immune system) will be recognized and understood by the person of ordinary skill in the art, and is for example intended to refer to a system typically comprising the cells and mechanisms that defend the host from infection by other organisms in a non-specific manner. This means that the cells of the innate system may recognize and respond to pathogens in a generic way, but unlike the adaptive immune system, it does not confer long-lasting or protective immunity to the host. The innate immune system may be, e.g. activated by ligands of Toll-like receptors (TLRs) or other auxiliary substances such as lipopolysaccharides, TNF-alpha, CD40 ligand, or cytokines, monokines, lymphokines, interleukins or chemokines, IL-1, IL-2, IL-3, IL-4, IL-5, IL-6, IL-7, IL-8, IL-9, IL-10, IL-11, IL-12, IL-13, IL-14, IL-15, IL-16, IL-17, IL-18, IL-19, IL-20, IL-21, IL-22, IL-23, IL-24, IL-25, IL-26, IL-27, IL-28, IL-29, IL-30, IL-31, IL-32, IL-33, IFN-alpha, IFN-beta, IFN-gamma, GM-CSF, G-CSF, M-CSF, LT-beta, TNF-alpha, growth factors, and hGH, a ligand of human Toll-like receptor TLR1, TLR2, TLR3, TLR4, TLR5, TLR6, TLR7, TLR8, TLR9, TLR10, a ligand of murine Toll-like receptor TLR1, TLR2, TLR3, TLR4, TLR5, TLR6, TLR7, TLR8, TLR9, TLR10, TLR11, TLR12 or TLR13, a ligand of a NOD-like receptor, a ligand of a RIG-1 like receptor, an immunostimulatory nucleic acid, an immunostimulatory RNA (isRNA), a CpG-DNA, an antibacterial agent, or an anti-viral agent.

The terms "isolate" or "isolate of a virus" as used herein, will be recognized and understood by the person of ordinary skill in the art, and are for example intended to refer to a specific isolated virus of a certain virus species. In the context of the invention, a natural Bunyavirales isolate is an instance of a particular natural virus or of a particular genetic strain (or variant). Isolates can be identical or slightly different in consensus or individual sequence from each other.

The terms "monovalent" or "monovalent vaccine" (univalent vaccine) will be recognized and understood by the person of ordinary skill in the art, and are for example intended to refer to a vaccine (or composition) designed against a single antigen for a single organism (e.g. virus). The term "monovalent vaccine" includes the immunization against a single valence. In the context of the invention, a monovalent Bunyavirales vaccine would comprise a vaccine comprising an artificial nucleic acid encoding one single antigenic peptide, protein, or polyprotein derived from one specific virus of the order Bunyavirales.

The terms "nucleic acid" or "nuclei acid molecule" will be recognized and understood by the person of ordinary skill in the art, and are for example intended to refer to a molecule comprising, preferably consisting of nucleic acid components. The term nucleic acid molecule preferably refers to DNA or RNA molecules. It is preferably used synonymous with the term polynucleotide. Preferably, a nucleic acid or a nucleic acid molecule is a polymer comprising or consisting of nucleotide monomers, which are covalently linked to each other by phosphodiester-bonds of a sugar/phosphate-backbone. The term "nucleic acid molecule" also encompasses modified nucleic acid molecules, such as base-modified, sugar-modified or backbone-modified DNA or RNA molecules as defined herein.

The terms "nucleic acid sequence" or "amino acid sequence" will be recognized and understood by the person of ordinary skill in the art, and are for example intended to refer to particular and individual order of the succession of its nucleotides or amino acids respectively.

The terms "orthologues" and "paralogues" (of a sequence) will be recognized and understood by the person of ordinary skill in the art, and are for example intended to refer to evolutionary concepts used to describe the ancestral relationships of genes and their corresponding gene products (proteins). Paralogues are genes (or proteins) within the same species that have originated through duplication of an ancestral gene; orthologues are genes (or proteins) from different organisms that have originated through speciation, and are also derived from a common ancestral gene.

The term "peptide" will be recognized and understood by the person of ordinary skill in the art, and are for example intended to refer to a polymer of amino acid monomers, linked by peptide bonds. It typically contains less than 50 amino acid monomers. Nevertheless, the term peptide is not a disclaimer for molecules having more than 50 amino acid monomers.

The terms "pharmaceutically effective amount" or "effective amount" will be recognized and understood by the person of ordinary skill in the art, and are for example intended to refer to an amount of a compound (e.g. the artificial nucleic acid of the invention) that is sufficient to induce a pharmaceutical effect, such as, in the context of the invention, an immune response (e.g. against an antigenic peptide, protein, polyprotein as defined herein).

The term "strain" or "strain of a virus" is a group of viruses that are genetically distinct from other groups of the same species. Accordingly, a "strain" is a variant of a given virus (species) that is recognizable because it possesses some unique phenotypic characteristics that remain stable under natural conditions. In the context of the invention, the terms "variant" of a virus and "strain" of a virus are used interchangeably.

The term "stabilized nucleic acid molecule" or "stabilized RNA" refer to is a nucleic acid molecule, preferably an RNA molecule that is modified such, that it is more stable to disintegration or degradation, e.g., by environmental factors or enzymatic digest, such as by an exo- or endonuclease degradation, than the nucleic acid molecule without the modification. Preferably, a stabilized nucleic acid molecule, e.g. stabilized RNA, in the context of the present invention is stabilized in a cell, such as a prokaryotic or eukaryotic cell, preferably in a mammalian cell, such as a human cell. The stabilization effect may also be exerted outside of cells, e.g. in a buffer solution etc., for example, in a manufacturing process for a pharmaceutical composition comprising the stabilized nucleic acid molecule.

The term "transfection" will be recognized and understood by the person of ordinary skill in the art, and is for example intended to be a process where nucleic acid molecules, such as DNA or RNA (e.g. mRNA) molecules are introduced into cells, preferably into eukaryotic cells, most preferably into mammalian cells. In the context of the present invention, the term "transfection" encompasses any method known to the skilled person for introducing nucleic acid molecules into cells, preferably into eukaryotic cells, such as into mammalian cells. Such methods encompass, for example, electroporation, lipofection, e.g. based on cationic lipids and/or liposomes, calcium phosphate precipitation, nanoparticle based transfection, virus based transfection, or transfection based on cationic polymers, such as DEAE-dextran or polyethylenimine etc.

The term "variant" as used throughout the present specification in the context of a nucleic acid sequence will be recognized and understood by the person of ordinary skill in the art, and is for example intended to refer to a variant of nucleic acid sequences which forms the basis of a nucleic acid sequence. For example, a variant nucleic acid sequence may exhibit one or more nucleotide deletions, insertions, additions and/or substitutions compared to the nucleic acid sequence from which the variant is derived. Preferably, a variant of a nucleic acid sequence is at least 40%, preferably at least 50%, more preferably at least 60%, more preferably at least 70%, even more preferably at least 80%, even more preferably at least 90%, most preferably at least 95% identical to the nucleic acid sequence the variant is derived from. Preferably, the variant is a functional variant. A "variant" of a nucleic acid sequence may have at least 70%, 75%, 80%, 85%, 90%, 95%, 98% or 99% nucleotide identity over a stretch of 10, 20, 30, 50, 75 or 100 nucleotide of such nucleic acid sequence.

The term "variant" as used throughout the present specification in the context of proteins or peptides will be recognized and understood by the person of ordinary skill in the art, and is for example intended to refer to a proteins or peptide variant having an amino acid sequence which differs from the original sequence in one or more mutation(s), such as one or more substituted, inserted and/or deleted amino acid(s). Preferably, these fragments and/or variants have the same biological function or specific activity compared to the full-length native protein, e.g. its specific antigenic property. "Variants" of proteins or peptides as defined in the context of the present invention may comprise conservative amino acid substitution(s) compared to their native, i.e. non-mutated physiological, sequence. Those amino acid sequences as well as their encoding nucleotide sequences in particular fall under the term variants as defined herein. Substitutions in which amino acids, which originate from the same class, are exchanged for one another are called conservative substitutions. In particular, these are amino acids having aliphatic side chains, positively or negatively charged side chains, aromatic groups in the side chains or amino acids, the side chains of which can enter into hydrogen bridges, e.g. side chains which have a hydroxyl function. This means that e.g. an amino acid having a polar side chain is replaced by another amino acid having a likewise polar side chain, or, for example, an amino acid characterized by a hydrophobic side chain is substituted by another amino acid having a likewise hydrophobic side chain (e.g. serine (threonine) by threonine (serine) or leucine (isoleuine) by isoleuine (leucine)). Insertions and substitutions are possible, in particular, at those sequence positions which cause no modification to the three-dimensional structure or do not affect the binding region. Modifications to a three-dimensional structure by insertion(s) or deletion(s) can easily be determined e.g. using CD spectra (circular dichroism spectra). A "variant" of a protein or peptide may have at least 70%, 75%, 80%, 85%, 90%, 95%, 98% or 99% amino acid identity over a stretch of 10, 20, 30, 50, 75 or 100 amino acids of such protein or peptide. Preferably, a variant of a protein comprises a functional variant of the protein, which means that the variant exerts the same effect or functionality as the protein it is derived from.

The term "vector" will be recognized and understood by the person of ordinary skill in the art, and are for example intended to refer to a nucleic acid molecule, preferably to an artificial nucleic acid. A vector in the context of the present invention is suitable for incorporating or harboring a desired nucleic acid sequence, such as a nucleic acid sequence comprising a coding sequence, e.g. an artificial nucleic acid sequence according to the invention. Such vectors may be storage vectors, expression vectors, cloning vectors, transfer vectors etc. A storage vector is a vector which allows the convenient storage of a nucleic acid molecule, for example, of an mRNA molecule. Thus, the vector may comprise a sequence corresponding, e.g. to a desired mRNA sequence or a part thereof, such as a sequence corresponding to the coding sequence and the 3'-UTR and/or the 5'-UTR of an mRNA. An expression vector may be used for production of expression products such as RNA, e.g. mRNA, or peptides, polypeptides or proteins. For example, an expression vector may comprise sequences needed for transcription of a sequence stretch of the vector, such as a promoter sequence, e.g. an RNA polymerase promoter sequence. A cloning vector is typically a vector that contains a cloning site, which may be used to incorporate nucleic acid sequences into the vector (A cloning site typically comprises one or more restriction enzyme recognition sites (restriction sites). A cloning vector may be, e.g. a plasmid vector or a bacteriophage vector. A transfer vector may be a vector which is suitable for transferring nucleic acid molecules into cells or organisms, for example, viral vectors (DNA virus or RNA virus). A vector in the context of the present invention may be, e.g. an RNA vector or a DNA vector as defined above comprising a nucleic acid sequence, preferably at least one coding sequence encoding at least one amino acid sequence derived from a virus of the order Bunyavirales.

SHORT DESCRIPTION OF THE INVENTION

The present invention is based on the inventors surprising finding that at least one peptide or protein derived from a Bunyavirales virus particularly at least one antigenic peptide or protein of a Severe fever with thrombocytopenia syndrome virus (SFTSV), Rift Valley fever virus (RVFV), or Crimean-Congo hemorrhagic fever virus (CCHFV) encoded by the artificial nucleic acid, particularly the artificial RNA of the invention can efficiently be expressed in a mammalian cell.

Further unexpectedly, the artificial nucleic acid, particularly the artificial RNA encoding at least one antigenic peptide or protein of a Bunyavirales virus induces very efficient antigen-specific immune responses against the encoded antigenic peptide or protein. The artificial nucleic acid, particularly the artificial RNA encoding at least one antigenic peptide or protein of a SFTSV, RVF, or CCHFV induces very efficient antigen-specific immune responses against the encoded antigenic peptide or protein. Accordingly, the nucleic acid of the invention is suitable for eliciting an immune response against Bunyavirales virus, particularly against a SFTSV, RVFV, or CCHFV in a mammalian subject, in particular, in a human subject. The artificial nucleic acid, particularly the artificial RNA of the invention is therefore suitable for use as a vaccine, e.g. as a veterinary vaccine, preferably as a human vaccine.

Notably, the findings of the present invention may be adapted to and applied for developing corresponding artificial nucleic acid constructs, particularly of corresponding artificial RNA constructs suitable for eliciting an immune response against any pathogen of the order Bunyavirales, particularly against any pathogen of the Hantaviridae family (e.g. viruses of the genus Orthohantavirus), pathogens of the Nairoviridae family (e.g. viruses of the genus Orthonairovirus), and pathogens of the Peribunyaviridae family (e.g.

viruses of the genus Orthobunyavirus), the Phenuiviridae family (e.g. viruses of the genus Phlebovirus) as described herein.

Further advantages of the artificial nucleic acid, particularly the artificial RNA (or the composition comprising the artificial nucleic acid or the vaccine comprising the artificial nucleic) are:

- Induction of a strong and specific humoral immune response and induction of B-cell memory
- Fast onset of immune protection ideally after the first vaccination
- Induction of long-lived specific immune responses
- Induction of long-lived neutralizing antibody titers
- Induction of broad cellular T-cell responses
- No induction of systemic cytokine or chemokine response
- Well tolerability, no side-effects, non-toxic, non-teratogen
- Advantageous stability characteristics. e.g. heat stable (e.g. lyophilizable)
- No vector immunity, i.e. technology can be used to vaccinate the same subject multiple times against multiple (different) antigen providing artificial nucleic acids
- No biosafety issues during vaccine development/manufacturing as for vaccines based on live attenuated viruses
- No danger of reversion to virulence via genetic reassortment with wild type virus as for vaccines based on live attenuated viruses
- Scalable, fast-adaptable, cost-effective, time efficient and simple production process
- RNA based vaccines show no danger of genomic integration as observed for DNA-based approaches
- RNA based vaccines show no danger of anti-drug antibodies as observed for DNA-based approaches In a first aspect, the present invention provides artificial nucleic acids, particularly artificial RNAs comprising at least one coding sequence encoding at least one antigenic peptide or protein derived from a virus of the order Bunyavirales or a fragment or variant thereof.

In embodiments, the artificial RNA comprises or consists of a coding sequence encoding Glycoprotein and/or a Nucleoprotein or a fragment or variant of any of these, wherein the Glycoprotein comprises or consists of GP, Gn, Gne, Gc, GP38, GP85, GP160 and/or NSm or a fragment or variant of any of these.

The artificial RNA may further comprise a 5'-cap structure, and/or a 5'-UTR, and/or a poly(A) sequence and/or a poly(C) sequence and/or a histone stem-loop, and/or a 3'-UTR, and/or an additional poly(A) sequence.

In another aspect, the invention relates to a composition comprising at least one artificial RNA.

The artificial RNA comprised in the composition may additionally be complexed or at least partially complexed with one or more cationic or polycationic compound, preferably with a cationic or polycationic polymer, cationic or polycationic polysaccharide, cationic or polycationic lipid, cationic or polycationic protein, cationic or polycationic peptide, or any combinations thereof.

The artificial RNA comprised in the composition may be at least partially complexed with protamine. In an embodiment, the composition may comprise at least one protamine complexed artificial RNA and at least one free RNA, wherein the molar ratio of the complexed nucleic acid to the free nucleic acid about 1:1.

In another embodiment, the composition may comprise an RNA complexed with one or more lipids, thereby forming lipid nanoparticles (LNPs).

The present invention also concerns a Bunyavirales vaccine, particularly, a SFTSV, RVFV, or CCHFV vaccine.

The present invention is also directed to the use of the artificial RNA, the composition and the vaccine in treatment or prophylaxis of an infection with a virus of the order Bunyavirales.

In particular, the present invention is directed to the use of the artificial RNA, the composition and the vaccine in treatment or prophylaxis of an infection with SFTSV, RVFV, or CCHFV or a disorder related to such an infection.

The invention further concerns a method of treating or preventing a disorder or a disease in a subject, first and second medical uses of the artificial RNA, compositions and vaccines. Further, the invention is directed to a kit, particularly to a kit of parts, comprising the artificial RNA, compositions and vaccines.

DETAILED DESCRIPTION OF THE INVENTION

The present application is filed together with a sequence listing in electronic format, which is part of the description of the present application (WIPO standard ST.25). The information contained in the electronic format of the sequence listing filed together with this application is incorporated herein by reference in its entirety. For many sequences, the sequence listing also provides additional detailed information, e.g. regarding certain structural features, sequence optimizations, GenBank identifiers, or additional detailed information regarding its coding capacity. In particular, such information is provided under numeric identifier <223> in the WIPO standard ST.25 sequence listing. Accordingly, information provided under said numeric identifier <223> is explicitly included herein in its entirety and has to be understood as integral part of the description of the underlying invention.

Viruses of the Order Bunyavirales:

In a first aspect, the invention relates to an artificial nucleic acid comprising at least one coding sequence encoding at least one antigenic peptide or protein derived from at least one virus of the order Bunyavirales (also herein referred to as "virus of the order Bunyavirales" or "Bunyavirales virus" or "Bunyavirales").

In this context, the terms "artificial nucleic acid" as used herein will be recognized and understood by the person of ordinary skill in the art, and are for example intended to refer to a nucleic acid molecule. e.g. a DNA or an RNA that does not occur naturally. In other words, an artificial nucleic acid may be understood as a non-natural nucleic acid molecule. Such nucleic acid molecule may be non-natural due to its individual sequence (which does not occur naturally, e.g. G/C content modified coding sequence, UTRs) and/or due to other modifications, e.g. structural modifications of nucleotides which do not occur naturally. An artificial nucleic acid may be a DNA molecule, an RNA molecule or a hybrid-molecule comprising DNA and RNA portions. Typically, artificial nucleic acids may be designed and/or generated by genetic engineering methods to correspond to a desired artificial sequence of nucleotides (heterologous sequence). In this context an artificial sequence is usually a sequence that may not occur naturally. i.e. it differs from the wild type sequence by at least one nucleotide. The term "wild type" as used herein will be recognized and understood by the person of ordinary skill in the art, and is for example intended to refer to a sequence occurring in nature. Further, the term "artificial nucleic acid" is not restricted to mean "one single molecule" but is, typically, understood to comprise an ensemble of essentially identical molecules. Accordingly, it may relate to a plurality of essentially identical molecules contained in an aliquot or a sample.

The term "coding sequence" or the corresponding abbreviation "cds" as used herein will be recognized and understood by the person of ordinary skill in the art, and are for example intended to refer to a sequence of several nucleotide triplets, which may be translated into a peptide or protein. A coding sequence in the context of the present invention is preferably a nucleotide sequence, consisting of a number of nucleotides that may be divided by three, which starts with a start codon and which preferably terminates with a stop codon. The coding sequence may be isolated or it may be incorporated in a longer nucleic acid sequence, for example in a DNA vector or an RNA, particularly in an mRNA.

The term "antigenic peptide or protein" will be recognized and understood by the person of ordinary skill in the art, and is for example intended to refer to a peptide, protein (or polyprotein) derived from a (antigenic) protein/polyprotein which may stimulate the body's adaptive immune system to provide an adaptive immune response. Therefore an "antigenic peptide or protein" comprises at least one epitope (as defined herein) or antigen (as defined herein) of the protein it is derived from.

The terms "virus of the order Bunyavirales" or "Bunyavirales virus" or "Bunyavirales" will be recognized and understood by the person of ordinary skill in the art, referring to any virus, strain, variant, isolate, serotype, or genetic reassortant of any virus of the order Bunyavirales (previous taxonomy: Bunyaviridae). The taxonomy of the order Bunyavirales (Taxonomy ID: 1980410; according to NCBI taxonomy database) has been recently revised and re-allocated (see International Committee on Taxonomy of Viruses (ICTV); virus taxonomy report 2016). According to the current virus taxonomy, the order Bunyavirales comprises the Feraviridae family (Genus: Orthoferavirus), the Fimoviridae family (Genus: Emaravirus), the Hantaviridae family (Genus: Orthohantavirus), the Jonviridae family (Genus: Orthojonvirus), the Nairoviridae family (Genus: Orthonairovirus), the Peribunyaviridae family (Genera: Herbevirus, Orthobunyavirus) the Phasmaviridae family (Genus: Orthophasmavirus), the Phenuiviridae family (Genera: Goukovirus, Phasivirus, Phlebovirus, Tenuivirus) and the Tospoviridae family (Genus: Orthotospovirus). Accordingly, any virus, virus member, virus strain, virus type, virus sub-type, virus isolate, virus variant, or virus serotype or genetic reassortant of a virus of the belonging to or related to or derived from viruses of the families and genera listed above are considered to be a "virus of the order Bunyavirales" or a "Bunyavirales virus" or "Bunyavirales" in the context of the present invention.

Suitably, the artificial nucleic acid comprises at least one coding sequence encoding at least one antigenic peptide or protein derived from at least one virus of the order Bunyavirales, wherein the at least one virus of the order Bunyavirales may be selected from a member of the Feraviridae family, the Fimoviridae family, the Hantaviridae family, the Jonviridae family, the Nairoviridae family, the Peribunyaviridae family, the Phasmaviridae family, the Phenuiviridae family, or the Tospoviridae family.

In preferred embodiments, the artificial nucleic acid comprises at least one coding sequence encoding at least one antigenic peptide or protein derived from at least one virus of the order Bunyavirales, wherein the at least one virus of the order Bunyavirales is selected from a member of the Hantaviridae family, the Nairoviridae family, the Peribunyaviridae family, or the Phenuiviridae family.

The virus of the Hantaviridae family is suitably selected from any virus from the genus Orthohantavirus.

Accordingly, the at least one virus of the invention may be selected from any virus, virus member, virus strain, virus type, virus sub-type, virus isolate, virus variant, or virus serotype or genetic reassortant of a virus of the genus Orthohantavirus (NCBI Taxonomy ID: 1980442; according to NCBI taxonomy database).

In preferred embodiments, the virus of the genus Orthohantavirus is suitably selected from Amga orthohantavirus, Andes orthohantavirus, Asama orthohantavirus, Asikkala orthohantavirus, Bayou orthohantavirus, Black Creek Canal orthohantavirus, Bowe orthohantavirus, Bruges orthohantavirus, Cano Delgadito orthohantavirus, Cao Bang orthohantavirus, Choo orthohantavirus, Dabieshan orthohantavirus, Dobrava-Belgrade orthohantavirus, El Moro Canyon orthohantavirus, Fugong orthohantavirus, Fusong orthohantavirus, Hantaan orthohantavirus, Imjin orthohantavirus, Jeju orthohantavirus, Kenkeme orthohantavirus, Khabarovsk orthohantavirus, Laguna Negra orthohantavirus, Laibin orthohantavirus, Longquan orthohantavirus, Luxi orthohantavirus, Maporal orthohantavirus, Montano orthohantavirus, Necoci orthohantavirus, Nova orthohantavirus, Oxbow orthohantavirus, Prospect Hill orthohantavirus, Puumala orthohantavirus, Quezon orthohantavirus, Rockport orthohantavirus, Sangassou orthohantavirus, Seoul orthohantavirus, Sin Nombre orthohantavirus, Thailand orthohantavirus, Thottapalayam orthohantavirus, Tula orthohantavirus, Yakeshi orthohantavirus, New York hantavirus, Isla Vista hantavirus, Muleshoe hantavirus, New York hantavirus, Rio Mamore hantavirus, Rio Segundo hantavirus, Saaremaa hantavirus, Topografov hantavirus, unclassified Hantavirus, or any virus member, virus strain, virus type, virus sub-type, virus isolate, virus variant, or virus serotype of any of these viruses.

In preferred embodiments, the virus of the genus Orthohantavirus is selected from the list provided below. Therein, for each virus (e.g. "Hantaan orthohantavirus") the NCBI taxonomy ID is provided (e.g. "1980471") and respective virus members are indicated (e.g. "Hantaan virus") including their NCBI taxonomy IDs (e.g. "11601, 11602, 31617, 73011, 162161, 164247, 164248, 198799, 198800, 198801, 370830, 412620, 1054851, 1054852, 1054853, 1054854, 1054855, 1054856, 1054857, 1054858, 1054859, 1127365") and the abbreviation as used throughout the specification (e.g. "HTNV"): Amga orthohantavirus (1980455): Amga virus (1511732); Andes orthohantavirus (1980456): Andes virus (ANDV) (1980456), Araraquara virus (139032), Araraquara-like virus (443745), Bermejo virus (BMJV) (69243), Castelo dos Sonhos virus (139033), Central Plata virus (374423), Hu39694 virus (69244), Jabora hantavirus (436675). Juquitiba-like virus (321613, 537334, 537360, 537477), Lechiguanas virus (LECV) (69245). Maciel virus (MCLV) (69246), Neembucu hantavirus (367400), Oran virus (ORNV) (69247), Pergamino virus (PRGV) (69248), Tunari virus (TUNV) (1085569); Asama orthohantavirus (1980457): Asama virus (564878); Asikkala orthohantavirus (1980458): Asikkala virus (ASIV) (1325569); Bayou orthohantavirus (1980459): Bayou orthohantavirus (BAYV) (1980459); Black Creek Canal orthohantavirus (1980460): Black Creek Canal orthohantavirus (BCCV) (1980460); Bowe orthohantavirus (1980461): Bowe virus (1400425); Bruges orthohantavirus (1980462): Bruges virus (1679445); Cano Delgadito orthohantavirus (1980463): Cano Delgadito virus (CADV) (1980463); Cao Bang orthohantavirus (1980464): Cao Bang virus (451711); Choo orthohantavirus (1980465): Choo virus (169173); Dabieshan orthohantavirus (1980466): Dabieshan virus (1167310); Dobrava-Belgrade orthohantavirus (1980467): Dobrava-Belgrade orthohantavirus (DOBV) (1980467), Kurkino virus; El Moro Canyon orthohantavirus (1980468): El Moro Canyon orthohantavirus (ELMCV/HMV-1) (1980468); Fugong orthohantavirus (Fusong orthohantavirus) (1980469): Eothenomys eleusis hantavirus (FUGV) (1788456); Hantaan orthohantavirus (1980471): Hantaan virus (HTNV) (11601, 11602, 31617, 73011, 162161, 164247, 164248, 198799, 198800, 198801, 370830, 412620, 1054851, 1054852, 1054853, 1054854, 1054855, 1054856, 1054857, 1054858, 1054859, 1127365), Hantaan-like virus (33731), Hantaanvirus (458667, 458668, 458669, 458670, 458671, 458672, 458673, 458674, 458675, 458676, 458677, 458678, 470916, 470917, 470918, 470919, 470920, 508669, 508670, 508671, 508672, 508674, 508675), Hantanvirus (333144, 333145), Hantavirus (74941, 74942, 74943, 135736, 135737, 164255, 164256, 310790, 310791, 424371, 424372, 424373, 424374, 424375, 424376, 424377, 424378, 424379, 424380, 424381, 424382, 453900), HoJo virus (11583); Imjin orthohantavirus (1980472): Imjin virus (467989); Jeju orthohantavirus (1980473): Jeju virus (990280); Kenkeme orthohantavirus (1980474): Kenkeme virus (765147); Khabarovsk orthohantavirus (1980475): Khabarovsk orthohantavirus (KHAV) (1980475), Vladivostok virus (74537); Laguna Negra orthohantavirus (1980476): Laguna Negra orthohantavirus (LANV) (1980476); Laibin orthohantavirus (1980477): Laibin virus (1633187); Longquan orthohantavirus (1980478): Longquan virus (LQUV) (1283294); Luxi orthohantavirus (1980479): Eothenomys miletus hantavirus (943342, 1001974); Maporal orthohantavirus (1980480): Maporal virus (238817); Montano orthohantavirus (1980481): Montano virus (1000585); Necocli orthohantavirus (1980482): Necocli virus (1145238); Nova orthohantavirus (1980483): Nova virus (660955); Oxbow orthohantavirus (1980484): Oxbow virus (660954); Prospect Hill orthohantavirus (1980485): Prospect Hill orthohantavirus (PHV) (1980485), Bloodland Lake virus (BLLV); Puumala orthohantavirus (1980486): Hantavirus (136358, 136359), Muju virus (MUV) (340093), Puumala virus (PUUV) (11605, 11606, 38998, 38999, 39000, 39001, 39002, 39003, 1337063), Puumala-like virus (428554, 428555, 428556, 428557, 428558, 428559); Quezon orthohantavirus (1980487): Quezon virus (1841195); Rockport orthohantavirus (1980488): Rockport virus (1001080); Sangassou orthohantavirus (1980489): Sangassou virus (SANGV) (1980489); Seoul orthohantavirus (1980490): Hantavirus (164252, 279233, 350036, 381329, 381330, 453895, 453896, 453897, 453898, 453899), Sapporo rat virus (11607), Seoul virus (SEOV) (11610, 12557, 31620, 164246, 164251, 164253, 164254, 280855, 374467, 929037, 929038, 929039, 929040, 929041, 929042, 929043, 929044, 929045, 929046, 929047, 929048, 929049, 929050, 993446, 993447, 993448, 993449, 993450, 993451, 993452, 993453, 993454, 993455, 993456, 993457, 993458, 993459, 993460, 993461, 993462, 993463, 993464, 993465, 993466). Seoulvirus (SEOV) (31619, 44269, 72683, 72684, 93831, 147455), Seoulvirus tchoupitoulas (147454); Sin Nombre orthohantavirus (1980491): Blue River virus (BRV) (69294), Convict Creek 107 virus or Pulmonary syndrome hantavirus (HPS) (32614). Four Corners hantavirus (31621), Monongahela virus (MGLV) Sin Nombre orthohantavirus (SNV) (1980491); Thailand orthohantavirus (1980492): Thailand virus (THAIV) (401485, 401486, 401487, 401488); Thottapalayam orthohantavirus (1980493): Thottapalayam orthohantavirus (TPMV) (1980493); Tula orthohantavirus (1980494): Hantavirus (96509, 96510). Tula orthohantavirus (TULV) (1980494); Yakeshi orthohantavirus (1980495): Yakeshi virus (1314974); Isla Vista hantavirus (42097): Isa Vista virus (ISLAV/ILV) (42097); Muleshoe hantavirus (47301): Muleshoe virus (MULV) (47301); New York hantavirus (44755): New York virus (NYV) (44755); Rio Mamore hantavirus (46920): Anajatuba virus (379964), Maripa virus Rio Mamore hantavirus (RIOMV) (46920), Rio Mearim virus (379963); Rio Segundo hantavirus (37207): Rio Segundo virus (RIOSV) (37207); Saaremaa hantavirus (159479): Saaremaa virus (SAAV) (159479); Topografov hantavirus (83192): Topografov virus (TOPV) Taimyr hantavirus (59565); unclassified Hantavirus (339351): Adler hantavirus (1578833), Altai virus (517361), Altai-like virus (1570420). Alto Paraguay hantavirus (261202), Amur virus (86782, 104577, 104578, 104579, 170954, 170955, 170956, 170957), Hantavirus Amur (86782, 172275, 172276, 172277), ANAJ Hantavirus (1244521), Anjozorobe hantavirus (1424613), Ape Aime-Itapua virus (700375), Araucaria virus (308159), Artybash virus (517360), Ash River virus (466216), Azagny virus (1001081), Boginia virus (1246675), Bmo virus (1744961), Calabazo virus (169174), Camp Ripley virus (460676). Carrizal virus (1000586), Castelo dos Sonhos-2 virus (1244524). CASV Hantavirus (1244522). CASV-2 Hantavirus (1244523), Catacamas virus (343870), Dahonggou Creek virus (937388), Eothenomys miletus hantavirus (943342), Gou virus (1285463), Hantavirus (31618, 37741, 38016, 42356, 42357, 42358, 74944, 93830, 103811, 104542, 104543, 104544, 104545, 104546, 104547, 104548, 104549, 104550, 104551, 104552, 104553, 104554, 104555, 104556, 104557, 104558, 104559, 104560, 104561, 104562, 104563, 104564, 104565, 104566, 104567, 104568, 104569, 104570, 104571, 104572, 104573, 104574, 104575, 104576, 124855, 135285, 139643, 164249, 164250, 172275, 172276, 172277, 289236, 308061, 367397, 367398, 367399, 414241, 443627, 458679, 458680, 462216, 462217, 462218, 462219, 462220, 462221, 469960, 469961, 469962, 469963, 469964, 469965, 46996, 470160, 496406, 496407, 496408, 496409, 497342, 497343, 497344, 497915, 513165, 513166, 513167, 515160, 515161, 515162, 515163, 560790, 560791, 560792, 560793, 560794, 560795, 560796, 587478, 587479, 587480, 587481, 587482, 587483, 587484, 587485, 587486, 587487, 587488, 587489, 587490, 587491, 587492, 587493, 640506, 640507, 641884, 641885, 641886, 641887, 641888, 650036, 659338, 659339, 666189, 666190, 691767, 714974, 714975, 714976, 714977, 858297, 911297, 911298, 934412, 934413, 937784, 1031707, 1055451, 1055452, 1055453, 1055454, 1076281, 1076282, 1076283, 1076284, 1076285, 1093930, 1093931, 1093932, 1093933, 1093934, 1093935, 1093936, 1093937, 1093938, 1093939, 1093940, 1093941, 1093942, 1093943, 1093944, 1093945, 1093946, 1093947, 1093948, 1093949, 1093950, 1093951, 1093952, 1093953, 1093954, 1093955, 1093956, 1093957, 1116392, 1116393, 1116394, 1116395, 1116396, 1116397, 1116398, 1134037, 1417603, 1417604, 1417605, 1417606, 1417607, 1417608, 1417609, 1417610, 1417611, 1417612, 1417613, 1417614, 1417615, 1417616, 1417617, 1417618, 1417619, 1464144, 1571455, 1677947, 1677949, 1677950, 1779847, 1779848, 1779849, 1779850, 1779851, 1779852, 1809451, 1811502, 1811503), Hokkaido virus (1100878), Huangpi virus (1314972). Huitzilac virus (1000587), Itapua hantavirus (261204), Jabora virus (436077), Jemez Springs virus (466215), Juquitiba virus (430511), Kiimanjaro virus (1201042), Korf virus (1519087), LANV-2 Hantavirus (1244525), Lianghe virus (1314973), Limestone Canyon virus (139445), Lohja virus (1577652), Makokou virus (1883431), Maripa hantavirus (654422), Mouyassue virus (1174522), Neomys anomalus hantavirus (516542), Newfound Gap hantavirus (249190), Playa de Oro hantavirus (454121), Prairie vole hantavirus (37477), Qian Hu Shan virus (745387), RIOMV-3 Hantavirus (1244526), RIOMV-4 Hantavirus (1244527), Sarufutsu virus (1405791), Seewis virus (450605), Serang virus (528322), Soochong virus (286540), Soochong virus-1 (286541), Soochong virus-2 (286542), Soochong virus-3 (286543), Soochong virus-4 (286544), Sorex araneus hantavirus (516543), Tanganya virus (425088). Tatenale virus (1313091), Tigray hantavirus (1268011), Uluguru virus (1201040), Ussuri virus (1107325), Uurainen virus (1577651), Xinyi virus (1405799), Xuan son virus (1303862), Yuanjiang virus (1538453), Hantavirus sp.

In particularly preferred embodiments, the virus of the genus Orthohantavirus as defined above is suitably selected from Andes hantavirus (alternative names: Andes virus, Andes orthohantavirus; abbreviation as used herein: "ANDV"), Black Creek Canal hantavirus virus (alternative names: Black Creek Canal orthohantavirus, Black Creek Canal virus; abbreviation as used herein: "BCCV"), Dobrava-Belgrade hantavirus (alternative names: Dobrava-Belgrade orthohantavirus, Dobravavirus, Dobrava-Belgrade virus, Dobrava virus; abbreviation as used herein: "DOBV"), Haantan virus (alternative names: Korean hemorrhagic fever virus, Hantaan hantavirus, Hantaanvirus, Hantan hantavirus, Hantanvirus; abbreviation as used herein: "HTNV"), Laguna Negra hantavirus (alternative names: Laguna Negra orthohantavirus, Laguna Negra virus; abbreviation as used herein: "LANV"), Longquan hantavirus (alternative names: Longquan orthohantavirus, Longquan virus; abbreviation as used herein: "LQUV"), Puumala hantavirus (alternative names: Puumala orthohantavirus, Puumala virus, Puumalavirus, Puumala virus PV, nephropathia epidemica virus; abbreviation as used herein: "PUUV"), Sangassou hantavirus (alternative names: Sangassou orthohantavirus, Sangassou virus, epidemic hemorrhagic fever virus; abbreviation as used herein: "SANGV"), Seoul hantavirus (alternative names: Seoul orthohantavirus, Seoul virus, Seoulvirus; abbreviation as used herein: "SEOV"), Sin Nombre hantavirus (alternative name: Sin Nombre orthohantavirus, Sin Nombre virus; abbreviation as used herein: "SNV"). Thailand hantavirus (alternative name: Thailand orthohantavirus, Thailand virus; abbreviation as used herein: "THAIV"), Tula hantavirus (alternative names: Tula orthohantavirus, Tula virus; abbreviation as used herein: "TULV"), New York hantavirus (alternative name: New York virus; abbreviation as used herein: "NYV").

The virus of the Nairoviridae family is suitably selected from any virus from the genus Orthonairovirus.

Accordingly, the at least one virus of the invention may be selected from any virus, virus member, virus strain, virus type, virus sub-type, virus isolate, virus variant, or virus serotype or genetic reassortant of a virus of the genus Orthonairovirus (Taxonomy ID: 1980517; according to NCBI taxonomy).

In preferred embodiments, the virus of the genus Orthonairovirus is selected from Burana orthonairovirus, Crimean-Congo hemorrhagic fever orthonairovirus, Dera Ghazi Khan orthonairovirus, Dugbe orthonairovirus, Hazara orthonairovirus, Hughes orthonairovirus, Kasokero orthonairovirus, Keterah orthonairovirus, Nairobi sheep disease orthonairovirus, Qalyub orthonairovirus, Sakhalin orthonairovirus, Thiafora orthonairovirus, Artashat virus, Bat nairovirus, Burana virus, Caspiy virus, Chim virus, Clo Mor virus, Geran virus, Gossas virus, Grotenhout virus, Issyk-Kul virus, Leopards Hill virus, Nayun tick nairovirus, Paramushir virus, Pustyn virus, Saphire II virus, South Bay virus, Tamdy virus, Tofla virus, Uzun Agach virus, Yogue virus, Nairovirus sp., Ganjam virus, or any virus member, virus strain, virus type, virus sub-type, virus isolate, virus variant, or virus serotype of any of these viruses.

In particularly preferred embodiments, the virus of the genus Orthonairovirus is selected from the list provided below. Therein, for each virus (e.g. "Crimean-Congo hemorrhagic fever orthonairovirus") the NCBI taxonomy ID is provided (e.g. "1980519") and respective virus members are indicated (e.g. "Crimean-Congo hemorrhagic fever virus") including their NCBI taxonomy IDs (e.g. "11594, 402052, 402369, 402370, 402371, 402372, 402373, 154120, 170517, 652961") and the abbreviation as used throughout the specification (e.g. CCHFV): Burana orthonairovirus (1980518): Tacheng Tick Virus 1 (1608083); Crimean-Congo hemorrhagic fever orthonairovirus (1980519): Crimean-Congo hemorrhagic fever virus (CCHFV) (11594, 402052, 402369, 402370, 402371, 402372, 402373, 154120, 170517, 652961); Dera Ghazi Khan orthonairovirus (1980520): Abu Hammad virus (AHV) (248058), Abu Mina virus (AMV) (248059), Dera Ghazi Khan orthonairovirus (DGKV) (1980520), Kao Shuan virus (KSV) Pathum Thani virus (PTHV) Pretoria virus (PREV); Dugbe orthonairovirus (1980521): Dugbe virus (DUGV) (766194); Hazara orthonairovirus (1980522): Hazara virus (HAZV) (11596, 11597); Hughes orthonairovirus (1980523): Caspiy virus (CASV) (1453405), Farallon virus (FARV) (248053), Fraser Point virus (FPV) Great Saltee virus (GRSV) Hughes orthonairovirus (HUGV) (1980523), Puffin Island virus (PIV) Punta Salinas virus (PSV) (248056). Raza virus (RAZAV) (248054), Saphire II virus (SAPV) (1815512), Sapphire II virus (1810945), Soldado virus (SOLV) (426791), Zirqa virus (ZIRV); Kasokero orthonairovirus (1980524): Kasokero virus (1712570); Keterah orthonairovirus (1980525): Keterrah virus (1712571); Nairobi sheep disease orthonairovirus (1980526): Kupe virus (KUPEV) (498356), Nairobi sheep disease virus (NSDV) (194540); Qalyub orthonairovirus (1980527): Bakel virus (BAKV) Bandia virus (BDAV) (248060). Chim virus (CHIMV) (1453406), Geran virus (GERV) (1453407), Omo virus (OMOV) Qalyub virus (QYBV) (1980527); Sakhalin orthonairovirus (1980528): Avalon virus (AVAV), Paramushir virus (PRMV) Clo Mor virus (CLMV) (1810952), Finch Creek virus (FINCV) Kachemak Bay virus (KBV) Sakhalin virus (SAKV) Taggert virus (TAGB) (487050), Tillamook virus (TILLV) (37297); Thiafora orthonairovirus (1980529): Erve virus (ERVEV) (248062), Thiafora orthonairovirus (TFAV) (1980529); Artashat virus: Artashat virus (1453403); Bat nairovirus: Bat nairovirus (1340803); Burana virus: Burana virus (1453404); Caspiy virus: Caspiy virus (1453405); Chim virus: Chim virus (1453406); Clo Mor virus: Clo Mor virus (1810952); Geran virus: Geran virus (1453407); Gossas virus: Gossas virus (1714376); Grotenhout virus: Grotenhout virus (1971396); Issyk-Kul virus: Issyk-Kul virus (1453408); Leopards Hill virus: Leopards Hill virus (1381104); Nayun tick nairovirus: Nayun tick nairovirus (1610817); Paramushir virus: Paramushir virus (1453409); Pustyn virus: Pustyn virus (1857750); Saphire II virus: Saphire I virus (1815512); South Bay virus: South Bay virus (1526514); Tamdy virus: Tamdy virus (1453410); Tofla virus: Tofla virus (1615758); Uzun Agach virus: Uzun Agach virus (1523052); Yogue virus: Yogue virus (1712572); Nairovirus sp.: Nairovirus sp. (1971604); Ganjam virus: Ganjam virus (GANV) (1810948).

In particularly preferred embodiments, the virus of the genus Orthonairovirus as defined above is suitably selected from Crimean-Congo hemorrhagic fever virus (alternative names: Crimean-Congo hemorrhagic fever orthonairovirus, Crimean-Congo hemorrhagic virus, Crimean-Congo hemorrhagic fever nairovirus, Crimean-Congo haemorrhagic fever virus; abbreviation as used herein: "CCHFV"), Dugbe virus (alternative name: Dugbe orthonairovirus, Dugbe nairovirus; abbreviation as used herein: "DUGV"), or Nairobi sheep disease virus (alternative name: Nairobi sheep disease orthonairovirus, Nairobi sheep disease nairovirus; abbreviation as used herein: "NSDV").

The virus of the Peribunyaviridae family is suitably selected from any virus from the genus Orthobunyavirus.

Accordingly, the at least one virus of the invention may be selected from any virus, virus member, virus strain, virus type, virus sub-type, virus isolate, virus variant, or virus serotype or genetic reassortant of a virus of the genus Orthobunyavirus (Taxonomy ID: 11572; according to NCBI taxonomy).

In preferred embodiments, the virus of the genus Orthobunyavirus is suitably selected from Acara orthobunyavirus, Akabane orthobunyavirus, Alajuela orthobunyavirus, Anopheles A orthobunyavirus, Anopheles B orthobunyavirus, Bakau orthobunyavirus, Batama orthobunyavirus, Benevides orthobunyavirus, Bertioga orthobunyavirus, Bimiti orthobunyavirus, Botambi orthobunyavirus, Bunyamwera orthobunyavirus, Bunyamwera virus, Ngari virus, Bushbush orthobunyavirus, Bwamba orthobunyavirus, California encephalitis orthobunyavirus, La Crosse virus. Keystone virus, California encephalitis virus, Jamestown Canyon virus, Capim orthobunyavirus, Caraparu orthobunyavirus, Catu orthobunyavirus, Estero Real orthobunyavirus, Gamboa orthobunyavirus, Guajara orthobunyavirus, Guama orthobunyavirus, Guaroa orthobunyavirus, Kaeng Khoi orthobunyavirus, Kairi orthobunyavirus, Koongol orthobunyavirus, Madrid orthobunyavirus, Main Drain orthobunyavirus, Manzanilla orthobunyavirus, Marituba orthobunyavirus, Minatitan orthobunyavirus, MPoko orthobunyavirus, Nyando orthobunyavirus, Olifantsvlei orthobunyavirus, Oriboca orthobunyavirus, Oropouche orthobunyavirus, Patois orthobunyavirus, Sathuperi orthobunyavirus, Shamonda orthobunyavirus, Shuni orthobunyavirus, Simbu orthobunyavirus, Tacaiuma orthobunyavirus, Tete orthobunyavirus, Thimiri orthobunyavirus, Timboteua orthobunyavirus, Turlock orthobunyavirus, Wyeomyia orthobunyavirus, Zegla orthobunyavirus, Bellavista virus, Brazoran virus, Calchaqui virus, Calovo virus, Diaphorina citri bunyavirus, El Huayo virus, Enseada virus, Gan Gan virus, 1612045 virus, Leanyer virus, Mojui dos Campos virus, Murrumbidgee virus, Orthobunyavirus, Oyo virus, Pacui virus, Rio Preto da Eva virus, Salt ash virus, Tapirape virus, Utive virus, Wuhan Louse Fly Virus 1, Zungarococha virus, or any virus member, virus strain, virus type, virus sub-type, virus isolate, virus variant, or virus serotype of any of these viruses.

In particularly preferred embodiments, the virus of the genus Orthobunyavirus is selected from the list provided below. Therein, for each virus (e.g. "Bwamba orthobunyavirus") the NCBI taxonomy ID is provided (e.g. "35310") and respective virus members are indicated (e.g. "Pongola virus") including the corresponding NCBI taxonomy IDs (e.g. "537994") and the abbreviation as used throughout the specification (e.g. "PGAV"): Acara orthobunyavirus: Acara virus (ACAV) Moriche virus (MORV); Akabane orthobunyavirus (1933178): Akabane virus (AKAV) (70566), Sabo virus (SABOV) (159138), Tinaroo virus (TINV) (66264), Yaba-7 virus (Y7V) (159137); Alajuela orthobunyavirus (1933181): Alajuela virus (ALV) (1552846), San Juan virus (SJV); Anopheles A orthobunyavirus (1933180): Anopheles A virus (ANAV) (35307), Arumateua virus (ARTV) Caraipe virus (CPEV) Las Maloyas virus (LMV) Lukuni virus (LUKV) (1678227), Trombetas virus (TRMV) Tucurui virus; Anopheles B orthobunyavirus (1933176): Anopheles B virus (ANBV) (35308), Boraceia virus (BORV) (611708); Bakau orthobunyavirus (1933175): Bakau virus (BAKV) (35309), Ketapang virus (KETV) Nola virus (NOLAV) (442713), Tanjong Rabok virus (TRV) Telok Forest virus (TFV); Batama orthobunyavirus (1933177): Batama virus (BMAV) (611709); Benevides orthobunyavirus: Benevides orthobunyavirus (BVSV); Bertioga orthobunyavirus (1933262): Bertioga orthobunyavirus (BERV) (1933262), Cananeia virus (CNAV) Guaratuba virus (GTBV) Itimirim virus (ITIV) Mirim virus (MIRV) (1927814); Bimiti orthobunyavirus (1933263): Bimiti virus (BIMV) (1678224); Botambi orthobunyavirus: Botambi orthobunyavirus (BOTV); Bunyamwera orthobunyavirus (1933179): Abbey lake orthobunyavirus (Ab-BUNV) (1501396), Anadyr virus (ANADV) (1642852), Batai virus (BATV) (80942). Birao virus (BIRV) (273358), Bozo virus (BOZOV) (273349), Bunyamwera virus (BUNV) (35304), Cache Valley virus (CVV) (80935), Cholul virus (CHLV) (1093160), Fort Sherman virus (FSV) (273345), Germiston virus (GERV) (11574), Iaco virus (IACOV) (273356), Ilesha virus (ILEV) (273341), Lokem virus (LOKV) (273346), Maguar virus (MAGV) (11575), Mboke virus (MBOV) (273342), Ngari virus (NRIV) (273357), Northway virus (NORV) (80937), Playas virus (PLAV) (273344), Potosi virus (POTV) (273360). Santa Rosa virus (SARV) Shokwe virus (SHOV) (273359), Stanfield virus Tensaw virus (TENV) (273347), Tlacotalpan virus (TLAV) (273343), Xingu virus (XINV) (273348); Bushbush orthobunyavirus: Benfica virus (BENV) Bushbush orthobunyavirus (BSBV) Juan Diaz virus (JDV); Bwamba orthobunyavirus (35310): Bwamba virus (BWAV) Pongola virus (PGAV) (537994); California encephalitis orthobunyavirus (1933264): California encephalitis virus (CEV) (35305, 685450), Chatanga virus (CHATV) or Khatanga virus (KHATV) (507486). Inkoo virus (INKV) (45269). Jamestown Canyon virus (JCV) (35511). Jerry Slough virus (JSV) (35513), Keystone virus (KEYV) (35514), La Crosse virus (LACV) (11577, 11578, 796210), Lumbo virus (LUMV) (80940), Melao virus (MELV) (35515), Morro Bay virus (MBV) (42159). San Angelo virus (SAV) (45767), Serra do Navio virus (SDNV) (45768), Snowshoe hare virus (SSHV) (11580). South River virus (SORV) (45769), Tahyna virus (TAHV) (45270), Trivittatus virus (TVTV) (35516); Capim orthobunyavirus (1933265): Capim virus (CAPV) (35312); Caraparu orthobunyavirus (1933290): Apeu virus (APEUV) (334520), Bruconha virus (BRUV) (348014), Caraparu virus (CARV) (192196), Itaya virus (1633620), Ossa virus (OSSAV) (348015), Vinces virus (VINV) (192197); Catu orthobunyavirus (1933269): Catu virus (CATUV) (1678225); Estero Real orthobunyavirus: Estero Real orthobunyavirus (ERV); Gamboa orthobunyavirus (1933270): Gamboa virus (GAMV) (35313), Pueblo Viejo virus (PVV); Guajar orthobunyavirus (1933272): Guajara virus (GJAV) (1678226); Guam orthobunyavirus (1933273): Ananindeua virus (ANUV) (1927813), Guama virus (GMAV) (1678234), Mahogany Hammock virus (MHV) (1763623), Moju virus (MOJUV) (1678228); Guaroa orthobunyavirus (1933274): Guaroa virus (GROV) (80941); Kaeng Khoi orthobunyavirus (1933275): Kaeng Khoi virus (KKV) (307164); Kairi orthobunyavirus (1933276): Kairi virus (KRIV) (80939); Koongol orthobunyavirus (1933288): Koongol virus (KOOV) (35314), Wongal virus (WONV); M'Poko orthobunyavirus (1933289): M'Poko virus (MPOV) (442712), Yaba-1 virus (Y1V); Madrid orthobunyavirus (1933291): Madrid virus (MADV) (348013); Main Drain orthobunyavirus (1933303): Main Drain virus (MDV) (80938); Manzanilla orthobunyavirus (1933304): Buttonwillow virus (BUTV) (159140), Cat Que virus (1495866), Ingwavuma virus (INGV) (159145), Inini virus (INIV) Manzanilla virus (MANV) (159139), Mermet virus (MERV) (159147); Marituba orthobunyavirus (1933307): Gumbo Limbo virus (GLV) (348010), Marituba virus (MTBV) (292278), Murutucu virus (MURV) (348008), Nepuyo virus (NEPV) (348009), Restan virus (RESV) (348011), Zungarococha virus (ZUNV) (1134389); Minatitlan orthobunyavirus: Minatitlan virus (MNTV) Palestina virus (PLSV); Nyando orthobunyavirus (1933306): Nyando virus (NDV) (35316), Eret(mapodites) virus (ERETV); Olifantsvlei orthobunyavirus: Bobia virus (BIAV) Dabakala virus (DABV) Olifantsvlei virus (OLIV) Oubi virus (OUBIV); Oriboca orthobunyavirus (1934100): Itaqui virus (ITQV) (348026), Oriboca virus (ORIV) (192199); Oropouche orthobunyavirus (1933309): Facey's Paddock virus (FPV) (159143), Iquitos virus (IQTV) (1387354), Madre de Dios virus (MDDV) (1494663), Oropouche virus (OROV) (118655), Perdoes virus (1628725), Utinga virus (UTIV) (159144); Pintupo virus: Utive virus (UW/UTVEV) (1494668); Patois orthobunyavirus: Abras virus (ABRV) Babahoya virus (BABV) Pahayokee virus (PAHV) Patois virus (PATV) Shark River virus (SRV); Sathuperi orthobunyavirus (159141): Douglas virus (DOUV) (159142), Sathuperi virus (SATV) (159141), Schmallenberg virus (SBV) (1133363); Shamonda orthobunyavirus (159150): Peaton virus (PEAV) (159151). Sango virus (SANV) (159152), Shamonda orthobunyavirus (SHAV) (159150); Shuni orthobunyavirus (159148): Aino virus (AINOV) (11582), Kaikalur virus (KAIV) (159149). Shuni orthobunyavirus (SHUV) (159148); Simbu orthobunyavirus (35306): Jatobal virus (150058), Oya virus (181003), Simbu orthobunyavirus (SIMV) (35306); Tacaiuma orthobunyavirus (611707): CoAr 1071 virus (CA1071V) CoAr 3627 virus (CA3627V) Tacaiuma orthobunyavirus (TCMV) (611707), Virgin River virus (VRV); Tete orthobunyavirus (35319): Bahig virus (BAHV) (1622279), Matruh virus (MTRV) (1678229), Tete orthobunyavirus (TETEV) (35319). Tsuruse virus (TSUV) Weldona virus (WELV) (500324); Thimiri orthobunyavirus: Thimiri virus (THIV) (1819305); Timboteua orthobunyavirus: Timboteua virus (TBTV); Turlock orthobunyavirus (35320): Lednice virus (LEDV) Turlock orthobunyavirus (TURV) (35320). Umbre virus (UMBV) (552554); Wyeomyia orthobunyavirus (273350): Anhembi virus (AMBV) (273355). BeAr 328208 virus (BAV) (273353), Cachoeira Porteira virus (CPOV) (1138490), Iaco virus (IACOV) (273356), Macaua virus (MCAV) (273352), Rio Pracupi virus Sororoca virus (SORV) (273354), Taiassui virus (TAIAV) (273351), Tucunduba virus (TUCV) (1138489), Wyeomyla virus (WYOV) (1138487, 1138488); Zegla orthobunyavirus: Zegla orthobunyavirus (ZEGV); Bellavista virus: Bellavista virus (1856565); Brazoran virus: Brazoran virus (1368616); Calchaqui virus: Calchaqui virus (1552845); Calovo virus: Calovo virus (365047); Diaphorina citri bunyavirus: Diaphorina citri bunyavirus (1776152); El Huayo virus: El Huayo virus (1769592); Enseada virus: Enseada virus (1821545); Gan Gan virus: Gan Gan virus (1764076); 1612045 virus: 1612045 virus (1027467); Leanyer virus: Leanyer virus (999729); Mojui dos Campos virus: Mojui dos Campos virus (1543245); Murrumbidgee virus: Murrumbidgee virus (1406134); Orthobunyavirus: Orthobunyavirus (11572, 930075, 1402035, 1488575); Oyo virus: Oyo virus (1027632); Pacui virus: Pacui virus (1538454); Rio Preto da Eva virus: Rio Preto da Eva virus (1538455); Salt ash virus: Salt ash virus (1406136); Tapirape virus: Tapirape virus (1538456); Utive virus: Utive virus (1494668); Wuhan Louse Fly Virus 1: Wuhan Louse Fly Virus 1 (1608113); Zungarococha virus: Zungarococha virus (1134389).

In particularly preferred embodiments, the virus of the genus Orthobunyavirus as defined above is suitably selected from Bunyamwera virus (alternative names: Bunyamwera orthobunyavirus, Bunyamwera virus group, Bunyamwera serogroup, Bunyamwera bunyavirus group; abbreviation as used herein: "BUNV"), Ngari virus (alternative name: Bunyamwera orthobunyavirus; abbreviation as used herein: "NRIV"), Bwamba bunyavirus (alternative names: Bwamba orthobunyavirus, Bwamba virus, Bwamba serogroup, Bwamba bunyavirus group, 5-Bwamba virus Group; abbreviation as used herein: "BWAV"), California encephalitis virus (alternative names: California encephalitis othobunyavirus. California serogroup virus, California virus, California serogroup, California encephalitis virus group, California bunyavirus group; abbreviation as used herein: "CEV"), Jamestown Canyon virus (alternative name: California encephalitis othobunyavirus; abbreviation as used herein: "JCV"), Keystone virus (alternative name: California encephalitis othobunyavirus; abbreviation as used herein: "KEYV"), La Crosse virus (alternative name: Bunyavirus Ia crosse, California encephalitis othobunyavirus; abbreviation as used herein: "LACV"), Oropouche virus (alternative name: Oropouche orthobunyavirus, Oropouche bunyavirus; abbreviation as used herein: "OROV").

The virus of the Phenuiviridae family is suitably selected from any virus from the genus Phlebovirus.

Accordingly, the at least one virus of the invention may be selected from any virus, virus member, virus strain, virus type, virus sub-type, virus isolate, virus variant, or virus serotype or genetic reassortant of a virus of the genus Phlebovirus (Taxonomy ID: 11584; according to NCBI taxonomy).

In preferred embodiments, the virus of the genus Phlebovirus is suitably selected from Bujaru phlebovirus, Candiru phlebovirus, Chilibre phlebovirus, Frijoles phlebovirus, Punta Toro phlebovirus, Punta Toro virus, Rift Valley fever phlebovirus, Rift Valley fever virus, Salehabad phlebovirus, Sandfly fever Naples phiebovirus, Sandfly fever Naples virus, Toscana virus, SFTS phlebovirus, Severe fever with thrombocytopenia virus, Uukuniemi phlebovirus, Sandfly fever Sicilian virus, Chagres virus, Heartland virus, Aguacate virus, Alcube virus, Ambe virus, American dog tick phlebovirus Anhanga virus, Arrabida virus, Arrabida-like virus, Arumowot virus, Bhanja serogroup, Blacklegged tick phlebovirus 1, Blacklegged tick phlebovirus 2, Blacklegged tick phlebovirus 3, Bole Tick Virus 1, Chagres virus, Changping Tick Virus 1, Corfou virus, Dabieshan Tick Virus, Fermo virus, Gabek Forest virus, Guertu virus, Heartland virus, Huangpi Tick Virus 2, Itaporanga virus, Kaisodi virus, Lanjan virus, Lesvos virus, Uhan Tick Virus, Malsoor virus, Manawa virus, Odaw virus, Odrenisrou virus, Phlebovirus, Provincia virus, Rio Grande virus, Saddaguia virus, Salanga virus, Salobo virus, Sandfly fever Sicilian virus, Sandfly phlebovirus, Scerotinia scerotiorum phlebo-like virus 1, Shibuyunji virus, Silverwater virus, Tacheng Tick Virus 2, Tapara virus, Toros virus, Uriurana virus, Urucuri virus, Yongjia Tick Virus 1, Zerdali virus, Phlebovirus sp., or any virus member, virus strain, virus type, virus sub-type, virus isolate, virus variant, or virus serotype of any of these viruses In particularly preferred embodiments, the virus of the genus Phlebovirus is selected from the list provided below. Therein, for each virus (e.g. "Rift Valley fever phlebovirus") the NCBI taxonomy ID is provided (e.g. "1933187") and respective virus members are indicated (e.g. "Rift Valley fever virus") including the corresponding NCBI taxonomy IDs (e.g. "11588, 11589") and the abbreviation as used throughout the specification (e.g. "RVFV"): Bujaru phlebovirus (1933183): Bujaru virus (BUJV) (904679), Munguba virus (MUNV) (1048854); Candiru phlebovirus (1933182): Alenquer virus (ALEV) (629726), Aiquemes virus (ARQV) (1000645), Chandiru virus (Candiru virus) (CDUV) (629725), Echarate virus (1000646), Iaituba virus (ITAV) (655689), Jacunda virus (JCNV) (1000411), Maldonado virus (MLOV) (1004889), Morumbi virus (MBV) (1000647), Mucura virus (MCRV/MRAV) (1000648), Nique virus (NIQV) (629739), Oriximine virus (ORXV) (655691), Serra Norte virus (SRNV) (1000649), Turuna virus (TUAV) (629737); Chilibre phlebovirus (1933184): Cacao virus (CACV) (629730), Chilibre virus (CHIV) (629728); Frijoles phlebovirus (1933185): Frioles virus (FRIV) (426786, 426788), Joa virus (JOAV) (426787); Punta Toro phlebovirus (1933186): Buenaventura virus (BUEV) (206377), Capira virus (CAPIV) (1649831), Code virus (CCLV) (1649829), Leticia virus (LTCV) Punta Toro virus (PTV) (11587); Rift Valley fever phlebovirus (1933187): Belterra virus (426789), Icoaraci virus (426790), Lunyo virus (75186), Rift Valley fever virus (RVFV) (11588, 11589); Salehabad phlebovirus (1933188): Adana virus (1611877), Adria virus (ADRV) Arumowot virus (AMTV) (904698), Medjerda Valley virus (1775957), Odrenisrou virus (ODRV) (1048855), Olbia virus (OLBV) Salehabad virus (SALV) (904699); Sandfly fever Naples phlebovirus (1933189): Arbia virus (ARBV) (398316), Fermo virus (1350214), Gordil virus (GORV) (1460451), Granada virus (GR(A)V) (904668), Karimabad virus (415382), Massil(i)a virus (MASLV) (391640), Punique virus (PUNV) (693015), Saddaguia virus (SADV) (1847896), Saint-Floris virus (SAFV) Sandfly fever Naples virus (SFNV) (206160), Sand fever Naples-like virus (1048856), Tehran virus (TEHV) (206161), Toscana virus (TOSV) (11590), Zerdali virus (1764086); SFTS phlebovirus (1933190): FTLS virus (1437064), Huaiyangshan virus (1001303), Orthobunyavirus (11572, 930075, 1402035, 1488575), Phlebovirus (11584, 242523, 327975, 904716, 904717, 904718, 904719, 904720, 904721, 914119, 914120, 914121, 914122, 914123, 914124, 914125, 931250, 931251, 981770, 1010663, 1010664, 1010665, 1017370, 1032690, 1032691, 1048849, 1048850, 1048857, 1072505, 1123947, 1205899, 1205900, 1205901, 1205902, 1642042, 1848960, 984974, 1173018, 999535, 1148317), Severe fever with thrombocytopenia virus (SFTSV) (1003835), SFTS virus (992210, 992211, 992212, 992213, 992214, 992215, 992216, 992217, 992218, 992219, 992220, 1115693, 1316165, 1316166, 1316167, 1316168, 1316169, 1316170, 1316171, 1316172, 1316173, 1316174, 1316175, 1316176, 1316177, 1316178, 1316179, 1316180, 1316181, 1316182, 1316183, 1316184, 1316185, 1316186, 1316187, 1316188, 1316189, 1316190, 1316191); Uukuniemi phlebovirus (1933191): Catch-me-cave virus (487102), Chize virus (CHZV) (1010666), EgAN 1825-61 virus (EGAV) (1010667), Fin V 707 virus (FINV) (1204159), Gissar virus (1489102), Grand Arbaud virus (487098), Murre virus (1010668). Oceanside virus (OCV) Ponteves virus (PTVV) Precarious point virus (487097), RML-105355 virus (1010669), Rukutama virus (RUKV) (1531287), Soybean cyst nematode associated Uukuniemi virus (1034379), St. Abbs Head virus (SAHV) Tunis virus (TUNV) (1810944), Uukuniemi virus (UUKV) (11591, 487099), Zaliv Terpenia virus (Zaliv Terpenyia virus) (ZTV) (1010670); Aguacate virus: Armero virus (1006584), Durania virus (1006585), Ixcanal virus (1006586); Alcube virus: Alcube virus (1725367); Ambe virus: Ambe virus (1926500); American dog tick phlebovirus: American dog tick phlebovirus (1517960); Anhanga virus: Anhanga virus (904722); Arrabida virus: Arrabida virus (1457322); Arrabida-like virus: Arrabida-like virus (1652026); Arumowot virus: Arumowot virus (904698); Bhanja serogroup: Bhanja virus (1213620), Forecariah virus (1282797), Kismayo virus (1564097). Palma virus (1213621), Razdan virus (1405807); Blacklegged tick phlebovirus 1: Blacklegged tick phlebovirus 1 (1526521); Blacklegged tick phlebovirus 2: Blacklegged tick phlebovirus 2 (1526522); Blacklegged tick phlebovirus 3: Blacklegged tick phlebovirus 3 (1844920); Bole Tick Virus 1: Bole Tick Virus 1 (1608040); Chagres virus: Chagres virus (629727); Changping Tick Virus 1: Changping Tick Virus 1 (1608043); Corfou virus: Corfou virus (206376); Dabieshan Tick Virus: Dabieshan Tick Virus (1608046); Fermo virus: Fermo virus (1350214); Gabek Forest virus: Gabek Forest virus (629736); Guertu virus: Guertu virus (1763596); Heartland virus: Heartland virus (1216928); Huangpi Tick Virus 2: Huangpi Tick Virus 2 (1608048); Itaporanga virus: Itaporanga virus (629735); Kaisodi virus: Kaisodi virus (1564120); Lanjan virus: Lanjan virus (1564119); Lesvos virus: Lesvos virus (1917976); Lihan Tick Virus: Lihan Tick Virus (1608056); Malsoor virus: Malsoor virus (1445418); Manawa virus: Manawa virus (1204160); Odaw virus: Odaw virus (1913640); Odrenisrou virus: Odrenisrou virus (1048855); Phlebovirus: Phlebovirus (11584, 242523, 327975, 904716, 904717, 904718, 904719, 904720, 904721, 914119, 914120, 914121, 914122, 914123, 914124, 914125, 931250, 931251, 981770, 1010663, 1010664, 1010665, 1017370, 1032690, 1032691, 1048849, 1048850, 1048857, 1072505, 1123947, 1205899, 1205900, 1205901, 1205902, 1642042, 1848960, 984974, 1173018, 999535, 1148317); Provincia virus: Provincia virus (945965); Rio Grande virus: Rio Grande virus (629740); Saddaguia virus: Saddaguia virus (1847896); Salanga virus: Salanga virus (U.S. Pat. Nos. 1,416,745, 1,394,870); Salobo virus: Salobo virus (427316); Sandfly fever Sicilian virus (28292): Sandfly fever Turkey virus (688699), Utique virus (743961); Sandfy phlebovirus: Sandfly phlebovirus (1608279); Sclerotinia scerotiorum phlebo-like virus 1: Sclerotinia scerotiorum phlebo-like virus 1 (1435451); Shibuyunji virus: Shibuyunji virus (1564122); Silverwater virus: Silverwater virus (1564099); Tacheng Tick Virus 2: Tacheng Tick Virus 2 (1608084); Tapara virus: Tapara virus (1926501); Toros virus: Toros virus (1764085); Uriurana virus: Uriurana virus (1055750); Urucuri virus: Urucuri virus (1926502); Yongjia Tick Virus 1: Yongjia Tick Virus 1 (1608145); Zerdali virus: Zerdali virus (1764086); Phlebovirus sp.: Phlebovirus sp. (206378, 439613, 439614, 439615, 439616, 439617, 439618, 439619, 439620, 439621, 439622, 439623, 439624, 439625, 439626, 1833897, 1833898, 1833899, 1833900, 1833901, 1833902, 1833903, 1833904, 1833905, 1833906, 1833907, 1833908, 1833909, 1833910, 1833911, 1833912, 1833913, 1833914, 1833915, 1833916, 1833917, 1833918, 1833919, 1833920, 1833921, 1833922, 1833923, 1833924, 1833925, 1833926, 1833927, 1833928, 1833929, 1833930, 1833931, 1833932, 1833933, 1833934, 2015054, 2015055, 2015056, 2015057, 2015058, 2015059, 2015060, 2015061, 2015062, 2015063, 2015064).

In particularly preferred embodiments, the virus of the genus Phlebovirus as defined above is suitably selected from Heartland virus (abbreviation as used herein: "HRTV"). Punta Toro virus (abbreviation as used herein: "PTV"), Rift Valley fever virus (abbreviation as used herein: "RVFV"), Sandfy fever Naples virus (abbreviation as used herein: "SFNV"). Toscana virus (alternative names: Toscana virus TOS; abbreviation as used herein: "TOSV"), Severe fever with thrombocytopenia syndrome virus (alternative names: Severe fever with thrombocytopenia virus, Severe fever with thrombocytopenia syndrome bunyavirus, SFTS virus, SFTS bunyavirus; abbreviation as used herein: "SFTSV").

Accordingly, in a particularly preferred embodiment the at least one virus of the order Bunyavirales is selected from the genus Orthohantavirus as defined herein, Orthonairovirus as defined herein, Orthobunyavirus as defined herein, or Phlebovirus as defined herein.

In a preferred embodiment, the at least one virus of the order Bunyavirales, particularly the virus of the genus Orthohantavirus, Orthonairovirus, Orthobunyavirus, or Phlebovirus is a pathogen, preferably a human pathogen.

The terms "pathogenic virus" or "pathogen" as used herein will be recognized and understood by the person of ordinary skill in the art, and is for example referring to a virus that in the broadest sense has the capability to infect a subject (e.g. human subject, animal), and thereby typically causing an infection or disease typically associated with medical symptoms or physical alterations (e.g. fever, headache, inflammation, vomiting etc.). Accordingly, the term human pathogen refers to a virus that is able to infect a human subject, and thereby typically causing a disease, or medical symptoms or physical alterations (e.g. fever, headache, inflammation, vomiting etc.) in a human subject.

Suitably, in the context of the invention, the pathogen, preferably a human pathogen is selected from any virus, virus strain, virus variant, virus isolate, virus type, virus sub-type, virus serotype, or genetic reassortant of a virus of the genus Orthobunyavirus, Orthohantavirus, Phlebovirus, or Orthonairovirus that has the capability to infect a subject, and thereby typically causing an infection or disease typically associated with medical symptoms or physical alterations.

The pathogenic virus of the order Bunyavirales as defined herein may be selected from Andes hantavirus (ANDV), Black Creek Canal hantavirus (BCCV), Dobrava-Belgrade hantavirus (DOBV), Haantan virus (HTNV), Laguna Negra hantavirus (LANV), Longquan hantavirus (LQUV), Puumala hantavirus (PUUV), Sangassou hantavirus (SANGV), Seoul hantavirus (SEOV), Sin Nombre hantavirus (SNV), Thailand hantavirus (THAIV), Tula hantavirus (TULV), New York hantavirus (NYV), Crimean-Congo hemorrhagic fever virus (CCHFV), Dugbe virus (DUGV), Nairobi sheep disease virus (NSDV), Bunyamwera virus (BUNV), Ngari virus (NRIV), Bwamba bunyavirus (BWAV), California encephalitis virus (CEV), Jamestown Canyon virus (JCV), Keystone virus (KEYV), La Crosse virus (LACV), Oropouche virus (OROV), Heartland virus (HRTV), Punta Toro virus (PTV), Rift Valley fever virus (RVFV), Sandfly fever Naples virus (SFNV), Toscana virus (TOSV), Severe fever with thrombocytopenia syndrome virus (SFTSV), or any strain, isolate, or serotype of any of these viruses.

In preferred embodiments, the pathogenic virus as defined herein may be selected from Crimean-Congo hemorrhagic fever virus (CCHFV), Rift Valley fever virus (RVFV), or Severe fever with thrombocytopenia virus (SFTSV), or any strain, isolate, or serotype of any of these viruses.

In further preferred embodiments, the at least one virus as defined herein, preferably the pathogen as defined herein is preferably selected from ANDV, DOBV, PUUV, or HTNV or any strain, isolate, or serotype of any of these viruses.

In further preferred embodiments, the at least one virus as defined herein, preferably the pathogen as defined herein is preferably selected from LACV or any strain, isolate, or serotype.

Suitable Bunyavirales Peptides or Proteins:

Viruses of the order Bunyavirales are enveloped viruses which harbor a tripartite, single stranded RNA genome with negative polarity. The L segment of the genome encodes for the viral polymerase (L), the M segment for the viral Glycoproteins, Glycoprotein precursor (GP), Glycoprotein N (Gn) and Glycoprotein C (Gc), and the S segment for the nucleocapsid (N) protein. In addition, non-structural proteins can be encoded by the S and M segment, employing either an ambisense coding strategy, overlapping open reading frames or an open reading frame (ORF) encoding a polyprotein. The Glycoproteins mediate the first step in the bunyavirus replication cycle—viral entry into host cells— and are the only targets for neutralizing antibodies. Glycoprotein N (Gn) and Glycoprotein C (Gc) are synthesized as a precursor protein (GP), (Gn)/(Gc), in the secretory pathway of infected cells. Glycoprotein N (Gn) and Glycoprotein C (Gc) are separated by proteoytic cleavage but may remain non-covalently associated. The cleavage step is executed by a cellular enzyme, signal peptidase during import of the (Gn)/(Gc) precursor into the endoplasmic reticulum (ER). In the ER, Glycoprotein N (Gn) and Glycoprotein C (Gc) are decorated with N-linked glycans of the high-mannose type, which can be processed into hybrid and complex forms upon import of Glycoprotein N (Gn) and Glycoprotein C (Gc) into the Golgi apparatus. The Golgi apparatus is the site of bunyavirus budding and this process is facilitated by Glycoprotein N (Gn) and Glycoprotein C (Gc), which play a key role in particle morphogenesis and genome incorporation. Finally, infectious particles decorated with Glycoprotein N (Gn) and Glycoprotein C (Gc) are released from the infected cell by exocytosis.

According to preferred embodiments, the artificial nucleic acid comprises at least one coding sequence encoding at least one antigenic peptide or protein derived from at least one virus of the order Bunyavirales as defined herein, wherein the at least one antigenic peptide or protein may be derived from any Bunyavirales protein or peptide or fragment or variant thereof.

The at least one antigenic peptide or protein may be derived from a genomic segment of a virus of the order Bunyavirales as defined herein, wherein the genomic segment of which the peptide or protein is derived from is selected from L segment. S segment. or M segment.

The term "genomic segment" as used throughout the present invention relates to a segment of the RNA genome of Bunyavirales. Viruses of the order Bunyavirales are enveloped, single-stranded, negative-sense RNA viruses, with the genome typically divided into 3 segments: The large (L) segment (also referred to as "L segment") encodes the RNA-dependent RNA polymerase needed for RNA replication and viral RNA synthesis, the medium (M) segment (also referred to as "M segment") encodes the viral Glycoproteins involved in virus/cell attachment, and the small (S) segment (also referred to as "S segment") encodes the nucleoprotein (N). Accordingly, any protein, peptide or variant derived from the genomic segment L segment. S segment, or M segment of a virus of the order Bunyavirales may serve as antigenic protein or peptide of the invention.

In preferred embodiments the at least one antigenic peptide or protein comprises or consists of Bunyavirales Glycoprotein, non-structural protein M (NSm), RNA-dependent RNA polymerase (L), Nucleoprotein (N), non-structural protein S (NSs), or a fragment or variant of any of these.

The term "Glycoprotein" as used throughout the present invention relates to any Glycoprotein derived from the Glycoprotein precursor (GP) (e.g. Glycoprotein N (Gn), Glycoprotein C (Gc) and any other protein derived from the Glycoprotein precursor (GP) including GP38, GP85, GP160 or non-structural protein (NSm).

The term "Glycoprotein precursor (GP)" or the corresponding abbreviation "GP" as used throughout the present invention relates to any GP protein, peptide or variant thereof derived from a virus of the order Bunyavirales as defined herein. GP is a polyprotein precursor encoded by the genomic M segment that is processed in the host to gives rise to Glycoprotein N (Gn) and Gycoprotein C (Gc). Typically, Glycoprotein precursor (GP) is co-translationally processed by signalase into Gn precursor (pre-Gn), non-structural protein M (NSm), and Gc precursor (pre-Gc). During processing, further proteins may be generated in some Bunyavirales, including non-structural GP38, non-structural GP85 and non-structural GP60. Accordingly, any protein, peptide or variant of derived from a GP of a virus of the order Bunyavirales may serve as antigenic protein or peptide of the invention. Alternative terminologies exist in the art. Accordingly, GP, GPC, M polyprotein, glycoprotein, glycoprotein GP and glycoprotein precursor has to be understood as "Gycoprotein precursor (GP)".

The terms "Glycoprotein N (Gn)", "Glycoprotein (Gn)" or the corresponding abbreviation "Gn" as used throughout the present invention relates to a Glycoprotein derived from the Glycoprotein precursor (GP) as defined above. Glycoprotein N (Gn) is typically generated by co-translational processing from Glycoprotein precursor (GP). The mature Glycoprotein N (Gn) is part of the virus envelop of Bunyavirales. Accordingly, any protein, peptide or variant derived from Glycoprotein N (Gn) of a virus of the order Bunyavirales may serve as antigenic protein or peptide of the invention. Alternative terminologies exist in the art. Accordingly, Gn, glycoprotein N, aminoterminal glycoprotein, amino-terminus glycoprotein, glycoprotein G2 and glycoprotein Gn has to be understood as "Glycoprotein N (Gn)".

The terms "Glycoprotein C (Gc)", "Glycoprotein (Gc)" or the corresponding abbreviation "Gc" as used throughout the present invention relates to a Glycoprotein derived from the Glycoprotein precursor (GP) as defined above. Gc is typically generated by co-translational processing from Glycoprotein precursor (GP). The mature Gc is part of the virus-envelop of viruses of the order Bunyavirales. Accordingly, any protein, peptide or variant derived from Gc of a virus of the order Bunyavirales may serve as antigenic protein or peptide of the invention. Alternative terminologies exist in the art. Accordingly, Gc, glycoprotein C, carboxyterminal glycoprotein, carboxy-terminus glycoprotein, glycoprotein G1 and glycoprotein Gc has to be understood as "Glycoprotein C (Gc)".

The terms "GP38", "GP85", "GP160" as used throughout the present invention relates to non-structural proteins derived from the Glycoprotein precursor (GP) as defined above. These soluble proteins may have a role in virus replication. Accordingly, any protein, peptide or variant derived from "GP38", "GP85", "GP160" of a virus of the order Bunyavirales may serve as antigenic protein or peptide of the invention.

The terms "non-structural protein M (NSm)" or the corresponding abbreviation "NSm" as used throughout the present invention relates to a non-structural protein derived from the Glycoprotein precursor (GP) as defined above. Accordingly, any protein, peptide or variant derived from "NSm" of a virus of the order Bunyavirales may serve as antigenic protein or peptide of the invention. Alternative terminologies exist in the art. Accordingly, NSm, non-structural protein M and non-structural protein NSm has to be understood as "non-structural protein M (NSm)".

The term "RNA-dependent RNA polymerase (L)" as used throughout the present invention relates to the RNA-dependent RNA polymerase needed for RNA replication and viral RNA synthesis that is encoded by the genomic L segment of Bunyavirales. Accordingly, any protein, peptide or variant derived from "RNA-dependent RNA polymerase (L)" of a virus of the order Bunyavirales may serve as antigenic protein or peptide of the invention. Alternative terminologies exist in the art. Accordingly, L, protein L. Large structural protein, Replicase, Transciptase and RNA-directed RNA polymerase L has to be understood as "RNA-dependent RNA polymerase (L)".

The term "Nucleoprotein (N)" also referred to as "Nucleocapsid (N)" as used throughout the present invention relates to a protein encoded by the genomic S segment of Bunyavirales. Said Nucleoprotein (N) coats the RNA genome of the Bunyavirales virus. Accordingly, any protein, peptide or variant derived from "Nucleoprotein (N)" of a virus of the order Bunyavirales may serve as antigenic protein or peptide of the invention. Alternative terminologies exist in the art. Accordingly, N, nucleocapsid protein, protein N and nucleoprotein N has to be understood as "Nucleoprotein (N)".

The term "non-structural protein S (NSs)" or the corresponding abbreviation "NSs" as used throughout the present invention relates to a protein encoded by the genomic S segment of Bunyavirales. Accordingly, any protein, peptide or variant derived from "non-structural protein S (NSs)" of a virus of the order Bunyavirales may serve as antigenic protein or peptide of the invention.

Accordingly, the at least one antigenic peptide or protein comprises or consists of Bunyavirales Glycoprotein (Bunyavirales Glycoprotein precursor (GP), and/or Bunyavirales Glycoprotein N (Gn), and/or Bunyavirales Glycoprotein C (Gc), and/or Bunyavirales GP38, and/or Bunyavirales GP85, and/or Bunyavirales GP160 and/or Bunyavirales non-structural protein M (NSm), Bunyavirales RNA-dependent RNA polymerase (L), Bunyavirales Nucleoprotein (N), Bunyavirales non-structural protein S (NSs), or a fragment or variant of any of these.

In preferred embodiments, the at least one antigenic peptide or protein is derived from Bunyavirales Glycoprotein and/or Bunyavirales Nucleoprotein, or a fragment or variant of any of these.

Accordingly, as defined above, the Glycoprotein may comprise or consists of GP, Gn, Gc, GP38, GP85, GP160 and/or NSm or a fragment or variant of any of these.

Any Bunyavirales peptide or protein provided herein, or any a fragment or variant thereof, can cause an immune response when administered to a subject. Therefore, all Bunyavirales proteins or peptides provided herein can be considered as antigens in the context of the present invention.

In preferred embodiments, the at least one antigenic peptide or protein as defined herein is selected from of a virus, preferably a pathogen of the genus Orthobunyavirus, the genus Orthohantavirus, the genus Phlebovirus, or the genus Orthonairovirus as defined herein.

In some embodiments described herein, the at least one antigenic peptide or protein encoded by the at least one coding sequence of the artificial nucleic acid may consist of an individual Bunyavirales protein stretch (e.g. derived from a Glycoprotein precursor), the amino acid sequence of which does typically not comprise an N-terminal Methionine residue. It is thus understood that the phrase "artificial nucleic acid comprising at least one coding sequence encoding at least one antigenic peptide or protein derived from . . . " relates to a protein or peptide comprising the amino acid sequence of said respective Bunyavirales peptide or protein and—if the amino acid sequence of the respective peptide or protein does not comprise such an N-terminal Methionine residue—an introduced N-terminal Methionine residue.

Notably, suitable amino acid sequences and their corresponding nucleic acid coding sequences encoding the respective suitable amino acid sequences are provided throughout the specification of the present invention (see Tables 1-4). Accordingly, Table 1 provides suitable amino acid sequences and their corresponding nucleic acid coding sequences of genus Orthobunyavirus antigenic peptides or proteins according to the invention. Table 2 provides suitable amino acid sequences and their corresponding nucleic acid coding sequences of genus Orthohantavirus antigenic peptides or proteins according to the invention. Table 3 provides suitable amino acid sequences and their corresponding nucleic acid coding sequences of genus Phebovirus antigenic peptides or proteins according to the invention. Table 4 provides suitable amino acid sequences and their corresponding nucleic acid coding sequences of genus Orhtonairovirus antigenic peptides or proteins according to the invention.

In each of the Tables 1-4, each row corresponds to a suitable antigenic peptide or protein in the context of the invention, wherein the virus (Column A, "Virus") and the respective peptide or protein (Column B, "Protein") are indicated. The corresponding amino acid sequences for each antigenic peptide or protein are provided in Column C (Column C, "SEQ ID NOs of Protein"). Columns D provides SEQ ID NOs corresponding to non-modified, wild type nucleic acid coding sequences (Column D. "SEQ ID NOs of wild type cds") that encode the respective amino acid sequences as defined in Column C of the respective row. Column E provides SEQ ID NOs corresponding to CAI maximized nucleic acid coding sequences (Column E. "SEQ ID NOs of CAI maximized cds") that encode the respective amino acid sequences as defined in Column C of the respective row. Column F provides SEQ ID NOs corresponding to human codon usage adapted nucleic acid coding sequences (Column F, "SEQ ID NOs of human codon usage adapted cds") that encode the respective amino acid sequences as defined in Column C of the respective row. Column G provides SEQ ID NOs corresponding to G/C optimized nucleic acid coding sequences (Column G, "SEQ ID NOs of G/C optimized cds") that encode the respective amino acid sequences as defined in Column C of the respective row. Column H provides SEQ ID NOs corresponding to G/C content modified nucleic acid coding sequences (Column H, "SEQ ID NOs of G/C content modified cds") that encode the respective amino acid sequences as defined in Column C of the respective row. Notably, any descriptive feature or other information provided in the corresponding sequence listing relating to amino acid sequences or nucleic acid sequences provided in Table 1 to Table 4 is explicitly included herein and has to be understood as part of the disclosure of the present invention. For Example in the standard ST.25 sequence listing the numeric identifier "<223>" provides information regarding the antigen, the virus, and the respective NCBI accession number in the following format: "virus_accession number_antigen". For example for SEQ ID NO: 1172 the numeric identifier <223> provides the following information: "derived and/or modified protein sequence (wt) from CCHFV(IbAr10200)_AF467768.2_GP". Accordingly. SEQ ID NO: 1172 relates to a "GP" antigen derived from "CCHFV(IbAr10200)" wherein the sequence is derived from the NCBI accession number AF467768.2.

In embodiments, the at least one antigenic peptide or protein derived from Bunyavirales may suitably comprise at least one of the amino acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs: 234-2568, 16579-16581, 16645-16647, 16711-16713, 16777-16779, 16840-16849, 17090-17094, 17200-17208, 17425-17427 and as defined in Column C of Tables 1-4 derived from a Bunyavirales protein or a fragment or variant of any of these sequences. Accordingly, the artificial nucleic acid of the invention may comprise at least one coding sequence encoding at least one antigenic peptide or protein from Bunyavirales as specified above.

In embodiments, the at least one antigenic peptide or protein derived from a virus of the order Bunyavirales may be suitably selected from any Bunyavirales Glycoprotein, or fragments or variants thereof. Preferably, the at least one antigenic peptide or protein derived from Bunyavirales Glycoprotein may comprise at least one of the amino acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs: 926-2568, 16580, 16581, 16646, 16647, 16712, 16713, 16778, 16779, 16842, 16843, 16844, 16845, 16846, 16847, 16848, 16849, 17091, 17092, 17093, 17094, 17201, 17202, 17203, 17204, 17205, 17206, 17207, 17208, 17426, 17427 and as defined in Column C of Tables 1-4 derived from a Bunyavirales Glycoprotein or a fragment or variant of any of these sequences. Accordingly, the artificial nucleic acid of the invention may comprise at least one coding sequence encoding at least one antigenic peptide or protein derived from Bunyavirales Glycoprotein as specified above.

In embodiments, the at least one antigenic peptide or protein derived from a virus of the order Bunyavirales may be suitably selected from any Nucleoprotein or fragments or variants thereof. Preferably, the at least one antigenic peptide or protein derived from Bunyavirales Nucleoprotein may comprise at least one of the amino acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs: 234-925, 16579, 16645, 16711, 16777, 16840, 16841, 17090, 17200, 17425 and as defined in Column C of Tables 1-4 derived from a Bunyavirales Nucleoprotein or a fragment or variant of any of these sequences. Accordingly, the artificial nucleic acid of the invention may comprise at least one coding sequence encoding at least one antigenic peptide or protein derived from Bunyavirales Nucleoprotein as specified above.

Suitable Orthobunvavirus Peptides or Proteins

According to the invention, the artificial nucleic acid comprises at least one coding sequence encoding at least one antigenic peptide or protein derived from at least one virus of the order Bunyavirales as defined herein, wherein the virus of the order Bunyavirales may be a virus of the genus Orthobunyavirus, preferably a pathogenic virus of the genus Orthobunyavirus, more preferably a virus selected from BUNV, NRIV, BWAV, CEV, JCV, KEYV, LACV, or OROV.

In embodiments the at least one antigenic peptide or protein derived from a virus of the genus Orthobunyavirus comprises or consists of Glycoprotein (e.g. Glycoprotein precursor (GP), Glycoprotein N (Gn), Glycoprotein C (Gc), GP38, GP85, GP160, non-structural protein M (NSm)), RNA-dependent RNA polymerase (L), Nucleoprotein (N), non-structural protein S (NSs), or a fragment or variant of any of these.

In embodiments, the at least one antigenic peptide or protein is derived from Orthobunyavirus Nucleoprotein or Orthobunyavirus Glycoprotein or a fragment or variant of any of these. Accordingly, the at least one antigenic peptide or protein derived from Orthobunyavirus may suitably comprise at least one of the amino acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs: 693-836.1775-1986, 17090-17094 and as defined in Column C of Table 1 derived from an Orthobunyavirus protein or a fragment or variant of any of these sequences. Accordingly, the artificial nucleic acid of the invention may comprise at least one coding sequence encoding at least one antigenic peptide or protein from Orthobunyavirus as specified above.

In embodiments, the at least one antigenic peptide or protein is derived from Orthobunyavirus Glycoprotein, or a fragment or variant of any of these. Accordingly, the at least one antigenic peptide or protein derived from Orthobunyavirus Glycoprotein may suitably comprise at least one of the amino acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs: 1775-1986, 17092-17094 and as defined in Column C of Table 1 derived from an Orthobunyavirus Glycoprotein or a fragment or variant of any of these sequences. Accordingly, the artificial nucleic acid of the invention may comprise at least one coding sequence encoding at least one antigenic peptide or protein derived from Orthobunyavirus Glycoprotein as specified above.

In embodiments, the at least one antigenic peptide or protein is derived from Orthobunyavirus Nucleoprotein, or a fragment or variant of any of these. Accordingly, the at least one antigenic peptide or protein derived from Orthobunyavirus Nucleoprotein may suitably comprise at least one of the amino acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs: 693-836.17090, 17091 and as defined in Column C of Table 1 derived from an Orthobunyavirus Nucleoprotein or a fragment or variant of any of these sequences. Accordingly, the artificial nucleic acid of the invention may comprise at least one coding sequence encoding at least one antigenic peptide or protein derived from Orthobunyavirus Nucleoprotein as specified above.

In specific embodiments, the at least one antigenic peptide or protein is derived from Orthobunyavirus, wherein the Orthobunyavirus is selected from BUNV, NRIV, BWAV, CEV, JCV, KEYV, LACV, or OROV.

According to the invention, the at least one antigenic peptide or protein derived from BUNV, NRIV, BWAV, CEV, JCV, KEYV, LAC, or OROV of the genus Orthobunyavirus comprises or consists of Glycoprotein (e.g. Glycoprotein precursor (GP), Glycoprotein N (Gn), Glycoprotein C (Gc), GP38, GP85, GP160, non-structural protein M (NSm)), RNA-dependent RNA polymerase (L), Nucleoprotein (N), non-structural protein S (NSs), or a fragment or variant of any of these.

In embodiments, the at least one antigenic peptide or protein derived from BUNV, NRIV, BWAV, CEV, JCV, KEYV, LACV, or OROV or a fragment or variant thereof encoded by the at least one coding sequence of the artificial nucleic acid according to the invention may typically comprise an amino acid sequence being identical, or at least 50%, 60%, 70%, 80%, 85%, 86%, 87%, 88%, 89%, 90%, 91%, 92%, 93%, 94%, 95%, 96%, 97%, 98%, or 99% identical to any one of the amino acid sequences according to SEQ ID NOs as provided in Table 1, Column C. or a fragment or variant of any of these sequences.

In Table 1, amino acid sequences derived from BUNV (Table 1, Row 1 and 2), NRIV (Table 1, row 3 and 4), BWAV (Table 1, row 5 and 6). CEV (Table 1, row 7 and 8), JCV (Table 1, row 9 and 10), KEYV (Table 1, row 11 and 12), LACV (Table 1, row 13 and 14), or OROV (Table 1, row 15 and 16) are disclosed that are particularly suitable in the context of the invention. Each row of Table 1 corresponds to a suitable antigen in the context of the invention, wherein the virus (Column A, "Virus") and the respective peptide or protein (Column B. "Protein") are indicated. The corresponding amino acid sequences for each antigenic peptide or protein are provided in "Column C" (Column C, "SEQ ID NOs of Protein"). The respective SEQ ID NOs are provided in the corresponding sequence listing of that application. Notably, any feature or additional information of the ST.25 sequence listing, particularly information under numeric identifier <223> relating to sequences provided in Table 1 is explicitly included herein and has to be understood as part of the disclosure of the present invention. The following columns ("Column D" to "Column H") provide the SEQ ID NOs corresponding to nucleic acid sequences that encode the respective BUNV, NRIV, BWAV, CEV, JCV, KEYV, LACV, or OROV peptides or proteins as defined by the SEQ ID NOs indicated in Column C.

In embodiments, the at least one antigenic peptide or protein is derived from BUNV, NRIV, BWAV, CEV, JCV, KEYV, LACV, or OROV Glycoprotein or a fragment or variant of any of these. Accordingly, the at least one antigenic peptide or protein derived from BUNV, NRIV, BWAV, CEV, JCV, KEYV, LACV, or OROV or a fragment or variant thereof may typically comprise an amino acid sequence being identical, or at least 50%, 60%, 70%, 80%, 85%, 86%, 87%, 88%, 89%, 90%, 91%, 92%, 93%, 94%, 95%, 96%, 97%, 98%, or 99% identical to any one of the amino acid sequence corresponding to Glycoproteins GP (as indicated in Column B, "Protein") according to the respective SEQ ID NOs as provided in Table 1, Column C, row 2 (BUNV), row 4 (NRIV), row 6 (BWAV), row 8 (CEV), row 10 (JCV), row 12 (KEYV), row 14 (LACV), or row 16 (OROV), or a fragment or variant of any of these sequences.

In embodiments, the at least one antigenic peptide or protein is derived from BUNV, NRIV, BWAV, CEV, JCV, KEYV, LACV, or OROV Nucleoprotein, or a fragment or variant of any of these. Accordingly, the at least one antigenic peptide or protein derived from BUNV, NRIV, BWAV, CEV, JCV, KEYV, LACV, or OROV or a fragment or variant thereof may typically comprise an amino acid sequence being identical, or at least 50%, 60%, 70%, 80%, 85%, 86%, 87%, 88%, 89%, 90%, 91%, 92%, 93%, 94%, 95%, 96%, 97%, 98%, or 99% identical to any one of the amino acid sequence corresponding to Nucleoprotein (N) (as indicated in Column B, "Protein") according to the respective SEQ ID NOs as provided in Table 1, Column C, row 1 (BUNV), row 3 (NRIV), row 5 (BWAV), row 7 (CEV), row 9 (JCV), row 11 (KEYV), row 13 (LACV), or row 15 (OROV), or a fragment or variant of any of these sequences.

pendent RNA polymerase (L), Nucleoprotein (N), non-structural protein S(NSs), or a fragment or variant of any of these.

In embodiments, the at least one antigenic peptide or protein is derived from Orthohantavirus Nucleoprotein or Orthohantavirus Gycoprotein or a fragment or variant of any of these. Accordingly, the at least one antigenic peptide or protein derived from Orthohantavirus may suitably comprise at least one of the amino acid sequences being identical or at least 50%, 60% 70%, 80%, 85%, 86%, 87%, 88%, 89%

TABLE 1

Nucleoprotein (N) and Glycoprotein (GP) protein and nucleic acid coding sequences (cds) indicated for preferred viruses of the genus Orthobunyavirus

| Row | Column A Virus | Column B Protein | Column C SEQ ID NOs of Protein | Column D SEQ ID NOs of wild type cds | Column E SEQ ID NOs of CAI maximized cds | Column F SEQ ID NOs of human codon usage adapted cds | Column G SEQ ID NOs of G/C optimized cds | Column H SEQ ID NOs of G/C content modified cds |
|---|---|---|---|---|---|---|---|---|
| 1 | BUNV | N | 693-730 | 3028-3065 | 5363-5400 | 6055-6092 | 6747-6784 | 7439-7476, 8131-8168 |
| 2 | BUNV | GP | 1775-1849 | 4110-4184 | 9213-9287 | 10856-10930 | 12499-12573 | 14142-14216, 15785-15859 |
| 3 | NRIV | N | 731-734 | 3066-3069 | 5401-5404 | 6093-6096 | 6785-6788 | 7477-7480, 8169-8172 |
| 4 | NRIV | GP | 1850-1857 | 4185-4192 | 9288-9295 | 10931-10938 | 12574-12581 | 14217-14224, 15860-15867 |
| 5 | BWAV | N | 735-739 | 3070-3074 | 5405-5409 | 6097-6101 | 6789-6793 | 7481-7485, 8173-8177 |
| 6 | BWAV | GP | 1858-1861 | 4193-4196 | 9296-9299 | 10939-10942 | 12582-12585 | 14225-14228, 15868-15871 |
| 7 | CEV | N | 740-777 | 3075-3112 | 5410-5447 | 6102-6139 | 6794-6831 | 7486-7523, 8178-8215 |
| 8 | CEV | GP | 1862-1919 | 4197-4254 | 9300-9357 | 10943-11000 | 12586-12643 | 14229-14286, 15872-15929 |
| 9 | JCV | N | 778-788 | 3113-3123 | 5448-5458 | 6140-6150 | 6832-6842 | 7524-7534, 8216-8226 |
| 10 | JCV | GP | 1920-1924 | 4255-4259 | 9358-9362 | 11001-11005 | 12644-12648 | 14287-14291, 15930-15934 |
| 11 | KEYV | N | 789-791 | 3124-3126 | 5459-5461 | 6151-6153 | 6843-6845 | 7535-7537, 8227-8229 |
| 12 | KEYV | GP | 1925-1928 | 4260-4263 | 9363-9366 | 11006-11009 | 12649-12652 | 14292-14295, 15935-15938 |
| 13 | LACV | N | 792-797 | 3127-3132 | 5462-5467 | 6154-6159 | 6846-6851 | 7538-7543, 8230-8235 |
| 14 | LACV | GP | 1929-1961 | 4264-4296 | 9367-9399 | 11010-11042 | 12653-12685 | 14296-14328, 15939-15971 |
| 15 | OROV | N | 798-836 | 3133-3171 | 5468-5506 | 6160-6198 | 6852-6890 | 7544-7582, 8236-8274 |
| 16 | OROV | GP | 1962-1986 | 4297-4321 | 9400-9424 | 11043-11067 | 12686-12710 | 14329-14353, 15972-15996 |

Abbreviation: BUNV: Bunyamwera virus; BWAV: Bwamba bunyavirus; CEV: California encephalitis virus; GP: glycoprotein precursor; JCV: Jamestown Canyon virus; KEYV: Keystone virus; LACV: La Crosse virus; N: nucleoprotein; NRIV: Ngari virus; OROV: Oropouche virus Suitable Orthohantavirus Peptides or Protein:

According to the invention, the artificial nucleic acid comprises at least one coding sequence encoding at least one antigenic peptide or protein derived from at least one virus of the order Bunyavirales as defined herein, wherein the virus of the order Bunyavirales may be a virus of the genus Orthohantavirus, preferably a pathogenic virus of the genus Orthohantavirus, more preferably a virus selected from ANDV, BCCV, DOBV, HTNV LANV, LQUV, NYV, PUUV, SANGV, SEOV, SNV, THAW, or TULV.

In embodiments the at least one antigenic peptide or protein derived from a virus of the genus Orthohantavirus comprises or consists of Gycoprotein (Gycoprotein precursor (GP), Gycoprotein N(Gn) Gycoprotein C(Gc), GP38, GP85, GP160, non-structural protein M(NSm)), RNA-de- 90%, 91%, 92%, 93%, 94%, 95%, 96%, 97%, 98%, or 99% identical to any one of SEQ ID NOs: 234-587, 926-1170, 16579-16581, 16645-16647, 16711-16713, 16777-16779 and as defined in Column C of Table 2 derived from an Orthohantavirus protein or a fragment or variant of any of these sequences. Accordingly, the artificial nucleic acid of the invention may comprise at least one coding sequence encoding at least one antigenic peptide or protein from Orthohantavirus as specified above.

In embodiments, the at least one antigenic peptide or protein is derived from Orthohantavirus Glycoprotein or a fragment or variant of any of these. Accordingly, the at least one antigenic peptide or protein derived from Orthohantavirus Glycoprotein may suitably comprise at least one of the amino acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs: 926-1170, 16580, 16581, 16646, 16647, 16712, 16713, 16778, 16779 and as defined in Column C of Table 2 derived from an Orthohantavirus Glycoprotein or a fragment or variant of any of these sequences. Accordingly, the artificial nucleic acid of the invention may comprise at least one coding sequence encoding at least one antigenic peptide or protein derived from an Orthohantavirus Glycoprotein as specified above.

In embodiments, the at least one antigenic peptide or protein is derived from Orthohantavirus Nucleoprotein or a fragment or variant of any of these. Accordingly, the at least one antigenic peptide or protein derived from Orthohantavirus Nucleoprotein may suitably comprise at least one of the amino acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs: 234-587, 16579, 16645, 16711, 16777 and as defined in Column C of Table 2 derived from an Orthohantavirus Nucleoprotein or a fragment or variant of any of these sequences. Accordingly, the artificial nucleic acid of the invention may comprise at least one coding sequence encoding at least one antigenic peptide or protein derived from an Orthohantavirus Nucleoprotein as specified above.

In specific embodiments, the at least one antigenic peptide or protein is derived from Orthohantavirus, wherein the Orthohantavirus is selected from ANDV, BCCV, DOBV, HTNV, LANV, LQUV, NYV, PUUV, SANGV, SEOV, SNV, THAIV, or TULV.

According to the invention, the at least one antigenic peptide or protein derived from ANDV, BCCV, DOBV, HTNV, LANV, LQUV, NYV, PUUV, SANGV, SEOV, SNV, THAIV, or TULV or of the genus Orthohantavirus comprises or consists of Glycoprotein (e.g. Glycoprotein precursor (GP), Glycoprotein N (Gn), Glycoprotein C (Gc), GP38, GP85, GP160, non-structural protein M (NSm)), RNA-dependent RNA polymerase (L), Nucleoprotein (N), non-structural protein S (NSs), or a fragment or variant of any of these.

In embodiments, the at least one antigenic peptide or protein derived from ANDV, BCCV, DOBV, HTNV, LANV, LQUV, NYV, PUUV, SANGV, SEOV, SNV, THAIV, or TULV or a fragment or variant thereof encoded by the at least one coding sequence of the artificial nucleic acid according to the invention may typically comprise an amino acid sequence being identical, or at least 50%, 60%, 70%, 80%, 85%, 86%, 87%, 88%, 89%, 90%, 91%, 92%, 93%, 94%, 95%, 96%, 97%, 98%, or 99% identical to any one of the amino acid sequences according to SEQ ID NOs as provided in Table 2, Column C, or a fragment or variant of any of these sequences.

In Table 2, amino acid sequences derived from ANDV (Table 2, row 1 and 2), BCCV (Table 2, row 3 and 4), DOBV (Table 2, row 5 and 6), HTNV (Table 2, row 7 and 8), LANV (Table 2, row 9 and 10), LQUV (Table 2, row 11 and 12), NYV (Table 2, row 13 and 14), PUUV (Table 2, row 15 and 16), SANGV (Table 2, row 17 and 18), SEOV (Table 2, row 19 and 20), SNV (Table 2, row 21 and 22), THAIV (Table 2, row 23 and 24), or TULV (Table 2, row 25 and 26) are disclosed that are particularly suitable in the context of the invention. Each row of Table 2 corresponds to a suitable antigen in the context of the invention, wherein the virus (Column A, "Virus") and the respective peptide or protein (Column B, "Protein") are indicated. The corresponding amino acid sequences for each antigenic peptide or protein are provided in Column C (Column C, "SEQ ID NOs of Protein"). The respective SEQ ID NOs are provided in the corresponding sequence listing of that application. Notably, any feature or additional information of the ST.25 sequence listing, particularly information under numeric identifier <223> relating to sequences provided in Table 2 is explicitly included herein and has to be understood as part of the disclosure of the present invention as explained above. The following columns (Column D to Column H) provide the SEQ ID NOs corresponding to nucleic acid sequences that encode the respective ANDV, BCCV, DOBV, HTNV, LANV, LQUV, NYV, PUUV, SANGV, SEOV, SNV, THAIV, or TULV or peptides or proteins as defined by the SEQ ID NOs indicated in Column C.

In embodiments, the at least one antigenic peptide or protein is derived from ANDV, BCCV, DOBV, HTNV, LANV, LQUV, NYV, PUUV, SANGV, SEOV, SNV, THAIV, or TULV or Glycoprotein or a fragment or variant of any of these. Accordingly, the at least one antigenic peptide or protein derived from ANDV, BCCV, DOBV, HTNV, LANV, LQUV, NYV, PUUV, SANGV, SEOV, SNV, THAIV, or TULV or a fragment or variant thereof may typically comprise an amino acid sequence being identical, or at least 50%, 60%, 70%, 80%, 85%, 86%, 87%, 88%, 89%, 90%, 91%, 92%, 93%, 94%, 95%, 96%, 97%, 98%, or 99% identical to any one of the amino acid sequence corresponding to Glycoproteins GP (as indicated in Column B, "Protein") according to the respective SEQ ID NOs as provided in Table 2, Column C, row 2 (ANDV), row 4 (BCCV), row 6 (DOBV), row 8 (HTNV), row 10 (LANV), row 12 (LQUV), row 14 (NYV), row 16 (PUUV), row 18 (SANGV), row 20 (SEOV), row 22 (SNV), row 24 (THAIV), or row 26 (TULV), or a fragment or variant of any of these sequences.

In embodiments, the at least one antigenic peptide or protein is derived from ANDV, BCCV, DOBV, HTNV, LANV, LQUV, PUUV, SANGV, SEOV, SNV, THAIV, TULV, or NYV Nucleoprotein or a fragment or variant of any of these. Accordingly, the at least one antigenic peptide or protein derived from ANDV, BCCV, DOBV, HTNV, LANV, LQUV, PUUV, SANGV, SEOV, SNV, THAIV, TULV, or NYV or a fragment or variant thereof may typically comprise an amino acid sequence being identical, or at least 50%, 60%, 70%, 80%, 85%, 86%, 87%, 88%, 89%, 90%, 91%, 92%, 93%, 94%, 95%, 96%, 97%, 98%, or 99% identical to any one of the amino acid sequence corresponding to Nucleoprotein (N) (as indicated in Column B, "Protein") according to the respective SEQ ID NOs as provided in Table 2, Column C, row 1 (ANDV), row 3 (BCCV), row 5 (DOBV), row 7 (HTNV), row 9 (LANV), row 11 (LQUV), row 13 (NYV), row 15 (PUUV), row 17 (SANGV), row 19 (SEOV), row 21 (SNV), row 23 (THAIV), or row 25 (TULV), or a fragment or variant of any of these sequences.

TABLE 2

Nucleoprotein (N) and Glycoprotein (GP) protein and nucleic acid coding sequences (cds) indicated for preferred viruses of the genus Orthohantavirus

| Row | Column A Virus | Column B Protein | Column C SEQ ID NOs of Protein | Column D SEQ ID NOs of wild type cds | Column E SEQ ID NOs of CAI maximized cds | Column F SEQ ID NOs of human codon usage adapted cds | Column G SEQ ID NOs of G/C optimized cds | Column H SEQ ID NOs of G/C content modified cds |
|---|---|---|---|---|---|---|---|---|
| 1 | ANDV | N | 234-246 | 2569-2581 | 4904-4916 | 5596-5608 | 6288-6300 | 6980-6992, 7672-7684 |
| 2 | ANDV | GP | 926-931 | 3261-3266 | 8364-8369 | 10007-10012 | 11650-11655 | 13293-13298, 14936-14941 |
| 3 | BCCV | N | 247-248 | 2582-2583 | 4917-4918 | 5609-5610 | 6301-6302 | 6993-6994, 7685-7686 |
| 4 | BCCV | GP | 932 | 3267 | 8370 | 10013 | 11656 | 13299, 14942 |
| 5 | DOBV | N | 249-278 | 2584-2613 | 4919-4948 | 5611-5640 | 6303-6332 | 6995-7024, 7687-7716 |
| 6 | DOBV | GP | 933-948 | 3268-3283 | 8371-8386 | 10014-10029 | 11657-11672 | 13300-13315, 14943-14958 |
| 7 | HTNV | N | 279-372 | 2614-2707 | 4949-5042 | 5641-5734 | 6333-6426 | 7025-7118, 7717-7810 |
| 8 | HTNV | GP | 949-1050 | 3284-3385 | 8387-8488 | 10030-10131 | 11673-11774 | 13316-13417, 14959-15060 |
| 9 | LANV | N | 373-374 | 2708-2709 | 5043-5044 | 5735-5736 | 6427-6428 | 7119-7120, 7811-7812 |
| 10 | LANV | GP | 1051 | 3386 | 8489 | 10132 | 11775 | 13418, 15061 |
| 11 | LQUV | N | 375-377 | 2710-2712 | 5045-5047 | 5737-5739 | 6429-6431 | 7121-7123, 7813-7815 |
| 12 | LQUV | GP | 1052-1056 | 3387-3391 | 8490-8494 | 10133-10137 | 11776-11780 | 13419-13423, 15062-15066 |
| 13 | NYV | N | 378 | 2713 | 5048 | 5740 | 6432 | 7124, 7816 |
| 14 | NYV | GP | 1057-1059 | 3392-3394 | 8495-8497 | 10138-10140 | 11781-11783 | 13424-13426, 15067-15069 |
| 15 | PUUV | N | 379-489 | 2714-2824 | 5049-5159 | 5741-5851 | 6433-6543 | 7125-7235, 7817-7927 |
| 16 | PUUV | GP | 1060-1092 | 3395-3427 | 8498-8530 | 10141-10173 | 11784-11816 | 13427-13459, 15070-15102 |
| 17 | SANGV | N | 490-491 | 2825-2826 | 5160-5161 | 5852-5853 | 6544-6545 | 7236-7237, 7928-7929 |
| 18 | SANGV | GP | 1093-1094 | 3428-3429 | 8531-8532 | 10174-10175 | 11817-11818 | 13460-13461, 15103-15104 |
| 19 | SEOV | N | 492-561 | 2827-2896 | 5162-5231 | 5854-5923 | 6546-6615 | 7238-7307, 7930-7999 |
| 20 | SEOV | GP | 1095-1158 | 3430-3493 | 8533-8596 | 10176-10239 | 11819-11882 | 13462-13525, 15105-15168 |
| 21 | SNV | N | 562-568 | 2897-2903 | 5232-5238 | 5924-5930 | 6616-6622 | 7308-7314, 8000-8006 |
| 22 | SNV | GP | 1159-1168 | 3494-3503 | 8597-8606 | 10240-10249 | 11883-11892 | 13526-13535, 15169-15178 |
| 23 | THAIV | N | 569 | 2904 | 5239 | 5931 | 6623 | 7315, 8007 |
| 24 | THAIV | GP | 1169 | 3504 | 8607 | 10250 | 11893 | 13536, 15179 |
| 25 | TULV | N | 570-587 | 2905-2922 | 5240-5257 | 5932-5949 | 6624-6641 | 7316-7333, 8008-8025 |
| 26 | TULV | GP | 1170 | 3505 | 8608 | 10251 | 11894 | 13537, 15180 |

Abbreviation: ANDV: Andes hantavirus; BCCV: Black Creek Canal hantavirus virus; DOBV: Dobrava-Belgrade hantavirus; GP: glycoprotein precursor; HTNV: Haantan virus; LANV: Laguna Negra hantavirus; LQUV: Longquan hantavirus; N: nucleoprotein; NYV: New York hantavirus; PUUV: Puumala hantavirus; SANGV: Sangassou hantavirus; SEOV: Seoul hantavirus; SNV: Sin Nombre hantavirus; THAIV: Thailand hantavirus; TULV: Tula hantavirus Suitable Phlebovirus Peptides or Proteins:

According to the invention, the artificial nucleic acid comprises at least one coding sequence encoding at least one antigenic peptide or protein derived from at least one virus of the order Bunyavirales as defined herein, wherein the virus of the order Bunyavirales may be a virus of the genus Phlebovirus, preferably a pathogenic virus of the genus Phlebovirus, more preferably a virus selected from HRTV, PTV, SFNV, TOSV, RVFV, or SFTSV, even more preferably RVFV or SFTSV.

In embodiments the at least one antigenic peptide or protein derived from a virus of the genus Phlebovirus comprises or consists of Glycoprotein (Glycoprotein precursor (GP), Glycoprotein N (Gn), Glycoprotein C (Gc), GP38, GP85, GP160, non-structural protein M (NSm)), RNA-dependent RNA polymerase (L), Nucleoprotein (N), non-structural protein S (NSs), or a fragment or variant of any of these.

In embodiments, the at least one antigenic peptide or protein is derived from Phlebovirus Nucleoprotein or Phlebovirus Glycoprotein or a fragment or variant of any of these. Accordingly, the at least one antigenic peptide or protein derived from Phlebovirus may suitably comprise at least one of the amino acid sequences being identical or at least 50%, 60%, 70%, 80%, 85%, 86%, 87%, 88%, 89%, 90%, 91% 92%, 93%, 94%, 95%, 96%, 97%, 98%, or 99% identical to any one of SEQ ID NOs: 837-925, 1987-2568, 17200-17208, 17425-17427 and as defined in Column C of Table 3 derived from a Phlebovirus protein or a fragment or variant of any of these sequences. Accordingly, the artificial nucleic acid of the invention may comprise at least one coding sequence encoding at least one antigenic peptide or protein from Phlebovirus as specified above.

In embodiments, the at least one antigenic peptide or protein is derived from Phlebovirus Glycoprotein or a fragment or variant of any of these. Accordingly, the at least one antigenic peptide or protein derived from Phlebovirus Glycoprotein may suitably comprise at least one of the amino acid sequences being identical or at least 50%, 60%, 70%, 80%, 85%, 86%, 87%, 88%, 89%, 90%, 91%, 92% 93%, 94% 95%, 96%, 97% 98%, or 99% identical to any one of SEQ ID NOs: 1987-2568, 17201-17208, 17426, 17427 and as defined in Column C of Table 3 derived from a Phlebovirus Glycoprotein or a fragment or variant of any of these sequences. Accordingly, the artificial nucleic acid of the invention may comprise at least one coding sequence encoding at least one antigenic peptide or protein derived from a Phlebovirus Glycoprotein as specified above.

In embodiments, the at least one antigenic peptide or protein is derived from Phlebovirus Nucleoprotein or a fragment or variant of any of these. Accordingly, the at least one antigenic peptide or protein derived from Phlebovirus Nucleoprotein may suitably comprise at least one of the amino acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs: 837-925, 17200, 17425 and as defined in Column C of Table 3 derived from a Phlebovirus Nucleoprotein or a fragment or variant of any of these sequences. Accordingly, the artificial nucleic acid of the invention may comprise at least one coding sequence encoding at least one antigenic peptide or protein derived from a Phlebovirus Nucleoprotein as specified above.

In specific embodiments, the at least one antigenic peptide or protein is derived from Phlebovirus, wherein the Phlebovirus is selected from HRTV, PTV, SFNV, TOSV, RVFV, or SFTSV According to the invention, the at least one antigenic peptide or protein derived from HRTV, PTV, SFNV, TOSV, RVFV, or SFTSV of the genus Phlebovirus comprises or consists of Glycoprotein (e.g. Glycoprotein precursor (GP), Glycoprotein N (Gn), Glycoprotein C (Gc), GP38, GP85, GP160, non-structural protein M (NSm)), RNA-dependent RNA polymerase (L), Nucleoprotein (N), non-structural protein S (NSs), or a fragment or variant of any of these.

In embodiments, the at least one antigenic peptide or protein derived from HRTV, PTV, SFNV, TOSV, RVFV, or SFTSV or a fragment or variant thereof encoded by the at least one coding sequence of the artificial nucleic acid according to the invention may typically comprise an amino acid sequence being identical, or at least 50%, 60%, 70%, 80%, 85%, 86%, 87%, 88%, 89%, 90%, 91%, 92%, 93%, 94%, 95%, 96%, 97%, 98%, or 99% identical to any one of the amino acid sequences according to SEQ ID NOs as provided in Table 3, Column C, or a fragment or variant of any of these sequences.

In Table 3, amino acid sequences derived from HRTV (Table 3, row 1 and 2), PTV (Table 3, row 3 and 4), SFNV (Table 3, row 5 and 6), TOSV (Table 3, row 7 and 8), RVFV (Table 3, rows 9 to 14), or SFTSV (Table 3, row 15 and 16) are disclosed that are particularly suitable in the context of the invention. Each row of Table 3 corresponds to a suitable antigen in the context of the invention, wherein the virus (Column A, "Virus") and the respective peptide or protein (Column B, "Protein") are indicated. The corresponding amino acid sequences for each antigenic peptide or protein are provided in Column C (Column C, "SEQ ID NOs of Protein"). The respective SEQ ID NOs are provided in the corresponding sequence listing of that application. Notably, any feature or additional information of the ST.25 sequence listing, particularly information under numeric identifier <223> relating to sequences provided in Table 3 is explicitly included herein and has to be understood as part of the disclosure of the present invention as explained above. The following columns (Column D to Column H) provide the SEQ ID NOs corresponding to nucleic acid sequences that encode the respective HRTV, PTV, SFNV, TOSV, RVFV, or SFTSV peptides or proteins as defined by the SEQ ID NOs indicated in Column C.

In embodiments, the at least one antigenic peptide or protein is derived from HRTV, PTV, SFNV, TOSV, RVFV, or SFTSV Glycoprotein or a fragment or variant of any of these. Accordingly, the at least one antigenic peptide or protein derived from HRTV, PTV, SFNV, TOSV, RVFV, or SFTSV or a fragment or variant thereof may typically comprise an amino acid sequence being identical, or at least 50%, 60%, 70% 80%, 85% 86%, 87%, 88%, 89%, 90%, 91%, 92%, 93%, 94%, 95%, 96%, 97%, 98%, or 99% identical to anyone of the amino acid sequence corresponding to lycoproteins GGP, Gn, Gc, NSm (as indicated in Column, Protein) according to the respective SEQ ID NOs as provided in Table 3, Column C, row 2 (HRTV), row 4 (PTV), row 6 (SFNV) row 8 (TOSV), rows 10-14 (RVFV), row 16 (SFTSV), or a fragment or variant of any of these sequences.

In embodiments, the at least one antigenic peptide or protein is derived from HRTV PTV, SFNV, TOSV RVFV, or SFTSV Nucleoprotein or a fragment or variant of any of these. Accordingly, the at least one antigenic peptide or protein derived from HRTV, SFNV, TOSV, RVFV, or SFTSV or a fragment or variant thereof may typically comprise an amino acid sequence being identical, or at least 50%, 60% 70% 80%, 85%, 86%, 87%, 88%, 89%, 90%, 91%, 92%, 93%, 94%, 95%, 96%, 97%, 98%, or 99% identical to any one of the amino acid sequence corresponding to Nucleoprotein (N) (as indicated in Column B, Protein) according to the respective SEQ ID NOs as provided in Table 3, Column C, row 1 (HRTV), row 3 (PTV), row 5 (SFNV), row 7 (TOSV), rows 9 (RVFV), row 15 (SFTSV) or a fragment or variant of any of these sequences.

TABLE 3

Nucleoprotein (N) and Glycoprotein (GP) protein and nucleic acid coding sequences (cds) indicated for preferred viruses of the genus Phlebovirus

| Row | Column A Virus | Column B Protein | Column C SEQ ID NOs of Protein | Column D SEQ ID NOs of wild type CDS | Column E SEQ ID NOs of CAI maximized CDS | Column F SEQ ID NOs of human codon usage adapted CDS | Column G SEQ ID NOs of G/C optimized CDS | Column H SEQ ID NOs of G/C content modified CDS |
|---|---|---|---|---|---|---|---|---|
| 1 | HRTV | N | 837-839 | 3172-3174 | 5507-5509 | 6199-6201 | 6891-6893 | 7583-7585, 8275-8277 |
| 2 | HRTV | GP | 1987-1989 | 4322-4324 | 9425-9427 | 11068-11070 | 12711-12713 | 14354-14356, 15997-15999 |
| 3 | PTV | N | 840-852 | 3175-3187 | 5510-5522 | 6202-6214 | 6894-6906 | 7586-7598, 8278-8290 |
| 4 | PTV | GP | 1990-2008 | 4325-4343 | 9428-9446 | 11071-11089 | 12714-12732 | 14357-14375, 16000-16018 |
| 5 | SFNV | N | 855-871 | 3190-3206 | 5525-5541 | 6217-6233 | 6909-6925 | 7601-7617, 8293-8309 |
| 6 | SFNV | GP | 2320-2328 | 4655-4663 | 9758-9766 | 11401-11409 | 13044-13052 | 14687-14695, 16330-16338 |
| 7 | TOSV | N | 872-876 | 3207-3211 | 5542-5546 | 6234-6238 | 6926-6930 | 7618-7622, 8310-8314 |
| 8 | TOSV | GP | 2329-2356 | 4664-4691 | 9767-9794 | 11410-11437 | 13053-13080 | 14696-14723, 16339-16366 |
| 9 | RVFV | N | 853-854 | 3188-3189 | 5523-5524 | 6215-6216 | 6907-6908 | 7599-7600, 8291-8292 |
| 10 | RVFV | GP | 2009-2084 | 4344-4419 | 9447-9522 | 11090-11165 | 12733-12808 | 14376-14451, 16019-16094 |
| 11 | RVFV | NSm-Gn-Gc | 2085-2158 | 4420-4493 | 9523-9596 | 11166-11239 | 12809-12882 | 14452-14525, 16095-16168 |
| 12 | RVFV | Gn-Gc | 2159-2226 | 4494-4561 | 9597-9664 | 11240-11307 | 12883-12950 | 14526-14593, 16169-16236 |
| 13 | RVFV | Gn | 2227-2280 | 4562-4615 | 9665-9718 | 11308-11361 | 12951-13004 | 14594-14647, 16237-16290 |
| 14 | RVFV | Gc | 2281-2319 | 4616-4654 | 9719-9757 | 11362-11400 | 13005-13043 | 14648-14686, 16291-16329 |
| 15 | SFTSV | N | 877-925 | 3212-3260 | 5547-5595 | 6239-6287 | 6931-6979 | 7623-7671, 8315-8363 |
| 16 | SFTSV | GP | 2357-2568 | 4692-4903 | 9795-10006 | 11438-11649 | 13081-13292 | 14724-14935, 16367-16578 |

Abbreviation: Gc: glycoprotein C; Gn: glycoprotein N; GP: glycoprotein precursor; HRTV: Heartland virus; N: nucleoprotein; NSm: non-structural protein M; PTV: Punta Toro virus; RVFV: Rift Valley fever virus; SFNV: Sandfly fever Naples virus; SFTSV: Severe fever with thrombocytopenia syndrome virus; TOSV: Toscana virus Suitable RVFV Peptides or Proteins:

In preferred embodiments the at least one antigenic peptide or protein is derived from RVFV. Suitably, the at least one antigenic peptide or protein comprises or consists of Glycoprotein (Glycoprotein precursor (GP), Glycoprotein N (Gn), Glycoprotein C (Gc), GP38, GP85, GP160, non-structural protein M (NSm)), RNA-dependent RNA polymerase (L), Nucleoprotein (N), non-structural protein S (NSs), or a fragment or variant of any of these.

In preferred embodiments, the at least one antigenic peptide or protein is derived from RVFV Nucleoprotein or RVFV Glycoprotein or a fragment or variant of any of these. Accordingly, the at least one antigenic peptide or protein derived from RVFV may suitably comprise at least one of the amino acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs: 853-854, 2009-2319, 17200-17208 and as defined in Column C rows 9-14 of Table 3 derived from a RVFV protein or a fragment or variant of any of these sequences. Accordingly, the artificial nucleic acid of the invention may comprise at least one coding sequence encoding at least one antigenic peptide or protein from RVFV as specified above.

In preferred embodiments, the at least one antigenic peptide or protein is derived from RVFV Glycoprotein or a fragment or variant of any of these. Accordingly, the at least one antigenic peptide or protein derived from RVFV Glycoprotein may suitably comprise at least one of the amino acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs: 2009-2319, 17201-17208 and as defined in Column C rows 10-14 of Table 3 derived from a RVFV Glycoprotein or a fragment or variant of any of these sequences. Accordingly, the artificial nucleic acid of the invention may comprise at least one coding sequence encoding at least one antigenic peptide or protein derived from an RVFV Glycoprotein as specified above.

In specific embodiments, the at least one antigenic peptide or protein is derived from RVFV GP may suitably comprise at least one of the amino acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs: 2009-2084, 17201 and as defined in in column C row 10 of Table 3, or a fragment or variant of any of these sequences. Accordingly, the artificial nucleic acid of the invention may comprise at least one coding sequence encoding at least one antigenic peptide or protein derived from an RVFV Glycoprotein GP as specified above.

In specific embodiments, the at least one antigenic peptide or protein is derived from RVFV Gn may suitably comprise at least one of the amino acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs 2227-2280, 17206, 17207 and as defined in in columns C row 13 of Table 3, or a fragment or variant of any of these sequences. Accordingly, the artificial nucleic acid of the invention may comprise at least one coding sequence encoding at least one antigenic peptide or protein derived from an RVFV Glycoprotein N (Gn) as specified above.

In specific embodiments, the at least one antigenic peptide or protein is derived from RVFV Gc may suitably comprise at least one of the amino acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs: 2281-2319, 17208 and as defined in in columns C row 14 of Table 3, or a fragment or variant of any of these sequences. Accordingly, the artificial nucleic acid of the invention may comprise at least one coding sequence encoding at least one antigenic peptide or protein derived from an RVFV Glycoprotein C (Gc) as specified above.

In specific embodiments, the at least one antigenic peptide or protein is may suitably comprise at least one of the amino acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs: 2085-2226, 17202-17205 and as defined in in columns C row 12 of Table 3, or a fragment or variant of any of these sequences. Accordingly, the artificial nucleic acid of the invention may comprise at least one coding sequence encoding RVFV Gn and RVFV Gc.

In specific embodiments, the at least one antigenic peptide or protein may suitably comprise at least one of the amino acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs: 2085-2158 and as defined in in columns C row 11 of Table 3, or a fragment or variant of any of these sequences. Accordingly, the artificial nucleic acid of the invention may comprise at least one coding sequence encoding RVFV NSm, RVFV Gn and RVFV Gc.

In preferred embodiments, the at least one antigenic peptide or protein is derived from RVFV Nucleoprotein or a fragment or variant of any of these. Accordingly, the at least one antigenic peptide or protein derived from RVFV Nucleoprotein may suitably comprise at least one of the amino acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs: 853-854, 17200 and as defined in Column C row 10 of Table 3 derived from a RVFV Nucleoprotein or a fragment or variant of any of these sequences. Accordingly, the artificial nucleic acid of the invention may comprise at least one coding sequence encoding at least one antigenic peptide or protein derived from a RVFV Nucleoprotein as specified above.

Suitable SFTSV Peptides or Proteins:

In preferred embodiments the at least one antigenic peptide or protein is derived from SFTSV. Suitably, the at least one antigenic peptide or protein comprises or consists of Glycoprotein (Glycoprotein precursor (GP), Glycoprotein N (Gn), Glycoprotein C (Gc), GP38, GP85, GP160, non-structural protein M (NSm)), RNA-dependent RNA polymerase (L), Nucleoprotein (N), non-structural protein S (NSs), or a fragment or variant of any of these.

In preferred embodiments, the at least one antigenic peptide or protein is derived from SFTSV Nucleoprotein or SFTSV Glycoprotein or a fragment or variant of any of these. Accordingly, the at least one antigenic peptide or protein derived from SFTSV may suitably comprise at least one of the amino acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs: 877-925, 2357-2568, 17425-17427 and as defined in Column C rows 15 and 16 of Table 3 derived from a SFTSV protein or a fragment or variant of any of these sequences. Accordingly, the artificial nucleic acid of the invention may comprise at least one coding sequence encoding at least one antigenic peptide or protein from SFTSV as specified above.

In preferred embodiments, the at least one antigenic peptide or protein is derived from SFTSV Glycoprotein or a fragment or variant of any of these. Accordingly, the at least one antigenic peptide or protein derived from SFTSV Glycoprotein may suitably comprise at least one of the amino acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs: 2357-2568, 17426, 14727 and as defined in Column C row 16 of Table 3 derived from a SFTSV Glycoprotein or a fragment or variant of any of these sequences. Accordingly, the artificial nucleic acid of the invention may comprise at least one coding sequence encoding at least one antigenic peptide or protein derived from a SFTSV Glycoprotein as specified above.

In preferred embodiments, the at least one antigenic peptide or protein is derived from SFTSV Nucleoprotein or a fragment or variant of any of these. Accordingly, the at least one antigenic peptide or protein derived from SFTSV Nucleoprotein may suitably comprise at least one of the amino acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs: 877-925, 17425 and as defined in Column C row 15 of Table 3 derived from a SFTSV Nucleoprotein or a fragment or variant of any of these sequences. Accordingly, the artificial nucleic acid of the invention may comprise at least one coding sequence encoding at least one antigenic peptide or protein derived from a SFTSV Nucleoprotein as specified above.

Suitable Orthonairovirus Peptides or Proteins:

According to the invention, the artificial nucleic acid comprises at least one coding sequence encoding at least one antigenic peptide or protein derived from at least one virus of the order Bunyavirales as defined herein, wherein the virus of the order Bunyavirales may be a virus of the genus Orthonairovirus, preferably a pathogenic virus of the genus Orthonairovirus, more preferably a virus selected from NSDV, DUGV, or CCHFV, even more preferably the virus is CCHFV.

In embodiments the at least one antigenic peptide or protein derived from a virus of the genus Orthonairovirus comprises or consists of Glycoprotein (Gycoprotein precursor (GP), Glycoprotein N (Gn), Glycoprotein C (Gc), GP38, GP85, GP160, non-structural protein M (NSm)), RNA-dependent RNA polymerase (L), Nucleoprotein (N), non-structural protein S (NSs), or a fragment or variant of any of these.

In embodiments, the at least one antigenic peptide or protein is derived from Orthonairovirus Nucleoprotein or Orthonairovirus Glycoprotein or a fragment or variant of any of these. Accordingly, the at least one antigenic peptide or protein derived from Orthonairovirus may suitably comprise at least one of the amino acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs: 588-692, 1171-1774, 16840-16849 and as defined in Column C of Table 4 derived from an Orthonairovirus protein or a fragment or variant of any of these sequences. Accordingly, the artificial nucleic acid of the invention may comprise at least one coding sequence encoding at least one antigenic peptide or protein from Orthonairovirus as specified above.

In embodiments, the at least one antigenic peptide or protein is derived from Orthonairovirus Glycoprotein or a fragment or variant of any of these. Accordingly, the at least one antigenic peptide or protein derived from Orthonairovirus Glycoprotein may suitably comprise at least one of the amino acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs: 1171-1774, 16842-16849 and as defined in Column C of Table 4 derived from an Orthonairovirus Glycoprotein or a fragment or variant of any of these sequences. Accordingly, the artificial nucleic acid of the invention may comprise at least one coding sequence encoding at least one antigenic peptide or protein derived from an Orthonairovirus Glycoprotein as specified above.

In embodiments, the at least one antigenic peptide or protein is derived from Orthonairovirus Nucleoprotein or a fragment or variant of any of these. Accordingly, the at least one antigenic peptide or protein derived from Orthonairovirus Nucleoprotein may suitably comprise at least one of the amino acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs: 588-692, 16840, 16841 and as defined in Column C of Table 4 derived from an Orthonairovirus Nucleoprotein or a fragment or variant of any of these sequences. Accordingly, the artificial nucleic acid of the invention may comprise at least one coding sequence encoding at least one antigenic peptide or protein derived from an Orthonairovirus Nucleoprotein as specified above.

In specific embodiments, the at least one antigenic peptide or protein is derived from Orthonairovirus, wherein the Orthonairovirus is selected from NSDV, DUGV, or CCHFV.

According to the invention, the at least one antigenic peptide or protein derived from NSDV, DUGV, or CCHFV of the genus Orthonairovirus comprises or consists of Glycoprotein (e.g. Glycoprotein precursor (GP), Glycoprotein N (Gn), Glycoprotein C (Gc), GP38, GP85, GP160, non-structural protein M (NSm)), RNA-dependent RNA polymerase (L), Nucleoprotein (N), non-structural protein S (NSs), or a fragment or variant of any of these.

In embodiments, the at least one antigenic peptide or protein derived from NSDV, DUGV, or CCHFV or a fragment or variant thereof encoded by the at least one coding sequence of the artificial nucleic acid according to the invention may typically comprise an amino acid sequence being identical, or at least 50%, 60%, 70%, 80%, 85%, 86%, 87%, 88%, 89%, 90%, 91%, 92%, 93%, 94%, 95%, 96%, 97%, 98%, or 99% identical to any one of the amino acid sequences according to SEQ ID NOs as provided in Table 4, Column C, or a fragment or variant of any of these sequences.

In Table 4, amino acid sequences derived from NSDV (Table 4, row 1 and 2), DUGV (Table 4, row 3 and 4), or CCHFV (Table 4, rows 5 to 10) are disclosed that are particularly suitable in the context of the invention. Each row of Table 4 corresponds to a suitable antigen in the context of the invention, wherein the virus (Column A, "Virus") and the respective peptide or protein (Column B, "Protein") are indicated. The corresponding amino acid sequences for each antigenic peptide or protein are provided in Column C (Column C, "SEQ ID NOs of Protein"). The respective SEQ ID NOs are provided in the corresponding sequence listing of that application. Notably, any feature or additional information of the ST.25 sequence listing, particularly information under numeric identifier <223> relating to sequences provided in Table 4 is explicitly included herein and has to be understood as part of the disclosure of the present invention as explained above. The following columns (Column D to Column H) provide the SEQ ID NOs corresponding to nucleic acid sequences that encode the respective NSDV, DUGV, or CCHFV peptides or proteins as defined by the SEQ ID NOs indicated in Column C.

In embodiments, the at least one antigenic peptide or protein is derived from NSDV, DUGV, or CCHFV Glycoprotein or a fragment or variant of any of these. Accordingly, the at least one antigenic peptide or protein derived from NSDV, DUGV, or CCHFV or a fragment or variant thereof may typically comprise an amino acid sequence being identical, or at least 50%, 60%, 70%, 80%, 85%, 86%, 87%, 88%, 89%, 90%, 91%, 92%, 93%, 94%, 95%, 96%, 97%, 98%, or 99% identical to any one of the amino acid sequence corresponding to Glycoproteins G, GP, Gn, Gc, NSm (as indicated in Column B, "Protein") according to the respective SEQ ID NOs as provided in Table 4, Column C, row 2 (NSDV), row 4 (DUGV), rows 6-10 (CCHFV), or a fragment or variant of any of these sequences.

In embodiments, the at least one antigenic peptide or protein is derived from NSDV, DUGV, or CCHFV Nucleoprotein or a fragment or variant of any of these. Accordingly, the at least one antigenic peptide or protein derived from NSDV, DUGV, or CCHFV or a fragment or variant thereof may typically comprise an amino acid sequence being identical, or at least 50%, 60%, 70%, 80%, 85%, 86%, 87%, 88%, 89%, 90%, 91%, 92%, 93%, 94%, 95%, 96%, 97%, 98%, or 99% identical to any one of the amino acid sequence corresponding to Nucleoprotein (N) (as indicated in Column B, "Protein") according to the respective SEQ ID NOs as provided in Table 4, Column C, row 1 (NSDV), row 3 (DUGV), rows 5 (CCHFV), or a fragment or variant of any of these sequences.

TABLE 4

Nucleoprotein (N) and Glycoprotein (GP) protein and nucleic acid coding sequences (cds) indicated for preferred viruses of the genus Orthonairovirus

| Row | Column A Virus | Column B Protein | Column C SEQ ID NOs of Protein | Column D SEQ ID NOs of wild type cds | Column E SEQ ID NOs of CAI maximized cds | Column F SEQ ID NOs of human codon usage adapted cds | Column G SEQ ID NOs of G/C optimized cds | Column H SEQ ID NOs of G/C content modified cds |
|---|---|---|---|---|---|---|---|---|
| 1 | NSDV | N | 685-692 | 3020-3027 | 5355-5362 | 6047-6054 | 6739-6746 | 7431-7438, 8123-8130 |
| 2 | NSDV | GP | 1772-1774 | 4107-4109 | 9210-9212 | 10853-10855 | 12496-12498 | 14139-14141, 15782-15784 |
| 3 | DUGV | N | 678-684 | 3013-3019 | 5348-5354 | 6040-6046 | 6732-6738 | 7424-7430, 8116-8122 |
| 4 | DUGV | GP | 1770-1771 | 4105-4106 | 9208-9209 | 10851-10852 | 12494-12495 | 14137-14138, 15780-15781 |
| 5 | CCHFV | N | 588-677 | 2923-3012 | 5258-5347 | 5950-6039 | 6642-6731 | 7334-7423, 8026-8115 |
| 6 | CCHFV | GP | 1171-1353 | 3506-3688 | 8609-8791 | 10252-10434 | 11895-12077 | 13538-13720, 15181-15363 |
| 7 | CCHFV | Gn-NSm-Gc | 1354-1469 | 3689-3804 | 8792-8907 | 10435-10550 | 12078-12193 | 13721-13836, 15364-15479 |
| 8 | CCHFV | Gn-4aa-Gc | 1470-1576 | 3805-3911 | 8908-9014 | 10551-10657 | 12194-12300 | 13837-13943, 15480-15586 |
| 9 | CCHFV | Gn | 1577-1662 | 3912-3997 | 9015-9100 | 10658-10743 | 12301-12386 | 13944-14029, 15587-15672 |
| 10 | CCHFV | Gc | 1663-1769 | 3998-4104 | 9101-9207 | 10744-10850 | 12387-12493 | 14030-14136, 15673-15779 |

Abbreviation: 4aa: 4 amino acids; CCHFV: Crimean-Congo hemorrhagic fever virus; DUGV: Dugbe virus; Gc: glycoprotein C; Gn: glycoprotein N; GP: glycoprotein precursor; N: nucleoprotein; NSDV: Nairobi sheep disease virus; NSm: non-structural protein M CCHFV Peptides or Proteins In preferred embodiments the at least one antigenic peptide or protein is derived from CCHFV. Suitably, the at least one antigenic peptide or protein comprises or consists of Glycoprotein (Glycoprotein precursor (GP), Glycoprotein N (Gn), Glycoprotein C (Gc), GP38, GP85, GP160, non-structural protein M (NSm)), RNA-dependent RNA polymerase (L), Nucleoprotein (N), non-structural protein S (NSs), or a fragment or variant of any of these.

In preferred embodiments, the at least one antigenic peptide or protein is derived from CCHFV Nucleoprotein or CCHFV Glycoprotein or a fragment or variant of any of these. Accordingly, the at least one antigenic peptide or protein derived from CCHFV may suitably comprise at least one of the amino acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs: 588-677, 1171-1769, 16840-16849 and as defined in Column C rows 5-10 of Table 4 derived from a CCHFV protein or a fragment or variant of any of these sequences. Accordingly, the artificial nucleic acid of the invention may comprise at least one coding sequence encoding at least one antigenic peptide or protein from CCHFV as specified above.

In preferred embodiments, the at least one antigenic peptide or protein is derived from CCHFV Glycoprotein or a fragment or variant of any of these. Accordingly, the at least one antigenic peptide or protein derived from CCHFV Glycoprotein may suitably comprise at least one of the amino acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs: 1171-1769, 16842-16849 and as defined in Column C rows 6-10 of Table 4 derived from a CCHFV Glycoprotein or a fragment or variant of any of these sequences. Accordingly, the artificial nucleic acid of the invention may comprise at least one coding sequence encoding at least one antigenic peptide or protein derived from a CCHFV Glycoprotein as specified above.

In specific embodiments, the at least one antigenic peptide or protein is derived from CCHFV GP may suitably comprise at least one of the amino acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs: 1171-1353, 16842-16844 and as defined in in Column C row 6 of Table 4, or a fragment or variant of any of these sequences. Accordingly, the artificial nucleic acid of the invention may comprise at least one coding sequence encoding at least one antigenic peptide or protein derived from a CCHFV Glycoprotein (GP) as specified above.

In specific embodiments, the at least one antigenic peptide or protein is derived from CCHFV Gn may suitably comprise at least one of the amino acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs 1577-1662, 16848 and as defined in in Column C row 9 of Table 4, or a fragment or variant of any of these sequences. Accordingly, the artificial nucleic acid of the invention may comprise at least one coding sequence encoding at least one antigenic peptide or protein derived from a CCHFV Glycoprotein N (Gn) as specified above.

In specific embodiments, the at least one antigenic peptide or protein is derived from CCHFV Gc may suitably comprise at least one of the amino acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs: 1663-1769, 16849 and as defined in in Column C row 10 of Table 4, or a fragment or variant of any of these sequences. Accordingly, the artificial nucleic acid of the invention may comprise at least one coding sequence encoding at least one antigenic peptide or protein derived from a CCHFV Glycoprotein C (Gc) as specified above.

In specific embodiments, the at least one antigenic peptide or protein is may suitably comprise at least one of the amino acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs: 1470-1576, 16847 and as defined in in Column C row 8 of Table 4, or a fragment or variant of any of these sequences. Accordingly, the artificial nucleic acid of the invention may comprise at least one coding sequence encoding CCHFV Gn and CCHFV Gc.

In specific embodiments, the at least one antigenic peptide or protein may suitably comprise at least one of the amino acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs: 1354-1469, 16845, 16846 and as defined in in Column C row 7 of Table 4, or a fragment or variant of any of these sequences. Accordingly, the artificial nucleic acid of the invention may comprise at least one coding sequence encoding CCHFV NSm, CCHFV Gn and CCHFV Gc.

In preferred embodiments, the at least one antigenic peptide or protein is derived from CCHFV Nucleoprotein, or a fragment or variant of any of these. Accordingly, the at least one antigenic peptide or protein derived from CCHFV Nucleoprotein may suitably comprise at least one of the amino acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs: 588-677, 16840, 16841 and as defined in Column C row 5 of Table 4 derived from a CCHFV Nucleoprotein or a fragment or variant of any of these sequences. Accordingly, the artificial nucleic acid of the invention may comprise at least one coding sequence encoding at least one antigenic peptide or protein derived from a CCHFV Nucleoprotein as specified above.

Additional Peptide or Protein Elements:

According to another preferred embodiment, the artificial nucleic acid according to the invention, particularly the at least one coding sequence, encodes at least one antigenic peptide or protein as defined above and may additionally encode at least one further peptide or protein element.

Suitably, the at least one further peptide or protein element may promote secretion of the encoded antigenic peptide or protein of the invention (e.g. via secretory signal peptides), promote anchoring of the encoded antigenic peptide or protein of the invention in the plasma membrane (e.g. via transmembrane elements), promote formation of antigen complexes (e.g. via multimerization domains), promote virus-like particle formation (VLP forming sequence). In addition, the artificial nucleic acid sequence according to the present invention may additionally encode peptide linker elements, self-cleaving peptides, immunologic adjuvant sequences or dendritic cell targeting sequences.

In embodiments, the artificial nucleic acid, particularly the RNA according to the invention may additionally encode at least one multimerization domain. For antigenic peptides or proteins according to the invention, multimerization of the encoded antigen may be beneficial for the induction of an immune response. Fusion of the target antigen to at least one multimerization domain (e.g. dimerization domain, trimerization domain, tetramerization domain, and oligomerization domain) may lead to the formation of multimeric antigen-complexes. This potentially increases immunogenicity of the respective antigen because such antigen-complexes may mimic a "natural" infection with an exogenous pathogen (e.g. virus) where a plurality of potential antigens is commonly located at the envelope of the pathogen (e.g. Glycoprotein antigen of a virus of the order Bunyavirales). Suitable multimerization domains may be selected from the list of amino acid sequences according to SEQ ID NOs: 1116-1167 of the patent application WO2017/081082, or fragments or variants of these sequences. On nucleic acid level, any nucleic acid sequence (e.g. RNA sequence) may be selected which encodes such amino acid sequences. In this context, the disclosure of WO2017/081082 is herewith incorporated by reference.

Accordingly, in preferred embodiments, the artificial nucleic acid according to the invention, particularly the artificial RNA, particularly the at least one coding sequence, may additionally encode at least one further peptide or protein element selected from a secretory signal peptide, a transmembrane domain, a VLP forming domain, a peptide linker, a self-cleaving peptide, an immunologic adjuvant sequence, and/or a dendritic cell targeting sequence.

In embodiments, the artificial nucleic acid according to the invention, particularly the artificial RNA, may additionally encode at least one transmembrane element. Transmembrane elements or membrane spanning polypeptide elements are present in proteins that are integrated or anchored in plasma membranes of cells. Typical transmembrane elements are alpha-helical transmembrane elements. Such transmembrane elements are composed essentially of amino acids with hydrophobic side chains, because the interior of a cell membrane (lipid bilayer) is also hydrophobic. The addition of a transmembrane element to the antigenic peptide or protein of the invention further enhances the immune response, wherein for example the translated peptide/protein, e.g. a viral antigen, anchors to a target membrane, e.g. the plasma membrane of a cell, thereby increasing immune responses. This effect is also referred to as antigen clustering. Suitable transmembrane elements may be selected from the list of amino acid sequences according to SEQ ID NOs: 1228-1343 of the patent application WO2017/081082, or fragments or variants of these sequences. On nucleic acid level, any nucleic acid sequence (e.g. RNA sequence) may be selected which encodes such amino acid sequences. In this context, the disclosure of WO2017/081082 is herewith incorporated by reference.

In embodiments, the artificial nucleic acid, particularly the RNA according to the invention may additionally encode at least one VLP forming sequence. VLPs are self-assembled viral structural proteins (envelope proteins or capsid proteins) that structurally resemble viruses (without containing viral genetic material). VLPs contain repetitive high density displays of antigens which present conformational epitopes that can elicit strong T cell and B cell immune responses. When used in combination with the antigenic peptide or protein in the context of the present invention, such VLP forming sequences may be placed N-terminal or C-terminal to the antigenic peptide or protein of the invention. VLP forming sequences fused to an antigen of the invention may generate virus like particles containing repetitive high density displays of antigens, may promote clustering of antigens, or may promote secretion of the VLP particle, thereby increasing the immunogenicity of the respective antigen. Suitable VLP forming sequences may be selected from the list of amino acid sequences according to SEQ ID NOs: 1168-1227 of the patent application WO2017081082, or fragments or variants of these sequences. On nucleic acid level, any nucleic acid sequence (e.g. RNA sequence) may be selected which encodes such amino acid sequences. In this context, the disclosure of WO2017/081082 is herewith incorporated by reference.

In embodiments, the artificial nucleic acid, particularly the RNA according to the invention may additionally encode at least one peptide linker. In protein constructs composed of several elements (e.g. antigenic peptide or protein of the invention fused to a VLP sequence), the protein elements may be separated by peptide linker elements. Such elements may be beneficial because they allow for a proper folding of the individual elements and thereby the proper functionality of each element. Peptide linkers are preferably composed of small, non-polar (e.g. Gly) or polar (e.g. Ser or Thr) amino acids. The small size of these amino acids provides flexibility, and allows for mobility of the connecting functional domains. The incorporation of Ser or Thr can maintain the stability of the linker in aqueous solutions by forming hydrogen bonds with the water molecules, and therefore reduces an interaction between the linker and the protein moieties. Rigid linkers generally maintain the distance between the protein domains and they may be based on helical structures and/or they have a sequence that is rich in proline. Cleavable linkers allow for in vivo separation of the protein domains. The mechanism of cleavage may be based e.g. on reduction of disulfide bonds within the linker sequence or proteolytic cleavage. The cleavage may be mediated by an enzyme (enzymatic cleavage), e.g. the cleavage linker may provide a protease sensitive sequence (e.g. furin cleavage). A typical sequence of a flexible linker is composed of repeats of the amino acids Glycine (G) and Serine (S). In some embodiments, the sequence is repeated multiple times (e.g. two, three, four, five or six times) to create a longer linker. In other embodiments, a single amino acid residue such as S or G can be used as a linker. Suitable peptide linkers may be selected from the list of amino acid sequences according to SEQ ID NOs: 1509-1565 of the patent application WO2017/081082, or fragments or variants of these sequences. On nucleic acid level, any nucleic acid sequence (e.g. RNA sequence) may be selected which encodes such amino acid sequences. In this context, the disclosure of WO2017/081082 is herewith incorporated by reference.

In embodiments, the artificial nucleic acid, particularly the RNA according to the invention may additionally encode at least one self-cleaving peptide. Viral self-cleaving peptides allow the expression of multiple proteins from a single coding sequence. When used in the context of the present invention, such self-cleaving peptides are particularly useful when encoded by a nucleic acid encoding at least two functional protein elements (e.g. antigenic peptides or proteins). In general, a self-cleaving peptide is useful when the artificial nucleic acid of the invention encodes at least one antigenic peptide or protein of the invention and at least one additional peptide or protein element as defined herein. The coding sequence for such self-cleaving peptides is typically located in between the coding sequence of the antigen and the coding sequence of the least one further protein element so that cleavage of the self-cleaving peptide leads to two separate polypeptide molecules, at least one of them being an antigenic peptide or protein of the invention. Suitable self-cleaving peptides may be selected from the list of amino acid sequences according to SEQ ID NOs: 1434-1508 of the patent application WO2017081082, or fragments or variants of these sequences. On nucleic acid level, any nucleic acid sequence (e.g. RNA sequence) may be selected which encodes such amino acid sequences. In this context, the disclosure of WO2017/081082 is herewith incorporated by reference.

In embodiments, the artificial nucleic acid, particularly the RNA according to the invention may additionally encode at least one immunologic adjuvant sequence. Immunologic adjuvant sequences may comprise peptide or protein elements that potentiate or "govern" the immune response. Such elements may include peptides/proteins that trigger a danger response (e.g. damage-associated molecular pattern molecules (DAMPs)), elements that activate the complement system (e.g. peptides/proteins involved in the classical complement pathway, the alternative complement pathway, and the lectin pathway), elements that activate an innate immune response (e.g. pathogen-associated molecular pattern molecules, PAMPs), or elements that bind to class II MHC molecules as a nonspecific vaccine helper epitope (adjuvant) and induces an increased (and long term) immune response by increasing the helper T-cell response. Suitable immunologic adjuvant sequences may be selected from the list of amino acid sequences according to SEQ ID NOs: 1360-1421 of the patent application WO2017/081082, or fragments or variants of these sequences. On nucleic acid level, any nucleic acid sequence (e.g. RNA sequence) may be selected which encodes such amino acid sequences. In this context, the disclosure of WO2017/081082 is herewith incorporated by reference.

In embodiments, the artificial nucleic acid, particularly the RNA according to the invention may additionally encode at least one dendritic cell (DCs) targeting sequence. Targeting antigens to DCs may be an appropriate method to stimulate and induce effective antiviral immune responses. To achieve dendritic cell targeting, proteins/peptides that bind to DC surface receptors have to be fused to the respective antigenic peptide or protein of the invention. Such DC receptors include C-type lectins (mannose receptors (e.g. MR1, DEC-205 (CD205)), CD206, DC-SI(GN) (CD209), Clec9a, DCIR, Lox-1, MGL, MGL-2, Clec12A, Dectin-1, Detin-2, langerin (CD207)), scavenger receptors, F4/80 receptors (EMR1), DC-STAMP, receptors for the Fc portion of antibodies (Fc receptors), toll-like receptors (e.g. TLR2, 5, 7, 8, 9) and complement receptors (e.g. CR1, CR2). Suitable dendritic cell (DCs) targeting sequences may be selected from the list of amino acid sequences according to SEQ ID NOs: 1344-1359 of the patent application WO2017/081082, or fragments or variants of these sequences. On nucleic acid level, any nucleic acid sequence (e.g. RNA sequence) may be selected which encodes such amino acid sequences. In this context, the disclosure of WO2017/081082 is herewith incorporated by reference.

In a preferred embodiment, the artificial nucleic acid or particularly the artificial RNA according to the invention, particularly the at least one coding sequence, encodes at least one antigenic peptide or protein as defined herein and additionally encodes a secretory signal peptide.

Secretory signal peptides are amino acid sequences of about 15 to 30 amino acids length. These sequences are preferably located at the N-terminus of the encoded antigenic peptide or protein as defined herein. Signal peptides allow the transport of the antigenic peptide or proteins as encoded by the at least one artificial nucleic acid sequence into a defined cellular compartment, preferably the cell surface, the endoplasmic reticulum (ER) or the endosomal-lysosomal compartment. Suitable secretory signal peptides may be selected from the list of amino acid sequences according to SEQ ID NOs: 1-1115 and SEQ ID NO: 1728 of the patent application WO2017/081082, or fragments or variants of these sequences. On nucleic acid level, any nucleic acid sequence (e.g. RNA sequence) may be selected which encodes such amino acid sequences. In this context, the disclosure of WO2017/081082 is herewith incorporated by reference.

In preferred embodiments, the secretory signal peptide comprises an amino acid sequence being identical or at least 50%, 60%, 70%, 80%, 85%, 86%, 87%, 88%, 89%, 90%, 91% 92%, 93%, 94%, 95%, 96%, 97%, 98%, or 99% identical to any one of SEQ ID NO: 38-65, or a fragment or variant of any of these sequences.

In particularly preferred embodiments, the at least one secretory signal peptide is selected from amino acid sequences according to SEQ ID NOs: 38 or 39, or a fragment or variant of any of these sequences.

In preferred embodiments, the secretory signal peptide as defined above, particularly the secretory signal peptide according to SEQ ID NO: 38-65, is suitably located at the N-terminus of the antigenic peptide or protein derived from a virus of the order Bunyavirales as defined herein.

Suitable Bunyavirales Nucleic Acid Coding Sequences:

According to a preferred embodiment, the artificial nucleic acid, particularly the artificial RNA comprises at least one coding sequence encoding at least one antigenic peptide or protein as defined herein derived from at least one virus of the order Bunyavirales as defined herein. Accordingly, any coding sequence encoding at least one antigenic peptide or protein derived from at least one virus of the order Bunyavirales as defined herein may be understood as suitable coding sequence and may therefore be comprised in the artificial nucleic acid of the invention.

Suitably, the artificial nucleic acid or the the artificial RNA comprises at least one coding sequence encoding at least one antigenic peptide or protein as defined herein derived from at least one virus of the genus Orthobunyavirus, the genus Orthohantavirus, the genus Phlebovirus, or the genus Orthonairovirus as defined herein. Accordingly, any coding sequence encoding at least one antigenic peptide or protein derived from at least one virus of the genus Orthobunyavirus, the genus Orthohantavirus, the genus Phlebovirus, or the genus Orthonairovirus as defined above may be understood as suitable coding sequence and may therefore be comprised in the artificial nucleic acid of the invention.

In the context of the invention, the coding sequence encoding the at least one Bunyavirales antigenic peptide or protein or fragment, variant or derivative thereof, may be selected from any nucleic acid sequence comprising a coding sequence encoding Glycoprotein (Glycoprotein precursor (GP), Glycoprotein N (Gn), Glycoprotein C (Gc), GP38, GP85, GP160, non-structural protein M (NSm)), RNA-dependent RNA polymerase (L), Nucleoprotein (N), non-structural protein S (NSs), or a fragment or variant of any of these, preferably derived from any virus of the order Bunyavirales as defined herein, more preferably from any pathogenic virus of the order Bunyavirales as defined herein.

The artificial nucleic acid of the invention, particularly the artificial RNA according to the invention may comprise or consist of at least one coding sequence encoding at least one Bunyavirales antigenic peptide or protein as defined herein, preferably encoding any one of SEQ ID NOs: 234-2568, 16579-16581, 16645-16647, 16711-16713, 16777-16779, 16840-16849, 17090-17094, 17200-17208, 17425-17427 or fragments of variants thereof. It has to be understood that, on nucleic acid level, any nucleic acid sequence (e.g. DNA sequence, RNA sequence) which encodes an amino acid sequences being identical to SEQ ID NOs: 234-2568, 16579-16581, 16645-16647, 16711-16713, 16777-16779, 16840-16849, 17090-17094, 17200-17208, 17425-17427 or fragments or variants thereof, or any nucleic acid sequence (e.g. DNA sequence, RNA sequence) which encodes amino acid sequences being at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs: 234-2568, 16579-16581, 16645-16647, 16711-16713, 16777-16779, 16840-16849, 17090-17094, 17200-17208, 17425-17427 or fragments or variants thereof, may be selected and may accordingly be understood as suitable coding sequence and may therefore be comprised in the artificial nucleic acid of the invention.

According to a preferred embodiment, the artificial nucleic acid, particularly the artificial RNA comprises or consists of at least one coding sequence encoding at least one Bunyavirales antigenic peptide or protein as defined herein. Preferably, the artificial nucleic acid comprises or consists of at least one coding sequence, wherein said at least one coding sequence comprises at least one of the nucleic acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to SEQ ID NOs: 2569-16578, 16582-16644, 16648-16710, 16714-16776, 16780-16839, 16850-17089, 17095-17199, 17209-17424, 17428-17487 and as defined in Columns D-H of Tables 1-4, encoding a peptide or protein derived from a Bunyavirales or a fragment or variant of any of these sequences.

In embodiments, the at least one coding sequence encodes a Bunyavirales Glycoproteins or fragments or variants thereof. Preferably, the at least one coding sequence comprises at least one of the nucleic acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to SEQ ID NOs: 3261-4903, 8364-16578, 16584-16587, 16589, 16590, 16592, 16593, 16595, 16596, 16598, 16599, 16601, 16602, 16650-16653, 16655, 16656, 16658, 16659, 16661, 16662, 16664, 16665, 16667, 16668, 16716-16719, 16721, 16722, 16724, 16725, 16727, 16728, 16730, 16731, 16733, 16734, 16781-16784, 16786, 16787, 16789, 16790, 16792, 16793, 16795, 16796, 16798, 16799, 16854-16869, 16872-16879, 16882-16889, 16892-16899, 16902-16909, 16912-16919, 16922-16929, 17097-17104, 17106-17109, 17111-17114, 17116-17119, 17121-17124, 17126-17129, 17211-17226, 17228-17235, 17237-17244, 17246-17253, 17255-17262, 17264-17271, 17273-17280, 17429-17432, 17434, 17435, 17437, 17438, 17440, 17441, 17443, 17444, 17446, 17447 and as defined in Columns D-H of Tables 1-4, encoding a Glycoprotein derived from a Bunyavirales or a fragment or variant of any of these sequences.

In embodiments, the at least one coding sequence encodes a Bunyavirales Nucleoprotein or fragments or variants thereof. Preferably, the at least one coding sequence comprises at least one of the nucleic acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to SEQ ID NOs: 2569-3260, 4904-8363, 16582, 16583, 16588, 16591, 16594, 16597, 16600, 16648, 16649, 16654, 16657, 16660, 16663, 16666, 16714, 16715, 16720, 16723, 16726, 16729, 16732, 16780, 16785, 16788, 16791, 16794, 16797, 16850, 16851, 16852, 16853, 16870, 16871, 16880, 16881, 16890, 16891, 16900, 16901, 16910, 16911, 16920, 16921, 17095, 17096, 17105, 17110, 17115, 17120, 17125, 17209, 17210, 17227, 17236, 17245, 17254, 17263, 17272, 17428, 17433, 17436, 17439, 17442, 17445 and as defined in Columns D-H of Tables 1-4, encoding a Nucleoprotein derived from a Bunyavirales or a fragment or variant of any of these sequences.

Suitable Orthobunyavirus Nucleic Acid Coding Sequences:

According to a preferred embodiment, the artificial nucleic acid, particularly the artificial RNA comprises at least one coding sequence encoding at least one antigenic peptide or protein as defined herein derived from at least one virus of the order Bunyavirales as defined herein, wherein the virus of the order Bunyavirales may be a virus of the genus Orthobunyavirus, more preferably a virus selected from BUNV, NRIV, BWAV, CEV, JCV, KEYV, LACV, or OROV. Accordingly, any coding sequence encoding at least one antigenic peptide or protein derived from at least one virus of the genus Orthobunyavirus, preferably a virus selected from BUNV, NRIV, BWAV, CEV, JCV, KEYV, LACV, or OROV, may be understood as suitable coding sequence and may therefore be comprised in the artificial nucleic acid of the invention.

In the context of the invention, the coding sequence encoding the at least one Orthobunyavirus antigenic peptide or protein or fragment, variant or derivative thereof, may be selected from any nucleic acid sequence comprising a coding sequence encoding Glycoprotein (Glycoprotein precursor (GP), Glycoprotein N (Gn), Glycoprotein C (Gc), GP38, GP85, GP160, non-structural protein M (NSm)), RNA-dependent RNA polymerase (L), Nucleoprotein (N), non-structural protein S (NSs), or a fragment or variant of any of these, preferably derived from any virus of the genus Orthobunyavirus, preferably a virus selected from BUNV, NRIV, BWAV, CEV, JCV, KEYV, LACV, or OROV.

The artificial nucleic acid of the invention, particularly the artificial RNA may comprise or consist of at least one coding sequence encoding at least one Orthobunyavirus antigenic peptide or protein as defined herein, preferably encoding any one of SEQ ID NOs: 693-836, 1775-1986, 17090-17094 or fragments of variants thereof. It has to be understood that, on nucleic acid level, any nucleic acid sequence (e.g. DNA sequence, RNA sequence) which encodes an amino acid sequences being identical to SEQ ID NOs: 693-836, 1775-1986, 17090-17094 or fragments or variants thereof, or any nucleic acid sequence (e.g. DNA sequence, RNA sequence) which encodes amino acid sequences being at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs: 693-836, 1775-1986, 17090-17094 or a fragment or variant of any of these sequences, may be selected and may accordingly be understood as suitable coding sequence and may therefore be comprised in the artificial nucleic acid of the invention.

According to a preferred embodiment, the artificial nucleic acid, particularly the artificial RNA comprises or consists of at least one coding sequence encoding at least one Orthobunyavirus antigenic peptide or protein as defined herein. Preferably, the artificial nucleic acid comprises or consists of at least one coding sequence, wherein said at least one coding sequence comprises at least one of the nucleic acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to SEQ ID NOs: 3028-3171, 4110-4321, 5363-5506, 6055-6198, 6747-6890, 7439-7582, 8131-8274, 9213-9424, 10856-11067, 12499-12710, 14142-14353, 15785-15996, 17095-17199 and as defined in Columns D-H of Table 1, encoding a peptide or protein derived from an Orthobunyavirus or a fragment or variant of any of these sequences.

In embodiments, the at least one coding sequence encodes an Orthobunyavirus Glycoprotein or fragments or variants thereof. Preferably, the at least one coding sequence comprises at least one of the nucleic acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to SEQ ID NOs: 4110-4321, 9213-9424, 10856-11067, 12499-12710, 14142-14353, 15785-15996, 17097-17104, 17106-17109, 17111-17114, 17116-17119, 17121-17124, 17126-17129, 17132-17139, 17141-17144, 17146-17149, 17151-17154, 17156-17159, 17161-17164, 17167-17174, 17176-17179, 17181-17184, 17186-17189, 17191-17194, 17196-17199 and as defined in Columns D-H of Table 1, encoding Orthobunyavirus Glycoprotein or a fragment or variant of any of these sequences.

In embodiments, the at least one coding sequence encodes an Orthobunyavirus Nucleoprotein or fragments or variants thereof. Preferably, the at least one coding sequence comprises at least one of the nucleic acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to SEQ ID NOs: 3028-3171, 5363-5506, 6055-6198, 6747-6890, 7439-7582, 8131-8274, 17095, 17096, 17105, 17110, 17115, 17120, 17125, 17130, 17131, 17140, 17145, 17150, 17155, 17160, 17165, 17166, 17175, 17180, 17185, 17190, 17195 and as defined in Columns D-H of Table 1, encoding Orthobunyavirus Nucleoprotein or a fragment or variant of any of these sequences.

In specific embodiments, the at least one coding sequence comprises at least one nucleic acid sequence encoding an Orthobunyavirus antigenic peptide or protein, wherein the Orthobunyavirus is selected from BUNV, NRIV, BWAV, CEV, JCV, KEYV, LACV, or OROV.

According to the invention, the coding sequence encoding the at least one BUNV, NRIV, BWAV, CEV, JCV, KEYV, LACV, or OROV antigenic peptide or protein or fragment, variant or derivative thereof, may be selected from any nucleic acid sequence comprising a coding sequence encoding Glycoprotein (Gycoprotein precursor (GP), Glycoprotein N (Gn), Glycoprotein C (Gc), GP38, GP85, GP160, non-structural protein M (NSm)), RNA-dependent RNA polymerase (L), Nucleoprotein (N), non-structural protein S (NSs), or a fragment or variant of any of these.

In embodiments, the at least one coding sequence encoding the at least one BUNV, NRIV, BWAV, CEV, JCV, KEYV, LACV, or OROV antigenic peptide or protein comprises at least one of the nucleic acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to any one of the nucleic acid sequences according to the SEQ ID NOs as provided in Table 1, Column D-H, or a fragment or variant of any of these sequences.

In Table 1, nucleic acid sequences encoding the at least one BUNV (Table 1, Row 1 and 2), NRIV (Table 1, row 3 and 4), BWAV (Table 1, row 5 and 6), CEV (Table 1, row 7 and 8), JCV (Table 1, row 9 and 10), KEYV (Table 1, row 11 and 12), LACV (Table 1, row 13 and 14), or OROV (Table 1, row 15 and 16) antigenic peptide or protein are disclosed that are particularly suitable in the context of the invention. Each row of Table 1 corresponds to a suitable antigen in the context of the invention, wherein the virus (Column A, "Virus") and the respective peptide or protein (Column B, "Protein") are indicated. Columns D-H provide the nucleic acid SEQ ID NOs corresponding to nucleic acid sequences that encode the respective amino acid sequences as defined in Column C. The respective nucleic acid SEQ ID NOs are provided in the corresponding sequence listing of that application. Notably, any feature or additional information of the ST.25 sequence listing, particularly information under numeric identifier <223> relating to sequences provided in Table 1 is explicitly included herein and has to be understood as part of the disclosure of the present invention.

In embodiments, the at least one coding sequence encodes a Glycoprotein derived from BUNV (Table 1, Row 2), NRIV (Table 1, 4), BWAV (Table 1, row 6), CEV (Table 1, row 8), JCV (Table 1, row 10), KEYV (Table 1, row 12), LACV (Table 1, row 14), or OROV (Table 1, row 16). Accordingly, the at least one coding sequence comprises at least one of the nucleic acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to any one of the nucleic acid sequences according to the SEQ ID NOs corresponding to a Glycoprotein as provided in Table 1, Column D-H, or a fragment or variant of any of these sequences.

In embodiments, the at least one coding sequence encodes a Nucleoprotein derived from BUNV (Table 1, Row 1), NRIV (Table 1, row 3), BWAV (Table 1, row 5), CEV (Table 1, row 7), JCV (Table 1, row 9), KEYV (Table 1, row 11), LACV (Table 1, row 13), or OROV (Table 1, row 15). Accordingly, the at least one coding sequence comprises at least one of the nucleic acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to any one of the nucleic acid sequences according to the SEQ ID NOs corresponding to a Nucleoprotein as provided in Table 1, Column D-H, or a fragment or variant of any of these sequences.

Suitable Orthohantavirus Nucleic Acid Coding Sequences:

According to a preferred embodiment, the artificial nucleic acid, particularly the artificial RNA comprises at least one coding sequence encoding at least one antigenic peptide or protein as defined herein derived from at least one virus of the order Bunyavirales as defined herein, wherein the virus of the order Bunyavirales may be a virus of the genus Orthohantavirus, more preferably a virus selected from ANDV, BCCV, DOBV, HTNV, LANV, LQUV, NYV, PUUV, SANGV, SEOV, SNV, THAIV, or TULV. Accordingly, any coding sequence encoding at least one antigenic peptide or protein derived from at least one virus of the genus Orthohantavirus, preferably a virus selected from ANDV, BCCV, DOBV, HTNV, LANV, LQUV, NYV, PUUV, SANGV, SEOV, SNV, THAIV, or TULV or may be understood as suitable coding sequence and may therefore be comprised in the artificial nucleic acid of the invention.

In the context of the invention, the coding sequence encoding the at least one Orthohantavirus antigenic peptide or protein or fragment, variant or derivative thereof, may be selected from any nucleic acid sequence comprising a coding sequence encoding Glycoprotein (Glycoprotein precursor (GP), Glycoprotein N (Gn), Glycoprotein C (Gc), GP38, GP85, GP160, non-structural protein M (NSm)), RNA-dependent RNA polymerase (L), Nucleoprotein (N), non-structural protein S (NSs), or a fragment or variant of any of these, preferably derived from any virus of the genus Orthohantavirus, preferably a virus selected from ANDV, BCCV, DOBV, HTNV, LANV, LQUV, NYV, PUUV, SANGV, SEOV, SNV, THAIV, or TULV.

The artificial nucleic acid of the invention, particularly the artificial RNA according to the invention may comprise or consist of at least one coding sequence encoding at least one Orthohantavirus antigenic peptide or protein as defined herein, preferably encoding any one of SEQ ID NOs: 234-587, 926-1170, 16579-16581, 16645-1647, 16711-16713, 16777-16779 or fragments of variants thereof. It has to be understood that, on nucleic acid level, any nucleic acid sequence (e.g. DNA sequence, RNA sequence) which encodes an amino acid sequences being identical to SEQ ID NOs: 234-587, 926-1170, 16579-16581, 16645-16847, 16711-16713, 16777-16779 or fragments or variants thereof, or any nucleic acid sequence (e.g. DNA sequence, RNA sequence) which encodes amino acid sequences being at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs: 234-587, 926-1170, 16579-16581, 16645-16647, 16711-16713, 16777-16779 or fragments or variants thereof, may be selected and may accordingly be understood as suitable coding sequence and may therefore be comprised in the artificial nucleic acid of the invention.

According to a preferred embodiment, the artificial nucleic acid, particularly the artificial RNA comprises or consists of at least one coding sequence encoding at least one Orthohantavirus antigenic peptide or protein as defined herein. Preferably, the artificial nucleic acid comprises or consists of at least one coding sequence, wherein said at least one coding sequence comprises at least one of the nucleic acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to SEQ ID NOs: 2569-2922, 3261-3505, 4904-5257, 5596-5949, 6288-6641, 6980-7333, 7672-8025, 8364-8608, 10007-10251, 11650-11894, 13293-13537, 14936-15180, 16582-16644, 16648-16710, 16714-16776, 16800-16839 and as defined in Columns D-H of Table 2, encoding a peptide or protein derived from an Orthohantavirus or a fragment or variant of any of these sequences.

In embodiments, the at least one coding sequence encodes an Orthohantavirus Glycoprotein or fragments or variants thereof. Preferably, the at least one coding sequence comprises at least one of the nucleic acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to SEQ ID NOs: 3261-3505, 8364-8608, 10007-10251, 11650-11894, 13293-13537, 14936-15180, 16584, 16585, 16589, 16592, 16595, 16598, 16601, 16605, 16606, 16610, 16613, 16616, 16619, 16622, 16626, 16627, 16631, 16634, 16637, 16640, 16643, 16650, 16651, 16655, 16658, 16661, 16664, 16667, 16671, 16672, 16676, 16679, 16682, 16685, 16688, 16692, 16693, 16697, 16700, 16703, 16706, 16709, 16716, 16717, 16721, 16724, 16727, 16730, 16733, 16737, 16738, 16742, 16745, 16748, 16751, 16754, 16758, 16759, 16763, 16766, 16769, 16772, 16775, 16781, 16782, 16786, 16789, 16792, 16795, 16798, 16801, 16802, 16806, 16809, 16812, 16815, 16818, 16821, 16822, 16826, 16829, 16832, 16835, 16838 and as defined in Columns D-H of Table 2, encoding Orthohantavirus Glycoprotein or a fragment or variant of any of these sequences.

In embodiments, the at least one coding sequence encodes an Orthohantavirus Nucleoprotein or fragments or variants thereof. Preferably, the at least one coding sequence comprises at least one of the nucleic acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to SEQ ID NOs: 2569-2922, 4904-5257, 5596-5949, 6288-6641, 6980-7333, 7672-8025, 16675, 16678, 16681, 16684, 16687, 16690, 16691, 16696, 16699, 16702, 16705, 16708, 16714, 16715, 16720, 16723, 16726, 16729, 16732, 16735, 16736, 16741, 16744, 16747, 16750, 16753, 16756, 16757, 16762, 16765, 16768, 16771, 16774, 16780, 16785, 16788, 16791, 16794, 16797, 16800, 16805, 16808, 16811, 16814, 16817, 16820, 16825, 16828, 16831, 16834, 16837 and as defined in Columns D-H of Table 2, encoding Orthohantavirus Nucleoprotein or a fragment or variant of any of these sequences.

In specific embodiments, the at least one coding sequence comprises at least one nucleic acid sequence encoding an Orthohantavirus antigenic peptide or protein, wherein the Orthohantavirus is selected from ANDV, BCCV, DOBV, HTNV, LANV, LQUV, NYV. PUUV, SANGV, SEOV SNV, THAIV. TULV.

According to the invention, the coding sequence encoding the at least one ANDV, BCCV, DOBV, HTNV, LANV, LQUV, NYV, PUUV, SANGV, SEOV, SNV, THAIV, or TULV or antigenic peptide or protein or fragment, variant or derivative thereof, may be selected from any nucleic acid sequence comprising a coding sequence encoding Glycoprotein (Glycoprotein precursor (GP), Glycoprotein N (Gn), Glycoprotein C (Gc), GP38, GP85, GP160, non-structural protein M (NSm)), RNA-dependent RNA polymerase (L), Nucleoprotein (N), non-structural protein S (NSs), or a fragment or variant of any of these.

In embodiments, the at least one coding sequence encoding the at least one ANDV, BCCV, DOBV, HTNV, LANV, LQUV, NYV, PUUV, SANGV, SEOV, SNV, THAIV, or TULV or antigenic peptide or protein comprises at least one of the nucleic acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to any one of the nucleic acid sequences according to the SEQ ID NOs as provided in Table 2, Column D-H, or a fragment or variant of any of these sequences.

In Table 2, nucleic acid sequences encoding the at least one ANDV (Table 2, row 1 and 2), BCCV (Table 2, row 3 and 4), DOBV (Table 2, row 5 and 6), HTNV (Table 2, row 7 and 8), LANV (Table 2, row 9 and 10), LQUV (Table 2, row 11 and 12), NYV (Table 2, row 13 and 14), PUUV (Table 2, row 15 and 16), SANGV (Table 2, row 17 and 18), SEOV (Table 2, row 19 and 20), SNV (Table 2, row 21 and 22), THAIV (Table 2, row 23 and 24), or TULV (Table 2, row 25 and 26) antigenic peptide or protein are disclosed that are particularly suitable in the context of the invention. Each row of Table 2 corresponds to a suitable antigen in the context of the invention, wherein the virus (Column A, "Virus") and the respective peptide or protein (Column B, "Protein") are indicated. Columns D-H provide the nucleic acid SEQ ID NOs corresponding to nucleic acid sequences that encode the respective amino acid sequences as defined in Column C. The respective nucleic acid SEQ ID NOs are provided in the corresponding sequence listing of that application. Notably, any feature or additional information of the ST.25 sequence listing, particularly information under numeric identifier <223> relating to sequences provided in Table 2 is explicitly included herein and has to be understood as part of the disclosure of the present invention.

In embodiments, the at least one coding sequence encodes a Glycoprotein derived from ANDV (Table 2, row 2), BCCV (Table 2, row 4), DOBV (Table 2, row 6), HTNV (Table 2, row 8), LANV (Table 2, row 10), LQUV (Table 2, row 12), NYV (Table 2, row 14), PUUV (Table 2, row 16), SANGV (Table 2, row 18), SEOV (Table 2, row 20), SNV (Table 2, row 22), THAIV (Table 2, row 24), or TULV (Table 2, row 26). Accordingly, the at least one coding sequence comprises at least one of the nucleic acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to any one of the nucleic acid sequences according to the SEQ ID NOs corresponding to a Glycoprotein (as indicated in Column B) as provided in Table 2, Column D-H, or a fragment or variant of any of these sequences.

In embodiments, the at least one coding sequence encodes a Nucleoprotein derived from ANDV (Table 2, row 1), BCCV (Table 2, row 3), DOBV (Table 2, row 5), HTNV (Table 2, row 7), LANV (Table 2, row 9), LQUV (Table 2, row 11), NYV (Table 2, row 13), PUUV (Table 2, row 15), SANGV (Table 2, row 17), SEOV (Table 2, row 19), SNV (Table 2, row 21), THAIV (Table 2, row 24), or TULV (Table 2, row 26). Accordingly, the at least one coding sequence comprises at least one of the nucleic acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to any one of the nucleic acid sequences according to the SEQ ID NOs corresponding to a Nucleoprotein (as indicated in Column B) as provided in Table 2, Column D-H, or a fragment or variant of any of these sequences.

Suitable Phlebovirus Nucleic Acid Coding Sequences:

According to a preferred embodiment, the artificial nucleic acid, particularly the artificial RNA comprises at least one coding sequence encoding at least one antigenic peptide or protein as defined herein derived from at least one virus of the order Bunyavirales as defined herein, wherein the virus of the order Bunyavirales may be a virus of the genus Phlebovirus, more preferably a virus selected from HRTV, PTV, SFNV, TOSV, RVFV, or SFTSV, even more preferably RVFV or SFTSV. Accordingly, any coding sequence encoding at least one antigenic peptide or protein derived from at least one virus of the genus Phlebovirus, preferably a virus selected from HRTV, PTV, SFNV, TOSV, RVFV, or SFTSV, even more preferably RVFV or SFTSV may be understood as suitable coding sequence and may therefore be comprised in the artificial nucleic acid of the invention.

In the context of the invention, the coding sequence encoding the at least one Phlebovirus antigenic peptide or protein or fragment, variant or derivative thereof, may be selected from any nucleic acid sequence comprising a coding sequence encoding Glycoprotein (Glycoprotein precursor (GP), Glycoprotein N (Gn), Glycoprotein C (Gc), GP38, GP85, GP160, non-structural protein M (NSm)), RNA-dependent RNA polymerase (L), Nucleoprotein (N), non-structural protein S (NSs), or a fragment or variant of any of these, preferably derived from any virus of the genus Phlebovirus, preferably a virus selected from HRTV, PTV, SFNV, TOSV, RVFV, or SFTSV, even more preferably RVFV or SFTSV.

The artificial nucleic acid of the invention, particularly the artificial RNA according to the invention may comprise or consist of at least one coding sequence encoding at least one Phlebovirus antigenic peptide or protein as defined herein, preferably encoding any one of SEQ ID NOs: 837-925, 1987-2568, 17200-17208, 17425-17427 or fragments of variants thereof. It has to be understood that, on nucleic acid level, any nucleic acid sequence (e.g. DNA sequence, RNA sequence) which encodes an amino acid sequences being identical to SEQ ID NOs: 837-925, 1987-2568, 17200-17208, 17425-17427 or fragments or variants thereof, or any nucleic acid sequence (e.g. DNA sequence, RNA sequence) which encodes amino acid sequences being at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs: 837-925, 1987-2568, 17200-17208, 17425-17427 or fragments or variants thereof, may be selected and may accordingly be understood as suitable coding sequence and may therefore be comprised in the artificial nucleic acid of the invention.

According to a preferred embodiment, the artificial nucleic acid, particularly the artificial RNA comprises or consists of at least one coding sequence encoding at least one Phlebovirus antigenic peptide or protein as defined herein. Preferably, the artificial nucleic acid comprises or consists of at least one coding sequence, wherein said at least one coding sequence comprises at least one of the nucleic acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to SEQ ID NOs: 3172-3260, 4322-4903, 5507-5595, 6199-6287, 6891-6979, 7583-7671, 8275-8363, 9425-10006, 11068-11649, 12711-13292, 14354-14935, 15997-16578, 17209-17424, 17428-17487 and as defined in Columns D-H of Table 3, encoding a peptide or protein derived from an Phlebovirus or a fragment or variant of any of these sequences.

In embodiments, the at least one coding sequence encodes a Phlebovirus Glycoprotein or fragments or variants thereof. Preferably, the at least one coding sequence comprises at least one of the nucleic acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to SEQ ID NOs: 4322-4903, 9425-10006, 11068-11649, 12711-13292, 14354-14935, 15997-16578, 17211-17226, 17228-17235, 17237-17244, 17246-17253, 17255-17262, 17264-17271, 17273-17280, 17283-17298, 17300-17307, 17309-17316, 17318-17325, 17327-17334, 17336-17343, 17345-17352, 17355-17370, 17372-17379, 17381-17388, 17390-17397, 17399-17406, 17408-17415, 17417-17424, 17429-17432, 17434, 17435, 17437, 17438, 17440, 17441, 17443, 17444, 17446, 17447, 17449, 17450, 17451, 17452, 17454, 17455, 17457, 17458, 17460, 17461, 17463, 17464, 17466, 17467, 17469, 17470, 17471, 17472, 17474, 17475, 17477, 17478, 17480, 17481, 17483, 17484, 17486, 17487 and as defined in Columns D-H of Table 3, encoding Phlebovirus Glycoprotein or a fragment or variant of any of these sequences.

In embodiments, the at least one coding sequence encodes a Phlebovirus Nucleoprotein or fragments or variants thereof. Preferably, the at least one coding sequence comprises at least one of the nucleic acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to SEQ ID NOs: 3172-3260, 5507-5595, 61994287, 6891-6979, 7583-7671, 8275-8363, 17209, 17210, 17227, 17236, 17245, 17254, 17263, 17272, 17281, 17282, 17299, 17308, 17317, 17326, 17335, 17344, 17353, 17354, 17371, 17380, 17389, 17398, 17407, 17416, 17428, 17433, 17436, 17439, 17442, 17445, 17448, 17453, 17456, 17459, 17462, 17465, 17468, 17473, 17476, 17479, 17482, 17485 and as defined in Columns D-H of Table 3, encoding Phlebovirus Nucleoprotein or a fragment or variant of any of these sequences.

In specific embodiments, the at least one coding sequence comprises at least one nucleic acid sequence encoding a Phlebovirus antigenic peptide or protein, wherein the Phlebovirus is selected from HRTV, PTV, SFNV, TOSV, RVFV, or SFTSV, wherein RVFV and SFTSV are preferred.

According to the invention, the coding sequence encoding the at least one HRTV, PTV, SFNV, TOSV, RVFV or SFTSV antigenic peptide or protein or fragment, variant or derivative thereof, may be selected from any nucleic acid sequence comprising a coding sequence encoding Glycoprotein (Glycoprotein precursor (GP), Glycoprotein N (Gn), Glycoprotein C (Gc), GP38, GP85, GP160, non-structural protein M (NSm)), RNA-dependent RNA polymerase (L), Nucleoprotein (N), non-structural protein S (NSs), or a fragment or variant of any of these.

In embodiments, the at least one coding sequence encoding the at least one HRTV, PTV, SFNV, TOSV, RVFV, or SFTSV antigenic peptide or protein comprises at least one of the nucleic acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to any one of the nucleic acid sequences according to the SEQ ID NOs as provided in Table 3, Column D-H, or a fragment or variant of any of these sequences.

In Table 3, nucleic acid sequences encoding the at least one HRTV (Table 3, row 1 and 2), PTV (Table 3, row 3 and 4), SFNV (Table 3, row 5 and 6), TOSV (Table 3, row 7 and 8), RVFV (Table 3, rows 9 to 14), or SFTSV (Table 3, row 15 and 16) antigenic peptide or protein are disclosed that are particularly suitable in the context of the invention. Each row of Table 3 corresponds to a suitable antigen in the context of the invention, wherein the virus (Column A, "Virus") and the respective peptide or protein (Column B, "Protein") are indicated. Columns D-H provide the nucleic acid SEQ ID NOs corresponding to nucleic acid sequences that encode the respective amino acid sequences as defined in Column C. The respective nucleic acid SEQ ID NOs are provided in the corresponding sequence listing of that application. Notably, any feature or additional information of the ST.25 sequence listing, particularly information under numeric identifier <223> relating to sequences provided in Table 3 is explicitly included herein and has to be understood as part of the disclosure of the present invention.

In embodiments, the at least one coding sequence encodes a Glycoprotein derived from HRTV (Table 3, row 2), PTV (Table 3, row 4), SFNV (Table 3, row 6), TOSV (Table 3, row 8), RVFV (Table 3, rows 10 to 14), or SFTSV (Table 3, row 16). Accordingly, the at least one coding sequence comprises at least one of the nucleic acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to any one of the nucleic acid sequences according to the SEQ ID NOs corresponding to Glycoprotein GP, Gn, Gc (as indicated in Column B) as provided in Table 3, Column D-H, or a fragment or variant of any of these sequences.

In embodiments, the at least one coding sequence encodes a Nucleoprotein derived from HRTV (Table 3, row 1), PTV (Table 3, row 3), SFNV (Table 3, row 5). TOSV (Table 3, row 7), RVFV (Table 3, rows 9), or SFTSV (Table 3, row 15). Accordingly, the at least one coding sequence comprises at least one of the nucleic acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to any one of the nucleic acid sequences according to the SEQ ID NOs corresponding to Nucleoprotein (as indicated in Column B) as provided in Table 3, Column D-H, or a fragment or variant of any of these sequences.

Suitable RVFV Nucleic Acid Coding Sequences:

In preferred embodiments, the coding sequence encoding the at least one antigenic peptide or protein or fragment, variant or derivative thereof, may be selected from any nucleic acid sequence comprising a coding sequence encoding Glycoprotein (Glycoprotein precursor (GP), Glycoprotein N (Gn), Glycoprotein C (Gc), GP38, GP85, GP160, non-structural protein M (NSm)), RNA-dependent RNA polymerase (L), Nucleoprotein (N), non-structural protein S (NSs), or a fragment or variant of any of these derived from RVFV.

In preferred embodiments, the artificial nucleic acid of the invention, particularly the artificial RNA may comprise or consist of at least one coding sequence encoding at least one RVFV antigenic peptide or protein as defined herein, preferably encoding any one of SEQ ID NOs: 853-854, 2009-2319, 17200-17208 or fragments of variants thereof. It has to be understood that, on nucleic acid level, any nucleic acid sequence (e.g. DNA sequence, RNA sequence) which encodes an amino acid sequences being identical to SEQ ID NOs: 853-854, 2009-2319, 17200-17208 or fragments or variants thereof, or any nucleic acid sequence (e.g. DNA sequence, RNA sequence) which encodes amino acid sequences being at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs: 853-854, 2009-2319, 17200-17208 or fragments or variants thereof, may be selected and may accordingly be understood as suitable coding sequence and may therefore be comprised in the artificial nucleic acid of the invention.

According to a preferred embodiment, the artificial nucleic acid, particularly the artificial RNA comprises or consists of at least one coding sequence encoding at least one RVFV antigenic peptide or protein as defined herein. Preferably, the artificial nucleic acid comprises or consists of at least one coding sequence, wherein said at least one coding sequence comprises at least one of the nucleic acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to SEQ ID NOs: 3188-3189, 4344-4654, 5523-5524, 9447-9757, 6215-6216, 11090-11400, 6907-6908, 12733-13043, 7599-7600, 8291-8292, 14376-14686, 16019-16329, 17209-17424 and as defined in Columns D-H, rows 9-14 of Table 3, encoding a peptide or protein derived from an RVFV or a fragment or variant of any of these sequences.

In preferred embodiments, the at least one coding sequence encodes a RVFV Glycoprotein or fragments or variants thereof. Preferably, the at least one coding sequence comprises at least one of the nucleic acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to SEQ ID NOs: 4344-4654, 9447-9757, 11090-11400, 12733-13043, 14376-14686, 16019-16329, 17211-17226, 17228-17235, 17237-17244, 17246-17253, 17255-17262, 17264-17271, 17273-17280, 17283-17298, 17300-17307, 17309-17316, 17318-17325, 17327-17334, 17336-17343, 17345-17352, 17355-17370, 17372-17379, 17381-17388, 17390-17397, 17399-17406, 17408-17415, 17417-17424 and as defined in Columns D-H, rows 10-14 of Table 3, encoding RVFV Glycoprotein or a fragment or variant of any of these sequences.

In specific embodiments, the at least one coding sequence comprises at least one of the nucleic acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to SEQ ID NOs: 4344-4419, 9447-9522, 11090-11165, 12733-12808, 14376-14451, 16019-16094, 17211, 17212, 17228, 17237, 17246, 17255, 17264, 17273, 17283, 17284, 17300, 17309, 17318, 17327, 17336, 17345, 17355, 17356, 17372, 17381, 17390, 17399, 17408, 17417 and as defined in Columns D-H row 10 of Table 3, encoding RVFV GP or a fragment or variant of any of these sequences.

In specific embodiments, the at least one coding sequence comprises at least one of the nucleic acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to SEQ ID NOs: 4562-4615, 9665-9718, 11308-11361, 12951-13004, 14594-14647, 16237-16290, 17221-17224, 17233, 17234, 17242, 17243, 17251, 17252, 17260, 17261, 17269, 17270, 17278, 17279, 17293-17296, 17305, 17306, 17314, 17315, 17323, 17324, 17332, 17333, 17341, 17342, 17350, 17351, 17365-17368, 17377, 17378, 17386, 17387, 17395, 17396, 17404, 17405, 17413, 17414, 17422, 17423 and as defined in Columns D-H row 13 of Table 3, encoding RVFV Gn or a fragment or variant of any of these sequences.

In specific embodiments, the at least one coding sequence comprises at least one of the nucleic acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to SEQ ID NOs: 4616-4654, 9719-9757, 11362-11400, 13005-13043, 14648-14686, 16291-16329, 17225, 17226, 17235, 17244, 17253, 17262, 17271, 17280, 17297, 17298, 17307, 17316, 17325, 17334, 17343, 17352, 17369, 17370, 17379, 17388, 17397, 17406, 17415, 17424 and as defined in Columns D-H row 14 of Table 3, encoding RVFV Gc or a fragment or variant of any of these sequences.

In specific embodiments, the at least one coding sequence comprises at least one of the nucleic acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to SEQ ID NOs: 44944561, 9597-9664, 11240-11307. 12883-12950, 14526-14593, 16169-16236, 17213-17220, 17229-17232, 17238-17241, 17247-17250, 17256-17259, 17265-17268, 17274-17277, 17285-17292, 17301-17304, 17310-17313, 17319-17322, 17328-17331, 17337-17340, 17346-17349, 17357-17364, 17373-17376, 17382-17385, 17391-17394, 17400-17403, 17402, 17409-17412, 17418-17421, 17431, 17432, 17435, 17438, 17441, 17444, 17447, 17451, 17452, 17455, 17458, 17461, 17464, 17467, 17471, 17472, 17475, 17478, 17481, 17484, 17487 and as defined in Columns D-H row 12 of Table 3, encoding RVFV Gn and RVFV Gc or a fragment or variant of any of these sequences.

In specific embodiments, the at least one coding sequence comprises at least one of the nucleic acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to SEQ ID NOs: 4420-4493, 9523-9596, 11166-11239, 12809-12882, 14452-14525, 16095-16168 and as defined in Columns D-H row 11 of Table 3, encoding RVFV NSm, RVFV Gn and RVFV Gc or a fragment or variant of any of these sequences.

In preferred embodiments, the at least one coding sequence encodes a RVFV Nucleoprotein or fragments or variants thereof. Preferably, the at least one coding sequence comprises at least one of the nucleic acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to SEQ ID NOs: 3188-3189, 5523-5524, 6215-6216, 6907-6908, 7599-7600, 8291-8292, 17209, 17210, 17227, 17238, 17245, 17254, 17263, 17272, 17281, 17282, 17299, 17308, 17317, 17326, 17335, 17344, 17353, 17354, 17371, 17380, 17389, 17398, 17407, 17416, 17428, 17433, 17436, 17439, 17442, 17445, 17448, 17453, 17456, 17459, 17462, 17465, 17468, 17473, 17476, 17479, 17482, 17485 and as defined in Columns D-H row 10 of Table 3, encoding RVFV Nucleoprotein or a fragment or variant of any of these sequences.

Suitable SFTSV Nucleic Acid Coding Sequences:

In preferred embodiments, the coding sequence encoding the at least one antigenic peptide or protein or fragment, variant or derivative thereof, may be selected from any nucleic acid sequence comprising a coding sequence encoding Glycoprotein (Glycoprotein precursor (GP), Glycoprotein N (Gn), Glycoprotein C (Gc), GP38, GP85, GP160, non-structural protein M (NSm)), RNA-dependent RNA polymerase (L), Nucleoprotein (N), non-structural protein S (NSs), or a fragment or variant of any of these derived from SFTSV.

In preferred embodiments, the artificial nucleic acid of the invention, particularly the artificial RNA of the invention may comprise or consist of at least one coding sequence encoding at least one SFTSV antigenic peptide or protein as defined herein, preferably encoding any one of SEQ ID NOs: 877-925, 2357-2568, 17425-17427 or fragments of variants thereof. It has to be understood that, on nucleic acid level, any nucleic acid sequence (e.g. DNA sequence, RNA sequence) which encodes an amino acid sequences being identical to SEQ ID NOs: 877-925, 2357-2568, 17425-17427 or fragments or variants thereof, or any nucleic acid sequence (e.g. DNA sequence, RNA sequence) which encodes amino acid sequences being at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs: 877-925, 2357-2568, 17425-17427 or fragments or variants thereof, may be selected and may accordingly be understood as suitable coding sequence and may therefore be comprised in the artificial nucleic acid of the invention.

According to a preferred embodiment, the artificial nucleic acid, particularly the artificial RNA comprises or consists of at least one coding sequence encoding at least one SFTSV antigenic peptide or protein as defined herein. Preferably, the artificial nucleic acid comprises or consists of at least one coding sequence, wherein said at least one coding sequence comprises at least one of the nucleic acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to SEQ ID NOs: 3212-3260, 4692-4903, 5547-5595, 9795-10006, 6239-6287, 11438-11649, 6931-6979, 13081-13292, 7623-7671, 8315-8363, 14724-14935, 16367-16578, 17428-17487 and as defined in Columns D-H rows 15 and 16 of Table 3, encoding a peptide or protein derived from an SFTSV or a fragment or variant of any of these sequences.

In preferred embodiments, the at least one coding sequence encodes a SFTSV Glycoprotein or fragments or variants thereof. Preferably, the at least one coding sequence comprises at least one of the nucleic acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to SEQ ID NOs: 4692-4903, 9795-10006, 11438-11649, 13081-13292, 14724-14935, 16367-16578, 17429-17432, 17434, 17435, 17437, 17438, 17440, 17441, 17443, 17444, 17446, 17447, 17449-17452, 17454, 17455, 17457, 17458, 17460, 17461, 17463, 17464, 17466, 17467, 17469-17472, 17474, 17475, 17477, 17478, 17480, 17481, 17483, 17484, 17486, 17487 and as defined in Columns D-H rows 16 of Table 3, encoding SFTSV Glycoprotein or a fragment or variant of any of these sequences.

In preferred embodiments, the at least one coding sequence encodes a SFTSV Nucleoprotein or fragments or variants thereof. Preferably, the at least one coding sequence comprises at least one of the nucleic acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to SEQ ID NOs: 3212-3260, 5547-5595, 6239-6287, 6931-6979, 7623-7671, 8315-8363, 17428, 17433, 17436, 17439, 17442, 17445, 17448, 17453, 17456, 17459, 17462, 17465, 17468, 17473, 17476, 17479, 17482, 17485 and as defined in Columns D-H rows 15 of Table 3, encoding SFTSV Nucleoprotein or a fragment or variant of any of these sequences.

Suitable Orthonairovirus Nucleic Acid Coding Sequences:

According to a preferred embodiment, the artificial nucleic acid, particularly the artificial RNA comprises at least one coding sequence encoding at least one antigenic peptide or protein as defined herein derived from at least one virus of the order Bunyavirales as defined herein, wherein the virus of the order Bunyavirales may be a virus of the genus Orthonairovirus, more preferably a virus selected from NSDV, DUGV, or CCHFV, even more preferably CCHFV. Accordingly, any coding sequence encoding at least one antigenic peptide or protein derived from at least one virus of the genus Orthonairovirus, preferably a virus selected from NSDV DUGV, or CCHFV, even more preferably CCHFV may be understood as suitable coding sequence and may therefore be comprised in the artificial nucleic acid of the invention.

In the context of the invention, the coding sequence encoding the at least one Orthonairovirus antigenic peptide or protein or fragment, variant or derivative thereof, may be selected from any nucleic acid sequence comprising a coding sequence encoding Glycoprotein (Gycoprotein precursor (GP), Glycoprotein N (Gn), Glycoprotein C (Gc), GP38, GP85, GP160, non-structural protein M (NSm)), RNA-dependent RNA polymerase (L), Nucleoprotein (N), non-structural protein S (NSs), or a fragment or variant of any of these, preferably derived from any virus of the genus Orthonairovirus, preferably a virus selected from NSDV, DUGV, or CCHFV, even more preferably CCHFV.

The artificial nucleic acid of the invention, particularly the artificial RNA of the invention may comprise or consist of at least one coding sequence encoding at least one Orthonairovirus antigenic peptide or protein as defined herein, preferably encoding any one of SEQ ID NOs: 588-692, 1171-1774, 16840-16849 or fragments of variants thereof. It has to be understood that, on nucleic acid level, any nucleic acid sequence (e.g. DNA sequence, RNA sequence) which encodes an amino acid sequences being identical to SEQ ID NOs: 588-692, 1171-1774, 16840-16849 or fragments or variants thereof, or any nucleic acid sequence (e.g. DNA sequence, RNA sequence) which encodes amino acid sequences being at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs: 588-692, 1171-1774, 16840-16849 or fragments or variants thereof, may be selected and may accordingly be understood as suitable coding sequence and may therefore be comprised in the artificial nucleic acid of the invention.

According to a preferred embodiment, the artificial nucleic acid, particularly the artificial RNA comprises or consists of at least one coding sequence encoding at least one Orthonairovirus antigenic peptide or protein as defined herein. Preferably, the artificial nucleic acid comprises or consists of at least one coding sequence, wherein said at least one coding sequence comprises at least one of the nucleic acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to SEQ ID NOs: 2923-3027, 3506-4109, 5258-5362, 5950-6054, 6642-6746, 7334-7438, 8026-8130, 8609-9212, 10252-10855, 11895-12498, 13538-14141, 15181-15784, 16850-17089 and as defined in Columns D-H of Table 4, encoding a peptide or protein derived from an Orthonairovirus or a fragment or variant of any of these sequences.

In embodiments, the at least one coding sequence encodes an Orthonairovirus Glycoprotein or fragments or variants thereof. Preferably, the at least one coding sequence comprises at least one of the nucleic acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to SEQ ID NOs: 3506-4109, 8609-9212, 10252-10855, 11895-12498, 13538-14141, 15181-15784, 16854-16869, 16872-16879, 16882-16889, 16892-16899, 16902-16909, 16912-16919, 16922-16929, 16934-16949, 16952-16959, 16962-16969, 16972-16979, 16982-16989, 16992-16999, 17002-17009, 17014-17029, 17032-17039, 17042-17049, 17052-17059, 17062-17069, 17072-17079, 17082-17089 and as defined in Columns D-H of Table 4, encoding Orthonairovirus Glycoprotein or a fragment or variant of any of these sequences.

In embodiments, the at least one coding sequence encodes an Orthonairovirus Nucleoprotein or fragments or variants thereof. Preferably, the at least one coding sequence comprises at least one of the nucleic acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to SEQ ID NOs: 2923-3027, 5258-5362, 5950-6054, 6642-6746, 7334-7438, 8026-8130, 16850-16853, 16870, 16871, 16880, 16881, 16890, 16891, 16900, 16901, 16910, 16911, 16920, 16921, 16930-16933, 16950, 16951, 16960, 16961, 16970, 16971, 16980, 16981, 16990, 16991, 17000, 17001, 17010-17013, 17030, 17031, 17040, 17041, 17050, 17051, 17060, 17061, 17070, 17071, 17080, 17081 and as defined in Columns D-H of Table 4, encoding Orthonairovirus Nucleoprotein or a fragment or variant of any of these sequences.

In specific embodiments, the at least one coding sequence comprises at least one nucleic acid sequence encoding a Orthonairovirus antigenic peptide or protein, wherein the Phlebovirus is selected from NSDV, DUGV, or CCHFV, wherein CCHFV is preferred.

According to the invention, the coding sequence encoding the at least NSDV, DUGV, or CCHFV antigenic peptide or protein or fragment, variant or derivative thereof, may be selected from any nucleic acid sequence comprising a coding sequence encoding Glycoprotein (Gycoprotein precursor (GP), Glycoprotein N (Gn), Glycoprotein C (Gc), GP38, GP85, GP160, non-structural protein M (NSm)), RNA-dependent RNA polymerase (L), Nucleoprotein (N), non-structural protein S (NSs), or a fragment or variant of any of these.

In embodiments, the at least one coding sequence encoding the at least one NSDV, DUGV, or CCHFV antigenic peptide or protein comprises at least one of the nucleic acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to any one of the nucleic acid sequences according to the SEQ ID NOs as provided in Table 4, Column D-H, or a fragment or variant of any of these sequences.

In Table 4, nucleic acid sequences encoding the at least one NSDV (Table 4, row 1 and 2), DUGV (Table 4, row 3 and 4), or CCHFV (Table 4, rows 5 to 10) antigenic peptide or protein are disclosed that are particularly suitable in the context of the invention. Each row of Table 4 corresponds to a suitable antigen in the context of the invention, wherein the virus (Column A, "Virus") and the respective peptide or protein (Column B, "Protein") are indicated. Columns D-H provide the nucleic acid SEQ ID NOs corresponding to nucleic acid sequences that encode the respective amino acid sequences as defined in Column C. The respective nucleic acid SEQ ID NOs are provided in the corresponding sequence listing of that application. Notably, any feature or additional information of the ST.25 sequence listing, particularly information under numeric identifier <223> relating to sequences provided in Table 4 is explicitly included herein and has to be understood as part of the disclosure of the present invention.

In embodiments, the at least one coding sequence encodes a Glycoprotein derived from NSDV (Table 4, row 2), DUGV (Table 4, row 4), or CCHFV (Table 4, rows 6 to 10). Accordingly, the at least one coding sequence comprises at least one of the nucleic acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to any one of the nucleic acid sequences according to the SEQ ID NOs corresponding to Glycoprotein GP, Gn, Gc (as indicated in Column B) as provided in Table 4, Column D-H, or a fragment or variant of any of these sequences.

In embodiments, the at least one coding sequence encodes a Nucleoprotein derived from NSDV (Table 4, row 1), DUGV (Table 4, row 3), or CCHFV (Table 4, rows 5). Accordingly, the at least one coding sequence comprises at least one of the nucleic acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to any one of the nucleic acid sequences according to the SEQ ID NOs corresponding to Nucleoprotein (as indicated in Column B) as provided in Table 4, Column D-H, or a fragment or variant of any of these sequences.

CCHFV Nucleic Acids:

In preferred embodiments, the coding sequence encoding the at least one antigenic peptide or protein or fragment, variant or derivative thereof, may be selected from any nucleic acid sequence comprising a coding sequence encoding Glycoprotein (Glycoprotein precursor (GP), Glycoprotein N (Gn), Glycoprotein C (Gc), GP38, GP85, GP160, non-structural protein M (NSm)), RNA-dependent RNA polymerase (L), Nucleoprotein (N), non-structural protein S (NSs), or a fragment or variant of any of these derived from CCHFV.

In preferred embodiments, the artificial nucleic acid of the invention may comprise or consist of at least one coding sequence encoding at least one CCHFV antigenic peptide or protein as defined herein, preferably encoding any one of SEQ ID NOs: 588-677, 1171-1769, 16840-16849 or fragments of variants thereof. It has to be understood that, on nucleic acid level, any nucleic acid sequence (e.g. DNA sequence, RNA sequence) which encodes an amino acid sequences being identical to SEQ ID NOs: 588-677, 1171-1769, 16840-16849 or fragments or variants thereof, or any nucleic acid sequence (e.g. DNA sequence, RNA sequence) which encodes amino acid sequences being at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs: 588-677, 1171-1769, 16840-16849 or fragments or variants thereof, may be selected and may accordingly be understood as suitable coding sequence and may therefore be comprised in the artificial nucleic acid of the invention.

According to a preferred embodiment, the artificial nucleic acid comprises or consists of at least one coding sequence encoding at least one CCHFV antigenic peptide or protein as defined herein. Preferably, the artificial nucleic acid comprises or consists of at least one coding sequence, wherein said at least one coding sequence comprises at least one of the nucleic acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to SEQ ID NOs: 2923-3012, 3506-4104, 5258-5347, 8609-9207, 5950-6039, 10252-10850, 6642-6731, 11895-12493, 7334-7423, 8026-8115, 13538-14136, 15181-15779, 16850-17089 and as defined in Columns D-H rows 5-10 of Table 4, encoding a peptide or protein derived from an CCHFV or a fragment or variant of any of these sequences.

In preferred embodiments, the at least one coding sequence encodes a CCHFV Glycoprotein or fragments or variants thereof. Preferably, the at least one coding sequence comprises at least one of the nucleic acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to SEQ ID NOs: 3506-4104, 8609-9207, 10252-10850, 11895-12493, 13538-14136.15181-15779, 16854-16869, 16872-16879, 16882-16889, 16892-16899, 16902-16909, 16912-16919, 16922-16929, 16934-16949, 16952-16959, 16962-16969, 16972-16979, 16982-16989, 16992-16999, 17002-17009, 17014-17029, 17032-17039, 17042-17049, 17052-17059, 17062-17069, 17072-17079, 17082-17089 and as defined in Columns D-H rows 6-10 of Table 4, encoding CCHFV Glycoprotein or a fragment or variant of any of these sequences.

In specific embodiments, the at least one coding sequence comprises at least one of the nucleic acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to SEQ ID NOs: 3506-3688, 8609-8791, 10252-10434, 11895-12077, 13538-13720, 15181-15363, 16854-16859, 16872-16874, 16882-16884, 16892-16894, 16902-16904, 16912-16914, 16922-16924, 16934-16939, 16952-16954, 16962-16964, 16972-16974, 16982-16984, 16992-16994, 17002-17004, 17014-17019, 17032-17034, 17042-17044, 17052-17054, 17062-17064, 17072-17074, 17082-17084 and as defined in Columns D-H row 6 of Table 4, encoding CCHFV GP or a fragment or variant of any of these sequences.

In specific embodiments, the at least one coding sequence comprises at least one of the nucleic acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to SEQ ID NOs: 3912-3997, 9015-9100, 10658-10743, 12301-12386, 13944-14029, 15587-15672, 16866, 16867, 16878, 16888, 16898, 16908, 16918, 16928, 16946, 16947, 16958, 16968, 16978, 16988, 16998, 17008, 17026, 17027, 17038, 17048, 17058, 17068, 17078. 17088 and as defined in Columns D-H row 9 of Table 4, encoding CCHFV Gn or a fragment or variant of any of these sequences.

In specific embodiments, the at least one coding sequence comprises at least one of the nucleic acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to SEQ ID NOs: 3998-4104, 9101-9207, 10744-10850, 12387-12493, 14030-14136, 15673-15779, 16868, 16869, 16879, 16889, 16899, 16909, 16919, 16929, 16948, 16949, 16959, 16969, 16979, 16989, 16999, 17009, 17028, 17029, 17039, 17049, 17059, 17069, 17079, 17089 and as defined in Columns D-H row 10 of Table 4, encoding CCHFV Gc or a fragment or variant of any of these sequences.

In specific embodiments, the at least one coding sequence comprises at least one of the nucleic acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to SEQ ID NOs: 3805-3911, 8908-9014, 10551-10657, 12194-12300, 13837-13943, 15480-15586, 16864, 16865, 16877, 16887, 16897, 16907, 16917, 16927, 16944, 16945, 16957, 16967, 16977, 16987, 16997, 17007, 17024, 17025, 17037, 17047, 17057, 17067, 17077, 17087 and as defined in Columns D-H row 8 of Table 4, encoding CCHFV Gn and CCHFV Gc or a fragment or variant of any of these sequences.

In specific embodiments, the at least one coding sequence comprises at least one of the nucleic acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to SEQ ID NOs: 3689-3804, 8792-8907, 10435-10550, 12078-12193, 13721-13836, 15364-15479, 16860-16863, 16875, 16876, 16885, 16886, 16895, 16896, 16905, 16906, 16915, 16916, 16925, 16926, 16940-16943, 16955, 16956, 16965, 16966, 16975, 16976, 16985, 16986, 16995, 16996, 17005, 17006, 17020-17023, 17035, 17036, 17045, 17046, 17055, 17056, 17065, 17066, 17075, 17076, 17085, 17086 and as defined in Columns D-H row 7 of Table 4, encoding CCHFV NSm, CCHFV Gn and CCHFV Gc or a fragment or variant of any of these sequences.

In preferred embodiments, the at least one coding sequence encodes a CCHFV Nucleoprotein or fragments or variants thereof. Preferably, the at least one coding sequence comprises at least one of the nucleic acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to SEQ ID NOs: 2923-3012, 5258-5347, 5950-6039, 6642-6731, 7334-7423, 8026-8115, 16850-16853, 16870, 16871, 16880, 16881, 16890, 16891, 16900, 16901, 16910, 16911, 16920, 16921, 16930-16933, 16950, 16951, 16960, 16961, 16970, 16971, 16980, 16981, 16990, 16991, 17000, 17001, 17010-17013, 17030, 17031, 17040, 17041, 17050, 17051, 17060, 17061, 17070, 17071, 17080, 17081 and as defined in Columns D-H row 5 of Table 4, encoding CCHFV Nucleoprotein or a fragment or variant of any of these sequences.

Nucleic Acid Sequences of Additional Peptide or Protein Elements:

In embodiments, the coding sequence encoding the at least one antigenic peptide or protein or fragment, variant or derivative thereof, may additionally comprise a nucleic acid sequence comprising a coding sequence encoding at least one further peptide or protein element selected from a secretory signal peptide, a transmembrane domain, a VLP forming domain, a peptide linker, a self-cleaving peptide, an immunologic adjuvant sequence, and/or a dendritic cell targeting sequence as defined herein.

In preferred embodiments, the artificial nucleic acid of the invention, particularly the artificial RNA may comprise at least one additional coding sequence encoding at least one secretory signal peptide as defined herein, preferably encoding any one of SEQ ID NO: 38-65 or fragments of variants thereof. It has to be understood that, on nucleic acid level, any nucleic acid sequence (e.g. DNA sequence, RNA sequence) which encodes an amino acid sequences being identical to SEQ ID NO: 38-65 or fragments or variants thereof, or any nucleic acid sequence (e.g. DNA sequence, RNA sequence) which encodes amino acid sequences being at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NO: 38-65 or fragments or variants thereof, may be selected and may accordingly be understood as suitable coding sequence and may therefore be comprised in the artificial nucleic acid of the invention.

In a preferred embodiment, the artificial nucleic acid of the invention, particularly the artificial RNA of the invention comprises at least one additional coding sequence wherein the at least one additional coding sequence comprises at least one of the nucleic acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to SEQ ID NOs: 66-233 encoding a secretory signal peptide or a fragment or variant of any of these sequences.

In a particularly preferred embodiment, the artificial nucleic acid of the invention, particularly the artificial RNA of the invention comprises at least one additional coding sequence wherein the at least one additional coding sequence comprises at least one of the nucleic acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to SEQ ID NOs: 66-67, 94-95, 122-123, 150-151, 178-179, 206-207 encoding a secretory signal peptide or a fragment or variant of any of these sequences.

Mono-, Bi- and Multicistronic and Multi-Antigen Nucleic Acids

In embodiments, the artificial nucleic acid of the invention, particularly the artificial RNA of the invention is monocistronic, bicistronic, or multicistronic.

In preferred embodiments, the artificial nucleic acid, particularly the artificial RNA of the invention is monocistronic.

The term "monocistronic nucleic acid" will be recognized and understood by the person of ordinary skill in the art, and is for example intended to refer to a nucleic acid, e.g. DNA or an RNA, particularly an RNA, that comprises only one coding sequences as defined herein. The terms "bicistronic nucleic acid, multicistronic nucleic acid" as used herein will be recognized and understood by the person of ordinary skill in the art, and are for example intended to refer to a nucleic acid, e.g. an RNA or DNA, preferably an mRNA, that typically may have two (bicistronic) or more (multicistronic) coding sequences.

In embodiments, the artificial nucleic acid, particularly the artificial RNA of the invention is monocistronic and the coding sequence of said monocistronic artificial nucleic encodes at least two different antigenic peptides or proteins derived from a virus of the order Bunyavirales as defined herein, or a fragment or variant thereof.

Accordingly, the at least one coding sequence of the monocistronic artificial nucleic acid, particularly the artificial RNA according to the invention may encode at least two, three, four, five, six, seven, eight and more antigenic peptides or proteins derived from a virus of the order Bunyavirales as defined herein linked with or without an amino acid linker sequence, wherein said linker sequence can comprise rigid linkers, flexible linkers, cleavable linkers (e.g. self-cleaving peptides) as defined above, or a combination thereof (herein referred to as "multi-antigen-constructs/nucleic acid").

In embodiments, the artificial nucleic acid, particularly the artificial RNA of the invention is bicistronic or multicistronic and comprises at least two coding sequences, wherein the at least two coding sequences encode two or more different antigenic peptides or proteins derived from a virus of the order Bunyavirales as defined herein, or a fragment or variant of any of these Accordingly, the coding sequences in a bicistronic or multicistronic artificial nucleic acid, particularly the artificial RNA of the invention suitably encode distinct antigenic proteins or peptides as defined herein or a fragment or variant thereof. Preferably, the coding sequences in said bicistronic or multicistronic artificial nucleic acid may be separated by at least one IRES (internal ribosomal entry site) sequence, as defined below. Thus, the term "encoding two or more antigenic peptides or proteins" may mean, without being limited thereto, that the bicistronic or multicistronic artificial nucleic acid may encode e.g. at least two, three, four, five, six or more (preferably different) antigenic peptides or proteins derived from different viruses of the order Bunyavirales or their fragments or variants within the definitions provided herein. Alternatively, the bicistronic or multicistronic artificial nucleic acid may encode e.g. at least two, three, four, five, six or more (preferably different) antigenic peptides or proteins derived from the same virus of the order Bunyavirales or their fragments or variants within the definitions provided herein. In this context, a so-called IRES (internal ribosomal entry site) sequence as defined above can function as a sole ribosome binding site, but it can also serve to provide a bi- or even multicistronic nucleic acid as defined above, which encodes several antigenic peptides or proteins which are to be translated by the ribosomes independently of one another. Suitable examples of IRES sequences may be selected from the list of nucleic acid sequences according to SEQ ID NOs: 1566-1662 of the patent application WO2017/081082, or fragments or variants of these sequences. On nucleic acid level, any nucleic acid sequence (e.g. RNA sequence) may be selected which encodes such amino acid sequences. In this context, the disclosure of WO2017/081082 relating to IRES sequences is herewith incorporated by reference.

It has to be understood that in the context of the invention, certain combinations of coding sequences may be generated by any combination of monocistronic, bicistronic and multicistronic nucleic acids and/or multi-antigen-constructs/nucleic acid to obtain a nucleic acid composition encoding multiple antigenic peptides or proteins as defined herein.

Nucleic Acid Modifications

In preferred embodiments, the artificial nucleic acid, particularly the artificial RNA according the invention is a modified artificial nucleic acid, preferably a stabilized artificial nucleic acid.

According to preferred embodiments, the artificial nucleic acid, particularly the artificial RNA of the present invention may be provided as a "stabilized artificial nucleic acid" that is an artificial nucleic acid showing improved resistance to in vivo degradation and/or an artificial nucleic acid showing improved stability in vivo, and/or an artificial nucleic acid showing improved translatability in vivo. In the following, specific suitable modifications in this context are described which are suitably to "stabilize" the artificial nucleic acid as defined herein.

According to embodiments, the artificial nucleic acid, particularly the artificial RNA according to the invention is a modified artificial nucleic acid, wherein the modification refers to chemical modifications comprising backbone modifications as well as sugar modifications or base modifications.

In this context, a modified nucleic acid sequence, preferably a modified RNA sequence as defined herein may contain nucleotide analogues/modifications, e.g. backbone modifications, sugar modifications or base modifications. A backbone modification in connection with the present invention is a modification, in which phosphates of the backbone of the nucleotides contained in a nucleic acid, e.g. an artificial RNA, are chemically modified. A sugar modification in connection with the present invention is a chemical modification of the sugar of the nucleotides of the RNA as defined herein. Furthermore, a base modification in connection with the present invention is a chemical modification of the base moiety of the nucleotides of the RNA. In this context, nucleotide analogues or modifications are preferably selected from nucleotide analogues which are applicable for transcription and/or translation.

In particularly preferred embodiments of the present invention, the nucleotide analogues/modifications which may be incorporated into a modified nucleic acid or particularly into a modified RNA as described herein are preferably selected from 2-amino-6-chloropurineriboside-5'-triphosphate, 2-Aminopurine-riboside-5'-triphosphate; 2-aminoadenosine-5'-triphosphate, 2'-Amino-2'-deoxycytidine-triphosphate, 2-thiocytidine-5'-triphosphate, 2-thiouridine-5'-triphosphate, 2'-Fluorothymidine-5'-triphosphate, 2'-O-Methyl-inosine-5'-triphosphate 4-thiouridine-5'-triphosphate, 5-aminoallylcytidine-5'-triphosphate, 5-aminoallyluridine-5-triphosphate, 5-bromocytidine-5'-triphosphate, 5-bromouridine-5'-triphosphate, 5-Bromo-2'-deoxycytidine-5'-triphosphate, 5-Bromo-2'-deoxyuridine-5'-triphosphate, 5-iodocytidine-1-triphosphate, 5-Iodo-2'-deoxycytidine-5'-triphosphate, 5-iodouridine-5'-triphosphate, 5-Iodo-2'-deoxyuridine-5'-triphosphate, 5-methylcytidine-5-triphosphate, 5-methyluridine-5'-triphosphate, 5-Propynyl-2'-deoxycytidine-5'-triphosphate, 5-Propynyl-2'-deoxyuridine-5'-triphosphate, 6-azacytidine-5'-triphosphate, 6-azauridine-5'-triphosphate, 6-chloropurinedboside-5'-triphosphate, 7-deazaadenosine-5'-triphosphate, 7-deazaguanosine-5'-triphosphate, 8-azaadenosine-5'-triphosphate, 8-azidoadenosine-5'-triphosphate, benzimidazole-riboside-5'-triphosphate, N1-methyladenosine-5'-triphosphate, N1-methylguanosine-5'-triphosphate, N6-methyladenosine-5'-triphosphate, O6-methylguanosine-5-triphosphate, pseudouridine-5-triphosphate, or puromycin-5'-triphosphate, xanthosine-5'-triphosphate. Particular preference is given to nucleotides for base modifications selected from the group of base-modified nucleotides consisting of 5-methylcytidine-5'-triphosphate, 7-deazaguanosine-5'-triphosphate, 5-bromocytidine-5'-triphosphate, and pseudouridine-5-triphosphate, pyridin-4-one ribonucleoside, 5-aza-uridine, 2-thio-5-aza-uridine, 2-thiouridine, 4-thio-pseudouridine, 2-thio-pseudouridine, 5-hydroxyuridine, 3-methyluridine, 5-carboxymethyl-uridine, 1-carboxymethyl-pseudouridine, 5-propynyl-uridine, 1-propynyl-pseudouridine, 5-taurinomethyluridine, 1-taurinomethyl-pseudouridine, 5-taurinomethyl-2-thio-uridine, 1-taurinomethyl-4-thio-uridine, 5-methyl-uridine, 1-methyl-pseudouridine, 4-thio-1-methyl-pseudouridine, 2-thio-1-methyl-pseudouridine, 1-methyl-1-deaza-pseudouridine, 2-thio-1-methyl-1-deaza-pseudouridine, dihydrouridine, dihydropseudouridine, 2-thio-dihydrouridine, 2-thio-dihydropseudouridine, 2-methoxyuridine, 2-methoxy-4-thio-uridine, 4-methoxy-pseudouridine, and 4-methoxy-2-thio-pseudouridine, 5-aza-cytidine, pseudoisocytidine, 3-methyl-cytidine, N4-acetylcytidine, 5-formylcytidine, N4-methylcytidine, 5-hydroxymethylcytidine, 1-methyl-pseudoisocytidine, pyrrolo-cytidine, pyrrolo-pseudoisocytidine, 2-thio-cytidine, 2-thio-5-methyl-cytidine, 4-thio-pseudoisocytidine, 4-thio-1-methyl-pseudoisocytidine, 4-thio-1-methyl-1-deaza-pseudoisocytidine, 1-methyl-1-deaza- pseudoisocytidine, zebularine, 5-aza-zebularine, 5-methyl-zebularine, 5-aza-2-thio-zebularine, 2-thio-zebularine, 2-methoxy-cytidine, 2-methoxy-5-methyl-cytidine, 4-methoxy-pseudoisocytidine, and 4-methoxy-1-methyl-pseudoisocytidine, 2-aminopurine, 2, 6-diaminopurine, 7-deaza-adenine, 7-deaza-8-aza-adenine, 7-deaza-2-aminopurine, 7-deaza-8-aza-2-aminopurine, 7-deaza-2,6-diaminopurine, 7-deaza-8-aza-2,6-diaminopurine, 1-methyl-adenosine, N6-methyladenosine, N6-isopentenyladenosine, N6-(cis-hydroxyisopentenyl)adenosine, 2-methylthio-N6-(cis-hydroxyisopentenyl) adenosine, N6-glycinylcarbamoyladenosine, N6-threonylcarbamoyladenosine, 2-methylthio-N6-threonyl carbamoyladenosine, N6,N6-dimethyladenosine, 7-methyladenine, 2-methylthio-adenine, and 2-methoxy-adenine, inosine, 1-methyl-inosine, wyosine, wybutosine, 7-deaza-guanosine, 7-deaza-8-aza-guanosine, 6-thio-guanosine, 6-thio-7-deaza-guanosine, 6-thio-7-deaza-8-aza-guanosine, 7-methyl-guanosine, 6-thio-7-methyl-guanosine, 7-methylinosine, 6-methoxy-guanosine, 1-methylguanosine, N2-methylguanosine, N2,N2-dimethylguanosine, 8-oxo-guanosine, 7-methyl-8-oxo-guanosine, 1-methyl-6-thio-guanosine, N2-methyl-6-thio-guanosine, and N2,N2-dimethyl-6-thio-guanosine, 5'-O-(1-thiophosphate)-adenosine, 5'-O-(1-thiophosphate)-cytidine, 5'-O-(1-thiophosphate)-guanosine, 5'-O-(1-thiophosphate)-uridine, 5'-O-(1-thiophosphate)-pseudouridine, 6-aza-cytidine, 2-thio-cytidine, α-thio-cytidine, Pseudo-iso-cytidine, 5-aminoallyl-uridine, 5-iodo-uridine, N1-methyl-pseudouridine, 5,6-dihydrouridine, α-thio-uridine, 4-thio-uridine, 6-aza-uridine, 5-hydroxy-uridine, deoxy-thymidine, 5-methyl-uridine, Pyrrolo-cytidine, inosine, α-thio-guanosine, 6-methyl-guanosine, 5-methyl-cytidine, 8-oxo-guanosine, 7-deaza-guanosine, N1-methyl-adenosine, 2-amino-6-Chloro-purine, N6-methyl-2-amino-purine, Pseudo-iso-cytidine, 6-Chloro-purine, N6-methyl-adenosine, α-thio-adenosine, 8-azido-adenosine, 7-deaza-adenosine.

Particularly preferred and suitable in the context of the invention are pseudouridine (ψ), N1-methylpseudouridine (m1ψ), 5-methylcytosine, and 5-methoxyuridine. Accordingly, the artificial nucleic acid as defined herein may comprise at least one modified nucleotide selected from pseudouridine (ψ), N1-methylpseudouridine (m1ψ), 5-methylcytosine, and 5-methoxyuridine.

Suitable Codon Modified Coding Sequences:

In preferred embodiments, the artificial nucleic acid, particularly the artificial RNA of the invention comprises at least one coding sequence, wherein the at least one coding sequence is codon modified.

In preferred embodiments, the at least one coding sequence of the invention is a codon modified coding sequence, wherein the amino acid sequence encoded by the at least one codon modified coding sequence is preferably not being modified compared to the amino acid sequence encoded by the corresponding wild type coding sequence.

The term "codon modified coding sequence" relates to coding sequences that differ in at least one codon (triplets of nucleotides coding for one amino acid) compared to the corresponding wild type coding sequence. Suitably, a codon modified coding sequence in the context of the invention may show improved resistance to in vivo degradation and/or improved stability in vivo, and/or improved translatability in vivo. Codon modifications in the broadest sense make use of the degeneracy of the genetic code wherein multiple codons may encode the same amino acid and may be used interchangeably (cf. Table 5) to optimize/modify the coding sequence for in vivo applications as outlined above.

In particularly preferred embodiments, the at least one sequence is a codon modified coding sequence, wherein the codon modified coding sequence is selected from C maximized coding sequence, G/C content modified coding sequence, G/C optimized coding sequence, human codon usage adapted coding sequence, CAI maximized coding sequence, or any combination thereof.

According to embodiments, the artificial nucleic acid of the present invention, particularly the artificial RNA according to the invention may be modified, wherein the C content of the at least one coding sequence of the invention may be increased, preferably maximized, compared to the C content of the corresponding wild type coding sequence (herein referred to as "C maximized coding sequence"). The amino acid sequence encoded by the C maximized coding sequence of the nucleic acid sequence is preferably not modified as compared to the amino acid sequence encoded by the respective wild type nucleic acid coding sequence. The generation of a Cytosine optimized nucleic acid sequences, e.g. RNA sequence of the present invention as described above may suitably be carried out using a modification method according to WO2015/062738. In this context, the disclosure of WO2015/062738 is included herewith by reference.

According to embodiments, the artificial nucleic acid, particularly the artificial RNA of the present invention may be modified, wherein the G/C content of the at least one coding sequence of the invention may be modified compared to the G/C content of the corresponding wild type coding sequence (herein referred to as "G/C content modified coding sequence"). In this context, the terms "G/C optimization" or "G/C content modification" relate to a nucleic acid, preferably an artificial nucleic acid of the invention that comprises a modified, preferably an increased number of guanosine and/or cytosine nucleotides as compared to the corresponding wild type nucleic acid sequence. Such an increased number may be generated by substitution of codons containing adenosine or thymidine nucleotides by codons containing guanosine or cytosine nucleotides. If the enriched G/C content occurs in a coding sequence of DNA or RNA, it makes use of the degeneracy of the genetic code. In particular, in case of RNA, sequences having an increased G (guanosine)/C (cytosine) content are more stable than sequences having an increased A (adenosine)/U (uracil) content. The amino acid sequence encoded by the G/C content modified coding sequence of the nucleic acid sequence is preferably not modified as compared to the amino acid sequence encoded by the respective wild type nucleic acid coding sequence. Preferably, the G/C content of the coding sequence of the artificial nucleic acid sequence. e.g. the RNA sequence of the present invention is increased by at least 10%, preferably by at least 20%, more preferably by at least 30%, most preferably by at least 40% compared to the G/C content of the coding sequence of the corresponding wild type nucleic acid sequence (e.g. RNA sequence), which codes for a virus antigen as defined herein or a fragment or variant thereof.

According to preferred embodiments, the artificial nucleic acid, particularly the artificial RNA of the present invention may be modified, wherein the G/C content of the at least one coding sequence of the invention may be optimized compared to the G/C content of the corresponding wild type coding sequence (herein referred to as "G/C content optimized coding sequence"). "Optimized" in that context refers to a coding sequence wherein the G/C content is preferably increased to the essentially highest possible G/C content. The amino acid sequence encoded by the G/C content optimized coding sequence of the nucleic acid sequence is preferably not modified as compared to the amino acid sequence encoded by the respective wild type nucleic acid coding sequence. The generation of a G/C content optimized nucleic acid sequences, e.g. RNA sequence of the present invention as described above may suitably be carried out using a G/C content modification method explained in WO2002/098443. In this context, the disclosure of WO2002/098443 is included in its full scope in the present invention.

According to preferred embodiments, the artificial nucleic acid, particularly the artificial RNA of the present invention may be modified, wherein the codons in the at least one coding sequence of the invention may be adapted to human codon usage (herein referred to as "human codon usage adapted coding sequence"). Codons encoding the same amino acid occur at different frequencies in a subject. e.g. a human. Accordingly, the coding sequence of the artificial nucleic acid as defined herein is preferably modified such that the frequency of the codons encoding the same amino acid corresponds to the naturally occurring frequency of that codon according to the human codon usage e.g. as shown in Table 5. For example, in the case of the amino acid Alanine (Ala), the wild type coding sequence is preferably adapted in a way that the codon "GCC" is used with a frequency of 0.40, the codon "GCT" is used with a frequency of 0.28, the codon "GCA" is used with a frequency of 0.22 and the codon "GCG" is used with a frequency of 0.10 etc. (see Table 5). Accordingly such a procedure (as exemplified for Ala) is applied for each amino acid encoded by the coding sequence of the artificial nucleic acid of the invention to obtain sequences adapted to human codon usage.

TABLE 5

Human codon usage table with frequencies indicated for each amino acid

| Amino acid | codon | frequency | Amino acid | codon | frequency |
|---|---|---|---|---|---|
| Ala | GCG | 0.10 | Pro | CCG | 0.11 |
| Ala | GCA | 0.22 | Pro | CCA | 0.27 |
| Ala | GCT | 0.28 | Pro | CCT | 0.29 |
| Ala | GCC* | 0.40 | Pro | CCC* | 0.33 |
| Cys | TGT | 0.42 | Gln | CAG* | 0.73 |
| Cys | TGC* | 0.58 | Gln | CAA | 0.27 |
| Asp | GAT | 0.44 | Arg | AGG | 0.22 |
| Asp | GAC* | 0.56 | Arg | AGA* | 0.21 |
| Glu | GAG* | 0.59 | Arg | CGG | 0.19 |
| Glu | GAA | 0.41 | Arg | CGA | 0.10 |
| Phe | TTT | 0.43 | Arg | CGT | 0.09 |
| Phe | TTC* | 0.57 | Arg | CGC | 0.19 |
| Gly | GGG | 0.23 | Ser | AGT | 0.14 |
| Gly | GGA | 0.26 | Ser | AGC* | 0.25 |
| Gly | GGT | 0.18 | Ser | TCG | 0.06 |
| Gly | GGC* | 0.33 | Ser | TCA | 0.15 |
| His | CAT | 0.41 | Ser | TCT | 0.18 |
| His | CAC* | 0.59 | Ser | TCC | 0.23 |
| Ile | ATA | 0.14 | Thr | ACG | 0.12 |
| Ile | ATT | 0.35 | Thr | ACA | 0.27 |
| Ile | ATC* | 0.52 | Thr | ACT | 0.23 |
| Lys | AAG* | 0.60 | Thr | ACC* | 0.38 |
| Lys | AAA | 0.40 | Val | GTG* | 0.48 |
| Leu | TTG | 0.12 | Val | GTA | 0.10 |
| Leu | TTA | 0.06 | Val | GTT | 0.17 |
| Leu | CTG* | 0.43 | Val | GTC | 0.25 |
| Leu | CTA | 0.07 | Trp | TGG* | 1 |
| Leu | CTT | 0.12 | Tyr | TAT | 0.42 |
| Leu | CTC | 0.20 | Tyr | TAC* | 0.58 |
| Met | ATG* | 1 | Stop | TGA* | 0.61 |
| Asn | AAT | 0.44 | Stop | TAG | 0.17 |
| Asn | AAC* | 0.56 | Stop | TAA | 0.22 |

*most frequent human codon

According to preferred embodiments, the artificial nucleic acid, particularly the artificial RNA of the present invention may be modified, wherein the codon adaptation index (CAI) may be increased or preferably maximised in the at least one coding sequence of the invention (herein referred to as "CAI maximized coding sequence"). Accordingly, it is preferred that all codons of the wild type nucleic acid sequence that are relatively rare in the cell (e.g. a human) are exchanged for a respective codon that is frequent in the cell, wherein the frequent codon encodes the same amino acid as the relatively rare codon. Suitably, the most frequent codons are used for each encoded amino acid (see Table 5, most frequent human codons are marked with asterisks). Suitably, the nucleic acid sequence of the present invention comprises at least one coding sequence, wherein the codon adaptation index (CAI) of the at least one coding sequence is at least 0.5, at least 0.8, at least 0.9 or at least 0.95. Most preferably, the codon adaptation index (CAI) of the at least one coding sequence is 1. For example, in the case of the amino acid alanine (Ala) present in the amino acid sequence encoded by the at least one coding sequence of the nucleic acid sequence according to the invention, the wild type coding sequence is adapted in a way that the most frequent human codon "GCC" is always used for said amino acid. Accordingly, such a procedure (as exemplified for Ala) is applied for each amino acid encoded by the coding sequence of the artificial nucleic acid of the invention to obtain CAI maximized coding sequences.

Suitably codon modified nucleic acid sequences as defined above that may be used according to the invention are provided in Tables 1-4, Columns E-H. Therein, Column E provides SEQ ID NOs corresponding to CA maximized nucleic acid sequences that encode the respective amino acid sequences as defined in Column C of the respective row. Column F provides SEQ ID NOs corresponding to human codon usage adapted nucleic acid sequences that encode the respective amino acid sequences as defined in Column C of the respective row. Column G provides SEQ ID NOs corresponding to G/C optimized nucleic acid sequences that encode the respective amino acid sequences as defined in Column C of the respective row. Column H provides SEQ ID NOs corresponding to G/C content modified nucleic acid sequences that encode the respective amino acid sequences as defined in Column C of the respective row. Each row in Tables 1-4 corresponds to an antigen (as defined in Column B) of a respective virus (as defined in Column A).

Accordingly, in a particularly preferred embodiment, the artificial nucleic acid of the invention, particularly the artificial RNA of the invention comprises at least one coding sequence comprising a nucleic acid sequence which is identical or at least 50%, 60%, 70%, 80%, 85%, 86%, 87%, 88%, 89%, 90%, 91%, 92%, 93%, 94%, 95%, 96%, 97%, 98%, or 99% identical to a codon modified nucleic acid sequence selected from the group consisting of SEQ ID NOs: 4904-16578, 16588-16602, 16654-16668, 16720-16734, 16785-16799, 16870-16929, 17105-17129, 17227-17280, 17433-17447 and as defined in Columns E-H of Tables 1-4, encoding a Glycoprotein or a Nucleoprotein derived from a virus of the order Bunyavirales, or a fragment or variant of any of these sequences.

In preferred embodiment, the artificial nucleic acid, particularly the artificial RNA of the invention comprises at least one coding sequence comprising a nucleic acid sequence which is identical or at least 50%, 60%, 70%, 80%, 85%, 86%, 87%, 88%, 89%, 90%, 91%, 92%, 93%, 94%, 95%, 96%, 97%, 98%, or 99% identical to any one of the G/C optimized nucleic acid sequence according to the SEQ ID NOs: 6288-13292, 16594-16596, 16660-16662, 16726-16728, 16791-16793, 16890-16909, 17115-17119, 17245-17262, 17439-17441 and as defined in Columns G of Tables 1-4, encoding a Glycoprotein or a Nucleoprotein derived from a virus of the order Bunyavirales, or a fragment or variant of any of these sequences.

In a further particularly preferred embodiment, the artificial nucleic acid, particularly the artificial RNA of the invention comprises at least one coding sequence comprising a nucleic acid sequence which is identical or at least 50%, 60%, 70%, 80%, 85%, 86%, 87%, 88%, 89%, 90%, 91%, 92%, 93%, 94%, 95%, 96%, 97%, 98%, or 99% identical to a codon modified nucleic acid sequence selected from the group consisting of SEQ ID NOs: 5363-5506, 6055-6198, 6747-6890, 7439-7582, 8131-8274, 9213-9424, 10856-11067, 12499-12710, 14142-14353, 15785-15996, 17105-17129 and as defined in Columns E-H of Table 1, encoding a Glycoprotein or a Nucleoprotein derived from a virus of the genus Orthobunyavirus, or a fragment or variant of any of these sequences.

In preferred embodiment, the artificial nucleic acid, particularly the artificial RNA of the invention comprises at least one coding sequence comprising a nucleic acid sequence which is identical or at least 50%, 60%, 70%, 80%, 85%, 86%, 87%, 88%, 89%, 90%, 91%, 92%, 93%, 94%, 95%, 96%, 97%, 98%, or 99% identical to any one of the G/C optimized nucleic acid sequence according to the SEQ ID NOs: 6747-6890, 12499-12710, 17115-17119 and as defined in Column G of Table 1, encoding a Glycoprotein or a Nucleoprotein derived from a virus of the genus Orthobunyavirus, or a fragment or variant of any of these sequences.

In a further particularly preferred embodiment, the artificial nucleic acid, particularly the artificial RNA of the invention comprises at least one coding sequence comprising a nucleic acid sequence which is identical or at least 50%, 60%, 70%, 80%, 85%, 86%, 87%, 88%, 89%, 90%, 91%, 92%, 93%, 94%, 95%, 96%, 97%, 98%, or 99% identical to a codon modified nucleic acid sequence selected from the group consisting of SEQ ID NOs: 4904-5257, 5596-5949, 6288-6641, 6980-7333, 7672-8025, 8364-8608, 10007-10251, 11650-11894, 13293-13537, 14936-15180, 16588-16602, 16654-16668, 16720-16734, 16785-16799 and as defined in Columns E-H of Table 2, encoding a Glycoprotein or a Nucleoprotein derived from a virus of the genus Orthohantavirus, or a fragment or variant of any of these sequences.

In preferred embodiment, the artificial nucleic acid, particularly the artificial RNA of the invention comprises at least one coding sequence comprising a nucleic acid sequence which is identical or at least 50%, 60%, 70%, 80%, 85%, 86%, 87%, 88%, 89%, 90%, 91%, 92%, 93%, 94%, 95%, 96%, 97%, 98%, or 99% identical to any one of the G/C optimized nucleic acid sequence according to the SEQ ID NOs: 6288-6641, 11650-11894, 16594-16596, 16660-16662, 16726-16728, 16791-16793 and as defined in Columns G of Table 2, encoding a Glycoprotein or a Nucleoprotein derived from a virus of the genus Orthohantavirus, or a fragment or variant of any of these sequences.

In a further particularly preferred embodiment, the artificial nucleic acid, particularly the artificial RNA of the invention comprises at least one coding sequence comprising a nucleic acid sequence which is identical or at least 50%, 60%, 70%, 80%, 85%, 86%, 87%, 88%, 89%, 90%, 91%, 92%, 93%, 94%, 95%, 96%, 97%, 98%, or 99% identical to a codon modified nucleic acid sequence selected from the group consisting of SEQ ID NOs: 5507-5595, 6199-6287, 689146979, 7583-7671, 8275-8363, 9425-

10006, 11068-11649, 12711-13292, 14354-14935, 15997-16578, 17227-17280, 17433-17447 and as defined in Columns E-H of Table 3, encoding a Glycoprotein or a Nucleoprotein derived from a virus of the genus Phlebovirus, or a fragment or variant of any of these sequences.

In preferred embodiment, the artificial nucleic acid, particularly the artificial RNA of the invention comprises at least one coding sequence comprising a nucleic acid sequence which is identical or at least 50%, 60%, 70%, 80%, 85%, 86%, 87%, 88%, 89%, 90%, 91%, 92%, 93%, 94%, 95%, 96%, 97%, 98%, or 99% identical to any one of the G/C optimized nucleic acid sequence according to the SEQ ID NOs: 6891-6979, 12711-13292, 17245-17262, 17439-17441 and as defined in Columns G of Table 3, encoding a Glycoprotein or a Nucleoprotein derived from a virus of the genus Phlebovirus, or a fragment or variant of any of these sequences.

In a further particularly preferred embodiment, the artificial nucleic acid, particularly the artificial RNA of the invention comprises at least one coding sequence comprising a nucleic acid sequence which is identical or at least 50%, 60%, 70%, 80%, 85%, 86%, 87%, 88%, 89%, 90%, 91%, 92%, 93%, 94%, 95%, 96%, 97%, 98%, or 99% identical to a codon modified nucleic acid sequence selected from the group consisting of SEQ ID NOs: 5523-5524, 9447-9757, 6215-6216, 11090-11400, 6907-6908, 12733-13043, 7599-7600, 8291-8292, 14376-14686, 16019-16329, 17227-17280 and as defined in Columns E-H, row 9-14 of Table 3 encoding a Glycoprotein or a Nucleoprotein derived from RVFV, or a fragment or variant of any of these sequences.

In preferred embodiment, the artificial nucleic acid, particularly the artificial RNA of the invention comprises at least one coding sequence comprising a nucleic acid sequence which is identical or at least 50%, 60%, 70%, 80%, 85%, 86%, 87%, 88%, 89%, 90%, 91%, 92%, 93%, 94%, 95%, 96%, 97%, 98%, or 99% identical to any one of the G/C optimized nucleic acid sequence according to the SEQ ID NOs: 6907-6908, 12733-13043, 17245-17262 as defined in Columns G rows 9-14 of Table 3, encoding a Glycoprotein or a Nucleoprotein derived from RVFV, or a fragment or variant of any of these sequences.

In a further particularly preferred embodiment, the artificial nucleic acid, particularly the artificial RNA of the invention comprises at least one coding sequence comprising a nucleic acid sequence which is identical or at least 50%, 60%, 70%, 80%, 85%, 86%, 87%, 88%, 89%, 90%, 91%, 92%, 93%, 94%, 95%, 96%, 97%, 98%, or 99% identical to a codon modified nucleic acid sequence selected from the group consisting of SEQ ID NOs: 5547-5595, 9795-10006, 6239-6287, 11438-11649, 6931-6979, 13081-13292, 7623-7671, 8315-8363, 14724-14935, 16367-1657, 17433-17447 and as defined in Columns E-H rows 15-16 of Table 3, encoding a Glycoprotein or a Nucleoprotein derived from SFTSV, or a fragment or variant of any of these sequences.

In preferred embodiment, the artificial nucleic acid, particularly the artificial RNA of the invention comprises at least one coding sequence comprising a nucleic acid sequence which is identical or at least 50%, 60%, 70%, 80%, 85%, 86%, 87%, 88%, 89%, 90%, 91%, 92%, 93%, 94%, 95%, 96%, 97%, 98%, or 99% identical to any one of the G/C optimized nucleic acid sequence according to the SEQ ID NOs: 6931-6979, 13081-13292, 17439-17441 as defined in Columns G rows 15-16 of Tables 3, encoding a Glycoprotein or a Nucleoprotein derived from SFTSV, or a fragment or variant of any of these sequences.

In a further particularly preferred embodiment, the artificial nucleic acid, particularly the artificial RNA of the invention comprises at least one coding sequence comprising a nucleic acid sequence which is identical or at least 50%, 60%, 70%, 80%, 85%, 86%, 87%, 88%, 89%, 90%, 91%, 92%, 93%, 94%, 95%, 96%, 97%, 98%, or 99% identical to a codon modified nucleic acid sequence selected from the group consisting of SEQ ID NOs: SEQ ID NOs: 5258-5362, 5950-054, 6642-6746, 7334-7438, 8026-8130, 8609-9212, 10252-10855, 11895-12498, 13538-14141, 15181-15784, 16870-16929 and as defined in Columns E-H of Table 4, encoding a Glycoprotein or a Nucleoprotein derived from a virus of the genus Orthonairovirus, or a fragment or variant of any of these sequences.

In preferred embodiment, the artificial nucleic acid, particularly the artificial RNA of the invention comprises at least one coding sequence comprising a nucleic acid sequence which is identical or at least 50%, 60%, 70%, 80%, 85%, 86%, 87%, 88%, 89%, 90%, 91%, 92%, 93%, 94%, 95%, 96%, 97%, 98%, or 99% identical to any one of the G/C optimized nucleic acid sequence according to the SEQ ID NOs: 6642-6746, 11895-12498, 16890-16909 and as defined in Columns G of Table 4, encoding a Glycoprotein or a Nucleoprotein derived from a virus of the genus Orthonairovirus, or a fragment or variant of any of these sequences.

In a further particularly preferred embodiment, the artificial nucleic acid, particularly the artificial RNA of the invention comprises at least one coding sequence comprising a nucleic acid sequence which is identical or at least 50%, 60%, 70%, 80%, 85%, 86%, 87%, 88%, 89%, 90%, 91%, 92%, 93%, 94%, 95%, 96%, 97%, 98%, or 99% identical to a codon modified nucleic acid sequence selected from the group consisting of SEQ ID NOs: 5258-5347, 8609-9207, 5950-6039, 10252-10850, 6642-6731, 11895-12493, 7334-7423, 8026-8115, 13538-14136, 15181-15779, 16870-16929 and as defined in Columns E-H rows 5-10 of Tables 4, encoding a Glycoprotein or a Nucleoprotein derived from CCHFV, or a fragment or variant of any of these sequences.

In preferred embodiment, the artificial nucleic acid, particularly the artificial RNA of the invention comprises at least one coding sequence comprising a nucleic acid sequence which is identical or at least 50%, 60%, 70%, 80%, 85%, 86%, 87%, 88%, 89%, 90%, 91%, 92%, 93%, 94%, 95%, 96%, 97%, 98%, or 99% identical to any one of the G/C optimized nucleic acid sequence according to the SEQ ID NOs: 6642-6731, 11895-12493, 16890-16909 as defined in Columns G rows 5-10 of Tables 4, encoding a Glycoprotein or a Nucleoprotein derived from CCHF, or a fragment or variant of any of these sequences.

In a further particularly preferred embodiment, the artificial nucleic acid, particularly the artificial RNA of the invention comprises at least one coding sequence comprising a nucleic acid sequence which is identical or at least 50%, 60%, 70%, 80%, 85%, 86%, 87%, 88%, 89%, 90%, 91%, 92%, 93%, 94%, 95%, 96%, 97%, 98%, or 99% identical to a codon modified nucleic acid sequence selected from the group consisting of SEQ ID NOs: 94-233 encoding a secretory signal peptide as defined herein, or a fragment or variant of any of these sequences.

In a further particularly preferred embodiment, the artificial nucleic acid, particularly the artificial RNA of the invention comprises at least one coding sequence comprising a nucleic acid sequence which is identical or at least 50%, 60%, 70%, 80%, 85%, 86%, 87%, 88%, 89%, 90%, 91%, 92%, 93%, 94%, 95%, 96%, 97%, 98%, or 99% identical to a G/C optimized nucleic acid sequence selected from the group consisting of SEQ ID NOs: 94-121 encoding a secretory signal peptide as defined herein, or a fragment or variant of any of these sequences.

In embodiments, the A/U content in the environment of the ribosome binding site of the artificial nucleic acid, particularly the artificial RNA of the invention may be increased compared to the A/U content in the environment of the ribosome binding site of its respective wild type nucleic acid. This modification (an increased A/U content around the ribosome binding site) increases the efficiency of ribosome binding to the nucleic acid, preferably the RNA. An effective binding of the ribosomes to the ribosome binding site in turn has the effect of an efficient translation of the RNA. Accordingly, in a particularly preferred embodiment, the artificial nucleic acid of the invention comprises a ribosome binding site, also referred to as "Kozak sequence" identical to or at least 80%, 85%, 90%, 95% identical to any one of the sequences SEQ ID NO: 19 or 20, or fragments or variants thereof.

Suitable Histone Stem-Loop Sequences and Structures:

In preferred embodiment, the artificial nucleic acid as defined herein, particularly the RNA, comprises at least one histone stem-loop sequence and/or structure.

The term "histone stem-loop" as used herein will be recognized and understood by the person of ordinary skill in the art, and are for example intended to refer to nucleic acid sequences that are predominantly found in histone histone mRNAs. Exemplary histone stem-loop sequences are described in Lopez et al. (Davila Lopez et al, (2008), RNA, 14 (1)). The stem-loops in histone pre-mRNAs are typically followed by a purine-rich sequence known as the histone downstream element (HDE). These pre-mRNAs are processed in the nucleus by a single endonucleolytic cleavage approximately 5 nucleotides downstream of the stem-loop, catalyzed by the U7 snRNP through base pairing of the U7 snRNA with the HDE.

Histone stem-loop sequences may suitably be selected from histone stem-loop sequences as disclosed in WO2012/019780, the disclosure relating to histone stem-loop sequences/structures incorporated herewith by reference. Accordingly, a histone stem-loop sequence that may be used within the present invention is preferably derived from formulae (I) or (II) of the patent application WO2012/019780. According to a further preferred embodiment the artificial nucleic acid as defined herein, particularly the RNA as defined herein may comprise at least one histone stem-loop sequence derived from at least one of the specific formulae (Ia) or (Ia) of the patent application WO2012/019780.

In particularly preferred embodiment, the artificial nucleic acid as defined herein, particularly the RNA as defined herein comprises a histone stem-loop sequence/structure according to SEQ ID NOs: 17 or 18, or a fragment or variant of any of these sequences.

In other embodiments, the nucleic acid does not comprise a histone stem-loop as defined herein.

In further embodiments, the nucleic acid of the invention comprises a 3'-terminal sequence element. Said 3'-terminal sequence element has to be understood as a sequence element comprising a poly(A)sequence and/or a histone-stem-loop sequence, wherein said sequence element is located at the 3 terminus of the RNA of the invention.

Accordingly, the nucleic acid, preferably the RNA of the invention may comprise a 3'-terminal sequence element according to SEQ ID NOs: 17522-17541 or a fragment or variant thereof.

Suitable UTR Elements:

In preferred embodiments, the artificial nucleic acid of the invention, particularly the RNA as defined herein comprises an untranslated region (UTR).

Suitably, the nucleic acid as defined herein, particularly the RNA may comprise at least one 5'-UTR element and/or at least one 3'-UTR element. In this context, an UTR element comprises or consists of a nucleic acid sequence, which is derived from a 5'-UTR or 3'-UTR of any naturally occurring gene or which is derived from a fragment, a homolog or a variant of the 5'-UTR or 3'-UTR of a gene. Preferably, the 5'-UTR or 3'-UTR element used according to the present invention is heterologous to the at least one coding sequence of the nucleic acid as defined herein, particularly the RNA as defined herein. Suitably, 5'-UTR or 3'-UTR elements are derived from naturally occurring genes. In other embodiments, synthetically engineered 5'-UTR or 3-UTR elements may be used in the context of the present invention.

In preferred embodiments, the artificial nucleic acid of the invention, particularly the RNA as defined herein comprises a 3'-UTR element, wherein the 3'-UTR element comprises a poly(A) sequence and/or a poly(C) sequence.

The terms "poly(A) sequence", "poly(A) tail" or "3'-poly (A) tail" will be recognized and understood by the person of ordinary skill in the art, and are for example intended to be a sequence of adenosine nucleotides, typically located at the 3-end of an RNA, of up to about 1000 adenosine nucleotides. In the context of the present invention, a poly(A) sequence may be located within an mRNA or any other nucleic acid molecule, such as, e.g., in a DNA vector, for example, in a vector serving as template for the generation of an RNA, preferably an mRNA, e.g., by RNA in vitro transcription of the vector (e.g., plasmid DNA or PCR product).

The term "poly(C) sequence" will be recognized and understood by the person of ordinary skill in the art, and are for example intended to be a sequence of cytosine nucleotides, typically located at the 3-end of an RNA, of up to about 500 cytosine nucleotides. In the context of the present invention, a poly(C) sequence may be located within an mRNA or any other nucleic acid molecule, such as, e.g., in a DNA vector, for example, in a vector serving as template for the generation of an RNA, preferably an mRNA, e.g., by RNA in vitro transcription of the vector (e.g., plasmid DNA or PCR product) . . . .

In a preferred embodiment, the poly(A) sequence, suitable located at the 3' terminus, comprises 10 to 500 adenosine nucleotides, 10 to 200 adenosine nucleotides, 40 to 80 adenosine nucleotides or 50 to 70 adenosine nucleotides. In a particularly preferred embodiment, the poly(A) sequence comprises about 64 adenosine nucleotides. In further particularly preferred embodiments, the poly(A) sequence comprises about 75 adenosine nucleotides.

Preferably, the poly(A) sequence in the artificial nucleic acid, preferably the RNA is derived from a DNA template by RNA in vitro transcription. In other embodiments, the poly (A) sequence is obtained in vitro by common methods of chemical synthesis without being necessarily transcribed from a DNA template. In other embodiments, poly(A) sequences are generated by enzymatic polyadenylation of the RNA (after RNA in vitro transcription) according to the present invention using commercially available polyadenylation kits and corresponding protocols known in the art, or alternatively, by using immobilized poly(A)polymerases e.g. in a polyadenylation reactor (as described in WO2016/174271).

Alternatively, the artificial nucleic acid as defined herein, particularly the RNA as defined herein may comprise a polyadenylation signal. A polyadenylation signal typically comprises a hexamer consisting of adenine and uracil/thymine nucleotides, preferably the hexamer sequence AAUAAA. Other sequences, preferably hexamer sequences, are also conceivable. Polyadenylation typically occurs during processing of a pre-mRNA (also called pre-mature-mRNA). In this context, a consensus polyadenylation signal is preferred comprising the NN(U/T)ANA consensus sequence. In a particularly preferred embodiment, the polyadenylation signal comprises one of the following sequences: AA(U/T)AAA or A(U/T)(U/T)AAA (wherein uridine is usually present in RNA and thymidine is usually present in DNA).

In embodiments, the RNA sequence of the present invention may contain a poly(A) sequence derived from a vector and may comprise at least one additional poly(A) sequence generated by enzymatic polyadenylation, e.g. as described in WO2016/091391.

According to a further preferred embodiment, the nucleic acid as defined herein, particularly the RNA as defined herein may contain a poly(C) sequence.

In a preferred embodiment, the poly(C) sequence, suitable located at the 3' terminus, comprises 10 to 200 cytosine nucleotides, 10 to 100 cytosine nucleotides, 20 to 70 cytosine nucleotides, 20 to 60 cytosine nucleotides, or 10 to 40 cytosine nucleotides. In a particularly preferred embodiment, the poly(C) sequence comprises about 30 cytosine nucleotides.

Preferably, the poly(C) sequence in the RNA sequence of the present invention is derived from a DNA template by RNA in vitro transcription. In other embodiments, the poly(C) sequence is obtained in vitro by common methods of chemical synthesis without being necessarily transcribed from a DNA template.

According to preferred embodiments, the at least one artificial nucleic acid as defined herein, particularly the RNA may comprise at least one 3-untranslated region or 3'-UTR element.

The term "3'-untranslated region" or "3'-UTR element" will be recognized and understood by the person of ordinary skill in the art, and are for example intended to refer to a part of a nucleic acid molecule, which is located 3' (i.e. "downstream") of a coding sequence and which is typically not translated into protein. Usually, a 3'-UTR is the part of an mRNA which is located between the coding sequence (cds) and the poly(A) sequence of the mRNA. In the context of the invention, the term 3'-UTR may also comprise elements, which are not encoded in the DNA template, from which an artificial RNA is transcribed, but which are added after transcription during maturation, e.g. a poly(A) sequence.

In preferred embodiments, the at least one artificial nucleic acid as defined herein, particularly the RNA as defined herein may comprise at least one heterologous 3'-UTR element.

Preferably, the at least one 3'-UTR element comprises or consists of a nucleic acid sequence derived from the 3'-UTR of a chordate gene, preferably a vertebrate gene, more preferably a mammalian gene, most preferably a human gene, or from a variant of the 3'-UTR of a chordate gene, preferably a vertebrate gene, more preferably a mammalian gene, most preferably a human gene.

Preferably, the at least one artificial nucleic acid, particularly the RNA of the present invention comprises a 3'-UTR element, which may be derivable from a gene that relates to an RNA with an enhanced half-life (that provides a stable RNA), for example a 3-UTR element as defined and described below.

Preferably, the at least one heterologous 3'-UTR element comprises a nucleic acid sequence derived from a 3'-UTR of a gene, which preferably encodes a stable mRNA, or from a homolog, a fragment or a variant of said gene.

In preferred embodiments, the 3'-UTR element comprises or consists of a nucleic acid sequence, which is derived from a 3'-UTR of a gene selected from the group consisting of an albumin gene, an alpha-globin gene, a beta-globin gene, a tyrosine hydroxylase gene, a lipoxygenase gene, and a collagen alpha gene, such as a collagen alpha 1(I) gene, or from a variant of a 3'-UTR of a gene selected from the group consisting of an albumin gene, an alpha-globin gene, a beta-globin gene, a tyrosine hydroxylase gene, a lipoxygenase gene, and a collagen alpha gene, such as a collagen alpha 1(I) gene according to SEQ ID NOs: 1389-1390 of the patent application WO2013/143700, whose disclosure is incorporated herein by reference, or from a homolog, a fragment or a variant thereof.

In preferred embodiments, the 3'-UTR element comprises or consists of a nucleic acid sequence which is derived from a 3'-UTR of an alpha- or beta-globin gene, preferably a vertebrate alpha- or beta-globin gene, more preferably a mammalian alpha- or beta-globin gene, most preferably a human alpha- or beta-globin gene according to SEQ ID NOs: 3, 5, 7, or 9 or the corresponding RNA sequences SEQ ID NOs: 4, 6, 8, or 10. For example, the 3'-UTR element may comprise or consist of the center, α-complex-binding portion of the 3'-UTR of an α-globin gene, such as of a human alpha-globin gene, or a homolog, a fragment, or a variant of an alpha-globin gene, preferably according to SEQ ID NO: 9 or 10.

In particularly preferred embodiments, the artificial nucleic acid of the invention, preferably the RNA comprises at least one 3'-UTR element, preferably a heterologous 3'-UTR element, wherein the 3'-UTR element comprises a nucleic acid sequence derived from a 3'-UTR of an alpha-globin gene, preferably comprising the corresponding RNA sequence of the nucleic acid sequence according to SEQ ID NOs: 9 or 10, or a fragment or variant of any of these sequences.

In preferred embodiments, the 3'-UTR element comprises or consists of a nucleic acid sequence which is derived from the 3'-UTR of a vertebrate albumin gene or from a variant thereof, preferably from the 3'-UTR of a mammalian albumin gene or from a variant thereof, more preferably from the 3'-UTR of a human albumin gene or from a variant thereof, even more preferably from the 3'-UTR of the human albumin gene according to GenBank Accession number NM_000477.5, or from a homolog, fragment or variant thereof.

In this context, it is particularly preferred that the 3'-UTR element of the nucleic acid, preferably the RNA according to the present invention comprises or consists of a nucleic acid sequence according to SEQ ID NOs: 11, 13, or 15 or the corresponding RNA sequence according to SEQ ID NOs: 12, 14, or 16.

In a particularly preferred embodiment, the artificial nucleic acid of the invention, preferably the RNA comprises at least one 3'-UTR element, preferably a heterologous 3'-UTR element, wherein the 3'-UTR element comprises a nucleic acid sequence derived from a 3'-UTR of human albumin gene, preferably comprising the corresponding RNA sequence of the nucleic acid sequence according to SEQ ID NOs: 14 or 16, or a fragment or variant of any of these sequences.

In embodiments, the artificial nucleic acid comprises at least one heterologous 3'-UTR element, wherein the at least one heterologous 3'-UTR element comprises a nucleic acid sequence derived from a 3'-UTR of a gene 40 selected from PSMB3, CASP1, COX6B1, GNAS, NDUFA1 and RPS9, or from a homolog, a fragment or variant of any one of these genes.

PSMB3-derived 3-UTR: The artificial nucleic acid may comprise a 3'-UTR which is derived from a 3'-UTR of a gene encoding a proteasome subunit beta type-3 (PSMB3) protein, or a homolog, variant, fragment or derivative thereof. Such 3'-UTRs preferably comprise or consist of a nucleic acid sequences derived from the 3'-UTR of a proteasome subunit beta type-3 (PSMB3) gene, preferably from a vertebrate, more preferably a mammalian, most preferably a human proteasome subunit beta type-3 (PSMB3) gene, or a homolog, variant, fragment or derivative thereof. Accordingly, the RNA may comprise a 3'-UTR derived from a PSMB3 gene, wherein said 3'-UTR derived from a PSMB3 gene comprises or consists of a nucleic acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 17508 or 17509 or a fragment or a variant thereof.

CASP1-derived 3-UTR: The artificial nucleic acid may comprise a 3'-UTR which is derived from a 3'-UTR of a gene encoding a Caspase-1 (CASP1) protein, or a homolog, variant, fragment or derivative thereof. Such 3'-UTRs preferably comprise or consist of a nucleic acid sequence derived from the 3'-UTR of a Caspase-1 (CASP1) gene, preferably from a vertebrate, more preferably a mammalian, most preferably a human Caspase-1 (CASP1) gene, or a homolog, variant, fragment or derivative thereof. Accordingly, the RNA may comprise a 3'-UTR derived from a CASP1 gene, wherein said 3'-UTR derived from a CASP1 gene comprises or consists of a nucleic acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 17510 or 17511 or a fragment or a variant thereof.

COX6B1-derived 3-UTR: The artificial nucleic acid may comprise a 3'-UTR which is derived from a 3'-UTR of a COX6B1 gene encoding a cytochrome c oxidase subunit 6B1 (COX6B1) protein, or a homolog, variant, fragment or derivative thereof. Such 3-UTRs preferably comprise or consist of a nucleic acid sequence which is derived from the 3'-UTR of a cytochrome c oxidase subunit 6B1 (COX6B1) gene, preferably from a vertebrate, more preferably a mammalian, most preferably a human cytochrome c oxidase subunit 661 (COX6B1) gene, or a homolog, variant, fragment or derivative thereof. Accordingly, the RNA may comprise a 3'-UTR derived from a COX6B1 gene, wherein said 3'-UTR derived from a COX6B1 gene comprises or consists of a nucleic acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 17512 or 17513 or a fragment or a variant thereof.

GNAS-derived 3'-UTR: The artificial nucleic acid may comprise a 3'-UTR which is derived from a 3'-UTR of a GNAS gene encoding a Guanine nucleotide-binding protein G(s) subunit alpha isoforms short (GNAS) protein, or a homolog, variant, fragment or derivative thereof. Such 3'-UTRs preferably comprise or consist of a nucleic acid sequence which is derived from the 3'-UTR of a Guanine nucleotide-binding protein G(s) subunit alpha isoforms short (GNAS) gene, preferably from a vertebrate, more preferably a mammalian Guanine nucleotide-binding protein G(s) subunit alpha isoforms short (GNAS) gene, or a homolog, variant, fragment or derivative thereof. Accordingly, the RNA may comprise a 3'-UTR derived from a GNAS gene, wherein said 3'-UTR derived from a GNAS gene comprises or consists of a nucleic acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 17514 or 17515 or a fragment or a variant thereof.

NDUFA1-derived 3-UTR: The artificial nucleic acid may comprise a 3'-UTR which is derived from a 3'-UTR of a gene encoding a NADH dehydrogenase [ubiquinone] 1 alpha sub complex subunit 1 (NDUFA1) protein, or a homolog, variant, fragment or derivative thereof. Such 3'-UTRs preferably comprise or consist of a nucleic acid sequence derived from the 3'-UTR of a NADH dehydrogenase [ubiquinone] 1 alpha sub complex subunit 1 (NDUFA1) gene, preferably from a vertebrate, more preferably a mammalian NADH dehydrogenase [ubiquinone] 1 alpha sub complex subunit 1 (NDUFA1) gene, or a homolog, variant, fragment or derivative thereof. Accordingly, the RNA may comprise a 3'-UTR derived from a NDUFA1 gene, wherein said 3'-UTR derived from a NDUFA1 gene comprises or consists of a nucleic acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 17516 or 17517 or a fragment or a variant thereof.

RPS9-derived 3-UTR: The artificial nucleic acid may comprise a 3'-UTR which is derived from a 3'-UTR of a gene encoding a 40S ribosomal protein S9 (RPS9) protein, or a homolog, variant, fragment or derivative thereof. Such 3'-UTRs preferably comprise or consist of a nucleic acid sequence derived from the 3'-UTR of a 40S ribosomal protein S9 (RPS9) gene, preferably from a vertebrate, more preferably a mammalian, most preferably a human 40S ribosomal protein S9 (RPS9) gene, or a homolog, variant, fragment or derivative thereof. Accordingly, the RNA may comprise a 3'-UTR derived from a RPS9 gene, wherein said 3'-UTR derived from a RPS9 gene comprises or consists of a nucleic acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 17518 or 17519 or a fragment or a variant thereof.

In further embodiments, the artificial nucleic acid as defined herein, particularly the RNA as defined herein comprises a 3'-UTR element, which may be any 3'-UTR element described in WO2016/107877. In this context, the disclosure of WO2016/107877 relating to 3'-UTR elements/sequences is herewith incorporated by reference. Particularly preferred 3'-UTR elements are SEQ ID NOs: 1 to 24 and SEQ ID NOs: 49 to 318 of the patent application WO2016/107877, or fragments or variants of these sequences. In this context, it is particularly preferred that the 3'-UTR element of the RNA sequence according to the present invention comprises or consists of a corresponding RNA sequence of the nucleic acid sequence according SEQ ID NOs: 1 to 24 and SEQ ID NOs: 49 to 318 of the patent application WO2016/107877.

In embodiments, the artificial nucleic acid as defined herein, particularly the RNA as defined herein comprises a 3'-UTR element, which may be any 3'-UTR element as described in WO2017/036580. In this context, the disclosure of WO2017/036580 relating to 3'-UTR elements/sequences is herewith incorporated by reference. Particularly preferred 3'-UTR elements are nucleic acid sequences according to SEQ ID NOs: 152 to 204 of the patent application WO2017/036580, or fragments or variants of these sequences. In this context, it is particularly preferred that the 3'-UTR element of the RNA sequence according to the present invention comprises or consists of a corresponding RNA sequence of the nucleic acid sequence according SEQ ID NOs: 152 to 204 of the patent application WO2017036580.

According to preferred embodiments, the at least one artificial nucleic acid as defined herein, particularly the RNA may comprise at least one 5'-untranslated region or 5'-UTR element.

The term "5'-untranslated region (5'-UTR)" will be recognized and understood by the person of ordinary skill in the art, and are for example intended to refer to a part of a nucleic acid molecule, which is located 5' (i.e. "upstream") of a coding sequence and which is not translated into protein. A 5'-UTR is typically understood to be a particular section of messenger RNA (mRNA), which is located 5' of the coding sequence of the mRNA. Typically, the 5'-UTR starts with the transcriptional start site (suitably comprising a 5' nucleic acid sequence/RNA sequence derived from, or identical to SEQ ID NOs: 17520 or 17521) and ends one nucleotide before the start codon of the coding sequence. Preferably, the 5'-UTRs have a length of more than 20, 30, 40 or 50 nucleotides. The 5'-UTR may comprise elements for controlling gene expression, also called regulatory elements. Such regulatory elements may be, for example, ribosomal binding sites. The 5'-UTR may be post-transcriptionally modified, for example by addition of a 5'-cap.

In preferred embodiments, the at least one artificial nucleic acid as defined herein, particularly the RNA as defined herein may comprise at least one heterologous 5'-UTR element.

In preferred embodiments, the at least one artificial nucleic acid as defined herein, particularly the RNA of the present invention comprises at least one 5'-UTR element. Preferably, the at least one 5'-UTR element comprises or consists of a nucleic acid sequence derived from the 5'-UTR of a chordate gene, preferably a vertebrate gene, more preferably a mammalian gene, most preferably a human gene, or from a variant of the 3'-UTR of a chordate gene, preferably a vertebrate gene, more preferably a mammalian gene, most preferably a human gene.

Preferably, the at least one artificial nucleic acid, particularly the RNA of the present invention comprises a 5'-UTR element, which may be derivable from a gene that relates to an RNA with an enhanced half-life (that provides a stable RNA), for example a 5'-UTR element as defined and described below. Preferably, the 5'-UTR element is a nucleic acid sequence derived from a 5'-UTR of a gene, which preferably encodes a stable RNA, or from a homolog, a fragment or a variant of said gene In preferred embodiments, the at least one heterologous 5'-UTR element comprises a nucleic acid sequence derived from a 5'-UTR of a gene, which preferably encodes a stable mRNA, or from a homolog, a fragment or a variant of said gene.

In preferred embodiments, the at least one 5'-UTR element comprises or consists of a nucleic acid sequence, which is derived from the 5'-UTR of a TOP gene or which is derived from a fragment, homolog or variant of the 5'-UTR of a TOP gene, or a variant thereof, preferably lacking the 5'-TOP motif.

The term "5' terminal oligopyrimidine tract (TOP)" is has to be understood as a stretch of pyrimidine nucleotides located in the 5' terminal region of a nucleic acid molecule, such as the 5' terminal region of certain mRNA 30 molecules or the 5' terminal region of a functional entity, e.g. the transcribed region, of certain genes. The sequence starts with a cytidine, which usually corresponds to the transcriptional start site, and is followed by a stretch of usually about 3 to 30 pyrimidine nucleotides. For example, the TOP may comprise 3, 4, 5, 6, 7, 8, 9, 10, 11, 12, 13, 14, 15, 16, 17, 18, 19, 20, 21, 22, 23, 24, 25, 26, 27, 28, 29, 30 or even more nucleotides. The pyrimidine stretch and thus the 5'-TOP ends one nucleotide 5' to the first purine nucleotide located downstream of the TOP. Messenger RNA that contains a 5' terminal oligopyrimidine tract is often referred to as TOP mRNA. Accordingly, genes that provide such messenger RNAs are referred to as TOP genes. The term "TOP motif" or "5'-TOP motif" has to be understood as a nucleic acid sequence which corresponds to a 5'-TOP as defined above. Thus, a TOP motif in the context of the present invention is preferably a stretch of pyrimidine nucleotides having a length of 3-30 nucleotides. Preferably, the TOP-motif consists of at least 3 pyrimidine 40 nucleotides, preferably at least 4 pyrimidine nucleotides, preferably at least 5 pyrimidine nucleotides, more preferably at least 6 nucleotides, more preferably at least 7 nucleotides, most preferably at least 8 pyrimidine nucleotides, wherein the stretch of pyrimidine nucleotides preferably starts at its 5'-end with a cytosine nucleotide. In TOP genes and TOP mRNAs, the TOP-motif preferably starts at its 5'-end with the transcriptional start site and ends one nucleotide 5' to the first purine residue in said gene or mRNA. A TOP motif in the sense of the present invention is preferably located at the 5'-end of a sequence which represents a 5'-UTR or at the 5'-end of a sequence which codes for a 5'-UTR. Thus, preferably, a stretch of 3 or more pyrimidine nucleotides is called "TOP motif" in the sense of the present invention if this stretch is located at the 5'-end of a respective sequence, such as the artificial nucleic acid, the 5'-UTR element of the artificial nucleic acid, or the nucleic acid sequence which is derived from the 5'-UTR of a TOP gene as described herein. In other words, a stretch of 3 or more pyrimidine nucleotides, which is not located at the 5'-end of a 5'-UTR or a 5'-UTR element but anywhere within a 5'-UTR or a 5'-UTR element, is preferably not referred to as "TOP motif".

In some embodiments, the nucleic acid sequence of the 5'-UTR element, which is derived from a 5'-UTR of a TOP gene, terminates at its 3'-end with a nucleotide located at position 1, 2, 3, 4, 5, 6, 7, 8, 9 or 10 upstream of the start codon (e.g. A(U/T)G) of the gene or RNA it is derived from. Thus, the 5'-UTR element does not comprise any part of the protein coding sequence. Thus, preferably, the only protein coding part of the at least one nucleic acid sequence, particularly of the RNA sequence, is provided by the coding sequence.

The nucleic acid sequence derived from the 5'-UTR of a TOP gene is preferably derived from a eukaryotic TOP gene, preferably a plant or animal TOP gene, more preferably a chordate TOP gene, even more preferably a vertebrate TOP gene, most preferably a mammalian TOP gene, such as a human TOP gene.

For example, the 5'-UTR element is preferably selected from 5'-UTR elements comprising or consisting of a nucleic acid sequence, which is derived from a nucleic acid sequence selected from the group consisting of SEQ ID NOs: 1-1363, SEQ ID NO: 1395, SEQ ID NO: 1421 and SEQ ID NO: 1422 of the patent application WO2013/143700, whose disclosure is incorporated herein by reference, from the homologs of SEQ ID NOs: 1-1363, SEQ ID NO: 1395, SEQ ID NO: 1421 and SEQ ID NO: 1422 of the patent application WO2013/143700, from a variant thereof, or preferably from a corresponding RNA sequence. The term "homologs of SEQ ID NOs: 1-1363, SEQ ID NO: 1395, SEQ ID NO: 1421 and SEQ ID NO: 1422 of the patent application WO2013/143700" refers to sequences of other species than *Homo sapiens*, which are homologous to the sequences according to SEQ ID NOs: 1-1363, SEQ ID NO: 1395, SEQ ID NO: 1421 and SEQ ID NO: 1422 of the patent application WO2013/143700.

In a preferred embodiment, the 5'-UTR element of the nucleic acid sequence, particularly of the RNA sequence according to the invention comprises or consists of a nucleic acid sequence, which is derived from a nucleic acid sequence extending from nucleotide position 5 (i.e. the nucleotide that is located at position 5 in the sequence) to the nucleotide position immediately 5' to the start codon (located at the 3'-end of the sequences), e.g. the nucleotide position immediately 5' to the ATG sequence, of a nucleic acid sequence selected from SEQ ID NOs: 1-1363, SEQ ID NO: 1395, SEQ ID NO: 1421 and SEQ ID NO: 1422 of the patent application WO2013/143700, from the homologs of SEQ ID NOs: 1-1363, SEQ ID NO: 1395, SEQ ID NO: 1421 and SEQ ID NO: 1422 of the patent application WO2013/143700 from a variant thereof, or a corresponding RNA sequence. It is particularly preferred that the 5'-UTR element is derived from a nucleic acid sequence extending from the nucleotide position immediately 3' to the 5'-TOP to the nucleotide position immediately 5' to the start codon (located at the 3'-end of the sequences), e.g. the nucleotide position immediately 5' to the ATG sequence, of a nucleic acid sequence selected from SEQ ID NOs: 1-1363, SEQ ID NO: 1395, SEQ ID NO: 1421 and SEQ ID NO: 1422 of the patent application WO2013/143700, from the homologs of SEQ ID NOs: 1-1363, SEQ ID NO: 1395, SEQ ID NO: 1421 and SEQ ID NO: 1422 of the patent application WO2013/143700, from a variant thereof, or a corresponding RNA sequence.

In a particularly preferred embodiment, the 5'-UTR element comprises or consists of a nucleic acid sequence, which is derived from a 5'-UTR of a TOP gene encoding a ribosomal protein or from a variant of a 5'-UTR of a TOP gene encoding a ribosomal protein. For example, the 5'-UTR element comprises or consists of a nucleic acid sequence, which is derived from a 5'-UTR of a nucleic acid sequence according to any of SEQ ID NOs: 67, 170, 193, 244, 259, 554, 650, 675, 700, 721, 913, 1016, 1063, 1120, 1138, and 1284-1360 of the patent application WO2013/143700, a corresponding RNA sequence, a homolog thereof, or a variant thereof as described herein, preferably lacking the 5'-TOP motif. As described above, the sequence extending from position 5 to the nucleotide immediately 5' to the ATG (which is located at the 3-end of the sequences) corresponds to the 5'-UTR of said sequences.

Preferably, the 5'-UTR element comprises or consists of a nucleic acid sequence, which is derived from a 5'-UTR of a TOP gene encoding a ribosomal Large protein (RPL) or from a homolog or variant of a 5'-UTR of a TOP gene encoding a ribosomal Large protein (RPL). For example, the 5'-UTR element comprises or consists of a nucleic acid sequence, which is derived from a 5'-UTR of a nucleic acid sequence according to any of SEQ ID NOs: 67, 259, 1284-1318, 1344, 1346, 1348-1354, 1357, 1358, 1421 and 1422 of the patent application WO2013/143700, a corresponding RNA sequence, a homolog thereof, or a variant thereof as described herein, preferably lacking the 5'-TOP motif.

In a particularly preferred embodiment, the 5'-UTR element comprises or consists of a nucleic acid sequence which is derived from the 5'-UTR of a ribosomal protein Large 32 gene, preferably from a vertebrate ribosomal protein Large 32 (L32) gene, more preferably from a mammalian ribosomal protein Large 32 (L32) gene, most preferably from a human ribosomal protein Large 32 (L32) gene, or from a variant of the 5'-UTR of a ribosomal protein Large 32 gene, preferably from a vertebrate ribosomal protein Large 32 (L32) gene, more preferably from a mammalian ribosomal protein Large 32 (L32) gene, most preferably from a human ribosomal protein Large 32 (L32) gene, wherein preferably the 5'-UTR element does not comprise the 5'-TOP of said gene.

In some embodiments, the RNA sequence according to the invention comprises a 5'-UTR element, which comprises or consists of a nucleic acid sequence, which is derived from the 5'-UTR of a vertebrate TOP gene, such as a mammalian, e.g. a human TOP gene, selected from RPSA, RPS2, RPS3, RPS3A, RPS4, RPS5, RPS6, RPS7, RPS8, RPS9, RPS10, RPS11, RPS12, RPS13, RPS14, RPS15, RPS15A, RPS16, RPS17, RPS18, RPS19, RPS20, RPS21, RPS23, RPS24, RPS25, RPS26, RPS27, RPS27A, RPS28, RPS29, RPS30, RPL3, RPL4, RPL5, RPL6, RPL7, RPL7A, RPL8, RPL9, RPL10, RPL10A, RPL11, RPL12, RPL13, RPL13A, RPL14, RPL15, RPL17, RPL18, RPL18A, RPL19, RPL21, RPL22, RPL23, RPL23A, RPL24, RPL26, RPL27, RPL27A, RPL28, RPL29, RPL30, RPL31, RPL32, RPL34, RPL35, RPL35A, RPL36, RPL36A, RPL37, RPL37A, RPL38, RPL39, RPL40, RPL41, RPLP0, RPLP1, RPLP2, RPLP3, RPLP0, RPLP1, RPLP2, EEF1A1, EEF1B2, EEF1D, EEF1G, EEF2, EIF3E, EIF3F, EIF3H, EIF2S3, EIF3C, EIF3K, EIF3EIP, EIF4A2, PABPC1, HNRNPA1, TPT1, TUBB1, UBA52, NPM1, ATP5G2, (GN)B2L1, NME2, UQCRB, or from a homolog or variant thereof, wherein preferably the 5'-UTR element does not comprise a TOP-motif or the 5'-TOP of said genes, and wherein optionally the 5'-UTR element starts at its 5'-end with a nucleotide located at position 1, 2, 3, 4, 5, 6, 7, 8, 9 or 10 downstream of the 5'-terminal oligopyrimidine tract (TOP) and wherein further optionally the 5'-UTR element which is derived from a 5'-UTR of a TOP gene terminates at its 3'-end with a nucleotide located at position 1, 2, 3, 4, 5, 6, 7, 8, 9 or 10 upstream of the start codon (A(U/T)G) of the gene it is derived from.

In further particularly preferred embodiments, the 5'-UTR element comprises or consists of a nucleic acid sequence, which is derived from the 5'-UTR of a ribosomal protein Large 32 gene (RPL32), a ribosomal protein Large 35 gene (RPL35), a ribosomal protein Large 21 gene (RPL21), an ATP synthase, H+ transporting, mitochondrial F1 complex, alpha subunit 1, cardiac muscle (ATP5A1) gene, an hydroxysteroid (17-beta) dehydrogenase 4 gene (HSD17B4), an androgen-induced 1 gene (AIG1), cytochrome c oxidase subunit VIc gene (COX6C), or a N-acylsphingosine amidohydrolase (acid ceramidase) 1 gene (ASAH1) or from a variant thereof, preferably from a vertebrate ribosomal protein Large 32 gene (RPL32), a vertebrate ribosomal protein Large 35 gene (RPL35), a vertebrate ribosomal protein Large 21 gene (RPL21), a vertebrate ATP synthase, H+ transporting, mitochondrial F1 complex, alpha subunit 1, cardiac muscle (ATP5A1) gene, a vertebrate hydroxysteroid (17-beta) dehydrogenase 4 gene (HSD1764), a vertebrate androgen-induced 1 gene (AIG1), a vertebrate cytochrome c oxidase subunit VIc gene (COX6C), or a vertebrate N-acylsphingosine amidohydrolase (acid ceramidase) 1 gene (ASAH1) or from a variant thereof, more preferably from a mammalian ribosomal protein Large 32 gene (RPL32), a ribosomal protein Large 35 gene (RPL35), a ribosomal protein Large 21 gene (RPL21), a mammalian ATP synthase, H+ transporting, mitochondrial F1 complex, alpha subunit 1, cardiac muscle (ATP5A1) gene, a mammalian hydroxysteroid (17-beta) dehydrogenase 4 gene (HSD17B4), a mammalian androgen-induced 1 gene (AIG1), a mammalian cyto-chrome c oxidase subunit VIc gene (COX6C), or a mammalian N-acylsphingosine ami-dohydrolase (acid ceramidase) 1 gene (ASAH1) or from a variant thereof, most preferably from a human ribosomal protein Large 32 gene (RPL32), a human ribosomal protein Large 35 gene (RPL35), a human ribosomal protein Large 21 gene (RPL21), a human ATP synthase, H+ transporting, mitochondrial F1 complex, alpha subunit 1, cardiac muscle (ATP5A1) gene, a human hydroxysteroid (17-beta) dehydrogenase 4 gene (HSD17B4), a human androgen-induced 1 gene (AIG1), a human cytochrome c oxidase subunit VIc gene (COX6C), or a human N-acylsphingosine amidohydrolase (acid ceramidase) 1 gene (ASAH1) or from a variant thereof, wherein preferably the 5'-UTR element does not comprise the 5'-TOP of said gene.

Accordingly, in preferred embodiments, the artificial nucleic acid of the invention, particularly the RNA as defined herein comprises at least one heterologous 5'-UTR, wherein the at least one heterologous 5'-UTR element comprises a nucleic acid sequence which is derived from a 5'-UTR of a TOP gene encoding a ribosomal Large protein (RPL), preferably RPL32 or RPL35A, or from a gene selected from the group consisting of HSD17B4, ATP5A1, AIG1, ASAH1, COX6C or ABCB7 (MDR), or from a homolog, a fragment or variant of any one of these genes, preferably lacking the 5'-TOP motif.

The 5'-UTR element may comprise or consist of a nucleic acid sequence, which has an identity of at least about 40%, 50%, 60%, 70%, 80%, 90%, 95%, preferably of at least about 99% to the nucleic acid sequence according to SEQ ID NO: 1 or 2, or more preferably to a corresponding RNA sequence according to SEQ ID NO: 2, wherein, preferably, the fragment is as described above, i.e. being a continuous stretch of nucleotides representing at least 20% etc. of the full-length 5'-UTR. Preferably, the fragment exhibits a length of at least about 20 nucleotides or more, preferably of at least about 30 nucleotides or more, more preferably of at least about 40 nucleotides or more. Preferably, the fragment is a functional fragment as described herein.

Accordingly, in preferred embodiments, the artificial nucleic acid of the invention, preferably the RNA comprises at least one 5-UTR element, preferably a heterologous 5'-UTR element, wherein the 5'-UTR element comprises a nucleic acid sequence derived from a 5'-UTR of a RPL32 gene, preferably comprising the corresponding RNA sequence of the nucleic acid sequence according to SEQ ID NOs: 1 or 2, or a fragment or variant of any of these sequences.

In embodiment, the 5'-UTR element comprises or consists of a nucleic acid sequence, which has an identity of at least about 40%, 50%, 60%, 70%, 80%, 90%, 95%, preferably of at least about 99% to the nucleic acid sequence according to SEQ ID NOs: 1412-1420 of the patent application WO2013/143700, or a corresponding RNA sequence or wherein the at least one 5-UTR element comprises or consists of a fragment of a nucleic acid sequence which has an identity of at least about 40%, 50%, 60%, 70%, 80%, 90%, 95%, preferably of at least about 99% to the nucleic acid sequence according SEQ ID NOs: 1412-1420 of the patent application WO2013/143700, wherein, preferably, the fragment is as described above, i.e. being a continuous stretch of nucleotides representing at least 20% etc. of the full-length 5'-UTR. Preferably, the fragment exhibits a length of at least about 20 nucleotides or more, preferably of at least about 30 nucleotides or more, more preferably of at least about 40 nucleotides or more. Preferably, the fragment is a functional fragment as described herein.

Accordingly, in a particularly preferred embodiment, the 5'-UTR element comprises or consists of a nucleic acid sequence, which has an identity of at least about 40%, 50%, 60%, 70%, 80%, 90%, 95%, preferably of at least about 99% to the nucleic acid sequence according to SEQ ID NO: 1414 of the patent application WO2013/143700 or preferably to a corresponding RNA sequence, or wherein the at least one 5'-UTR element comprises or consists of a fragment of a nucleic acid sequence which has an identity of at least about 40%, 50%, 60%, 70%, 80%, 90%, 95%, preferably of at least about 99% to the nucleic acid sequence according to SEQ ID NO: 1414 of the patent application WO2013/143700, wherein, preferably, the fragment is as described above, i.e. being a continuous stretch of nucleotides representing at least 20% etc. of the full-length 5'-UTR. Preferably, the fragment exhibits a length of at least about 20 nucleotides or more, preferably of at least about 30 nucleotides or more, more preferably of at least about 40 nucleotides or more. Preferably, the fragment is a functional fragment as described herein.

In a preferred embodiment, the 5'-UTR element comprises or consists of a nucleic acid sequence, according SEQ ID NO: 1368 of the patent application WO2013/143700, or preferably to a corresponding RNA sequence, or fragments or variants thereof. In another preferred embodiment, the 5'-UTR element comprises or consists of a nucleic acid sequence according to SEQ ID NOs: 1412-1420 of the patent application WO2013/43700, or a corresponding RNA sequence, or fragments or variants thereof.

In embodiments the artificial nucleic acid comprises at least one heterologous 5'-UTR element, wherein the at least one heterologous 5'-UTR element comprises a nucleic acid sequence derived from a 5'-UTR of gene selected from HSD17B4, ASAH1, ATP5A1, MP68, NDUFA4, NOSIP, RPL31, SLC7A3, TUBB4B, and UBQLN2, or from a homolog, a fragment or variant of any one of these genes.

HSD17B4-derived 5-UTR: The artificial nucleic acid may comprise a 5'-UTR derived from a 5'-UTR of a gene encoding a 17-beta-hydroxysteroid dehydrogenase 4, or a homolog, variant, fragment or derivative thereof, preferably lacking the TOP motif. Such 5'-UTRs preferably comprise or consist of a nucleic acid sequence derived from the 5'-UTR of a 17-beta-hydroxysteroid dehydrogenase 4 gene, preferably from a vertebrate, more preferably mammalian, most preferably human 17-beta-hydroxysteroid dehydrogenase 4 (HSD17B4) gene, or a homolog, variant, fragment or derivative thereof, wherein preferably the 5'-UTR does not comprise the TOP motif of said gene. Accordingly, the RNA may comprise a 5'-UTR derived from a HSD17B4 gene, wherein said 5'-UTR derived from a HSD17B4 gene comprises or consists of a nucleic acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 17488 or 17489 or a fragment or a variant thereof.

ASAH1-derived 5-UTR: The artificial nucleic acid may comprise a 5'-UTR derived from a 5'-UTR of a gene encoding acid ceramidase (ASAH1), or a homolog, variant, fragment or derivative thereof. Such 5'-UTRs preferably comprise or consist of a nucleic acid sequence derived from the 5'-UTR of an acid ceramidase (ASAH1) gene, preferably from a vertebrate, more preferably mammalian, most preferably human acid ceramidase (ASAH1) gene, or a homolog, variant, fragment or derivative thereof. Accordingly, the RNA may comprise a 5'-UTR derived from a ASAH1 gene, wherein said 5'-UTR derived from a ASAH1 gene comprises or consists of a nucleic acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 17490 or 17491 or a fragment or a variant thereof.

ATP5A1-derived 5'-UTR: The artificial nucleic acid may comprise a 5'-UTR which is derived from a 5'-UTR of a gene encoding mitochondrial ATP synthase subunit alpha (ATP5A1), or a homolog, variant, fragment or derivative thereof, wherein said 5'-UTR preferably lacks the TOP motif. Such 5'-UTRs preferably comprise or consist of a nucleic acid sequence derived from the 5'-UTR of a mitochondrial ATP synthase subunit alpha (ATP5A1) gene, preferably from a vertebrate, more preferably a mammalian and most preferably a human mitochondrial ATP synthase subunit alpha (ATP5A1) gene, or a homolog, variant, fragment or derivative thereof, wherein the 5'-UTR preferably does not comprise the TOP motif of said gene. Accordingly, the RNA may comprise a 5'-UTR derived from a ATP5A1 gene, wherein said 5'-UTR derived from a ATP5A1 gene comprises or consists of a nucleic acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 17492 or 17493 or a fragment or a variant thereof.

MP68-derived 5-UTR: The artificial nucleic acid may comprise a 5'-UTR which is derived from a 5'-UTR of a gene encoding MP68, or a homolog, fragment or variant thereof. Such 5'-UTRs preferably comprise or consist of a nucleic acid sequence derived from the 5'-UTR of a 6.8 kDa mitochondrial proteolipid (MP68) gene, preferably from a vertebrate, more preferably a mammalian 6.8 kDa mitochondrial proteolipid (MP68) gene, or a homolog, variant, fragment or derivative thereof. Accordingly, the RNA may comprise a 5'-UTR derived from a MP68 gene, wherein said 5'-UTR derived from a MP68 gene comprises or consists of a nucleic acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 17494 or 17495 or a fragment or a variant thereof.

NDUFA4-derived 5-UTR: The artificial nucleic acid may comprise a 5'-UTR which is derived from a 5'-UTR of a gene encoding a Cytochrome c oxidase subunit (NDUFA4), or a homolog, fragment or variant thereof. Such 5'-UTRs preferably comprise or consist of a nucleic acid sequence derived from the 5-UTR of a Cytochrome c oxidase subunit (NDUFA4) gene, preferably from a vertebrate, more preferably a mammalian Cytochrome c oxidase subunit (NDUFA4) gene, or a homolog, variant, fragment or derivative thereof. Accordingly, the RNA may comprise a 5'-UTR derived from a NDUFA4 gene, wherein said 5'-UTR derived from a NDUFA4 gene comprises or consists of a nucleic acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 17496 or 17497 or a fragment or a variant thereof.

NOSIP-derived 5-UTR: The artificial nucleic acid may comprise a 5'-UTR which is derived from a 5'-UTR of a gene encoding a Nitric oxide synthase-interacting (NOSIP) protein, or a homolog, variant, fragment or derivative thereof. Such 5'-UTRs preferably comprise or consist of a nucleic acid sequence derived from the 5'-UTR of a Nitric oxide synthase-interacting protein (NOSIP) gene, preferably from a vertebrate, more preferably a mammalian, most preferably a human Nitric oxide synthase-interacting protein (NOSIP) gene, or a homolog, variant, fragment or derivative thereof. Accordingly, the RNA may comprise a 5'-UTR derived from a NOSIP gene, wherein said 5'-UTR derived from a NOSIP gene comprises or consists of a nucleic acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 17498 or 17499 or a fragment or a variant thereof.

RPL31-derived 5-UTR: The artificial nucleic acid may comprise a 5'-UTR which is derived from a 5'-UTR of a gene encoding a 60S ribosomal protein L31, or a homolog, variant, fragment or derivative thereof, wherein said 5'-UTR preferably lacks the TOP motif. Such 5'-UTR preferably comprise or consist of a nucleic acid sequence derived from the 5'-UTR of a 60S ribosomal protein L31 (RPL31) gene, preferably from a vertebrate, more preferably a mammalian 60S ribosomal protein L31 (RPL31) gene, or a homolog, variant, fragment or derivative thereof, wherein the 5'-UTR preferably does not comprise the TOP motif of said gene. Accordingly, the RNA may comprise a 5'-UTR derived from a RPL31 gene, wherein said 5'-UTR derived from a RPL31 gene comprises or consists of a nucleic acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 17500 or 17501 or a fragment or a variant thereof.

SLC7A3-derived 5-UTR: The artificial nucleic acid may comprise a 5'-UTR which is derived from a 5'-UTR of a gene encoding a cationic amino acid transporter 3 (solute carrier family 7 member 3, SLC7A3) protein, or a homolog, variant, fragment or derivative thereof. Such 5'-UTRs preferably comprise or consist of a nucleic acid sequence derived from the 5'-UTR of a cationic amino acid transporter 3 (SLC7A3) gene, preferably from a vertebrate, more preferably a mammalian cationic amino acid transporter 3 (SLC7A3) gene, or a homolog, variant, fragment or derivative thereof. Accordingly, the RNA may comprise a 5'-UTR derived from a SLC7A3 gene, wherein said 5'-UTR derived from a SLC7A3 gene comprises or consists of a nucleic acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 17502 or 17503 or a fragment or a variant thereof.

TUBB4B-derived 5'-UTR: The artificial nucleic acid may comprise a 5'-UTR which is derived from a 5'-UTR of a gene encoding a tubulin beta-4 chain (TUBB4B) protein, or a homolog, variant, fragment or derivative thereof. Such 5'-UTRs preferably comprise or consist of a nucleic acid sequence derived from the 5'-UTR of a tubulin beta-4B chain (TUBB4B) gene, preferably from a vertebrate, more preferably a mammalian and most preferably a human tubulin beta-4B chain (TUBB4B) gene, or a homolog, variant, fragment or derivative thereof. Accordingly, the RNA may comprise a 5'-UTR derived from a TUBB4B gene, wherein said 5'-UTR derived from a TUBB4B gene comprises or consists of a nucleic acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 17504 or 17505 or a fragment or a variant thereof.

UBQLN2-derived 5-UTR: The artificial nucleic acid may comprise a 5'-UTR which is derived from a 5'-UTR of a gene encoding an ubiquilin-2 (UBQLN2) protein, or a homolog, variant, fragment or derivative thereof. Such 5'-UTRs preferably comprise or consist of a nucleic acid sequence derived from the 5'-UTR of an ubiquilin-2 (UBQLN2) gene, preferably from a vertebrate, more preferably a mammalian ubiquilin-2 (UBQLN2) gene, or a homolog, variant, fragment or derivative thereof. Accordingly, the RNA may comprise a 5'-UTR derived from a UBQLN2 gene, wherein said 5'-UTR derived from a UBQLN2 gene comprises or consists of a nucleic acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 17506 or 17507 or a fragment or a variant thereof.

In embodiments, the artificial nucleic acid as defined herein, particularly the RNA as defined herein comprises a 5'-UTR element, which may be any 5'-UTR element described in WO2016/107877. In this context, the disclosure of WO2016/107877 relating to 5'-UTR elements/sequences is herewith incorporated by reference. Particularly preferred 5'-UTR elements are nucleic acid sequences according to SEQ ID NOs: 25 to 30 and SEQ ID NOs: 319 to 382 of the patent application WO2016/07877, or fragments or variants of these sequences. In this context, it is particularly preferred that the 5'-UTR element of the RNA sequence according to the present invention comprises or consists of a corresponding RNA sequence of the nucleic acid sequence according SEQ ID NOs: 25 to 30 and SEQ ID NOs: 319 to 382 of the patent application WO2016/07877.

In embodiments, the artificial nucleic acid sequence as defined herein, particularly the RNA as defined herein comprises a 5'-UTR element, which may be any 5'-UTR element as described in WO2017/036580. In this context, the disclosure of WO2017/036580 relating to 5'-UTR elements/sequences is herewith incorporated by reference. Particularly preferred 5'-UTR elements are nucleic acid sequences according to SEQ ID NOs: 1 to 151 of the patent application WO2017/036580, or fragments or variants of these sequences. In this context, it is particularly preferred that the 5'-UTR element of the RNA sequence according to the present invention comprises or consists of a corresponding RNA sequence of the nucleic acid sequence according to SEQ ID NOs: 1 to 151 of the patent application WO2017/036580.

Preferably, the at least one 5'-UTR element as defined herein and the at least one 3-UTR element as defined herein act synergistically to increase protein production from the at least one RNA sequence as described above.

Accordingly, in a preferred embodiment of the first aspect, the artificial nucleic acid, in particular the RNA comprises at least one coding sequence encoding at least one antigenic peptide or protein as defined herein or a fragment or variant thereof, wherein said coding sequence is operably linked to 5'-UTR and/or 3'-UTR, comprising a-1. at least one 5'-UTR derived from a 5'-UTR of a HSD1764 gene, or from a corresponding RNA sequence, homolog, fragment or variant thereof and at least one 3'-UTR derived from a 3'-UTR of a PSMB3 gene, or from a corresponding RNA sequence, homolog, fragment or variant thereof; or a-2. at least one 5'-UTR derived from a 5'-UTR of a NDUFA4 gene, or from a corresponding RNA sequence, homolog, fragment or variant thereof and at least one 3'-UTR derived from a 3'-UTR of a PSMB3 gene, or from a corresponding RNA sequence, homolog, fragment or variant thereof; or b-4. at least one 5'-UTR derived from a 5'-UTR of a HSD17B4 gene, or from a corresponding RNA sequence, homolog, fragment or variant thereof and at least one 3'-UTR derived from a 3'-UTR of a CASP1 gene, or from a corresponding RNA sequence, homolog, fragment or variant thereof; or a-3. at least one 5'-UTR derived from a 5'-UTR of a SLC7A3 gene, or from a corresponding RNA sequence, homolog, fragment or variant thereof and at least one 3'-UTR derived from a 3'-UTR of a PSMB3 gene, or from a corresponding RNA sequence, homolog, fragment or variant thereof or a-4. at least one 5'-UTR from a 5'-UTR of a NOSIP gene, or from a corresponding RNA sequence, homolog, fragment or variant thereof and at least one 3'-UTR derived from a 3-UTR of a PSMB3 gene, or from a corresponding RNA sequence, homolog, fragment or variant thereof; or a-5. at least one 5'-UTR derived from a 5'-UTR of a MP68 gene, or from a corresponding RNA sequence, homolog, fragment or variant thereof and at least one 3'-UTR derived from a 3'-UTR of a PSMB3 gene, or from a corresponding RNA sequence, homolog, fragment or variant thereof; or b-1. at least one 5'-UTR derived from a 5'-UTR of a UBQLN2 gene, or from a corresponding RNA sequence, homolog, fragment or variant thereof and at least one 3'-UTR derived from a 3'-UTR of a RPS9 gene, or from a corresponding RNA sequence, homolog, fragment or variant thereof; or b-2. at least one 5'-UTR derived from a 5'-UTR of a ASAH1 gene, or from a corresponding RNA sequence, homolog, fragment or variant thereof and at least one 3'-UTR derived from a 3-UTR of a RPS9 gene, or from a corresponding RNA sequence, homolog, fragment or variant thereof; or b-3. at least one 5'-UTR derived from a 5'-UTR of a HSD17B4 gene, or from a corresponding RNA sequence, homolog, fragment or variant thereof and at least one 3'-UTR derived from a 3'-UTR of a RPS9 gene, or from a corresponding RNA sequence, homolog, fragment or variant thereof; or b-5. at least one 5'-UTR derived from a 5'-UTR of a NOSIP gene, or from a corresponding RNA sequence, homolog, fragment or variant thereof and at least one 3'-UTR derived from a 3'-UTR of a COX6B1 gene, or from a corresponding RNA sequence, homolog, fragment or variant thereof; or c-1. at least one 5'-UTR derived from a 5'-UTR of a NDUFA4 gene, or from a corresponding RNA sequence, homolog, fragment or variant thereof and at least one 3'-UTR derived from a 3'-UTR of a RPS9 gene, or from a corresponding RNA sequence, homolog, fragment or variant thereof; or c-2. at least one 5'-UTR derived from a 5'-UTR of a NOSIP gene, or from a corresponding RNA sequence. homolog, fragment or variant thereof and at least one 3'-UTR derived from a 3'-UTR of a NDUFA1 gene, or from a corresponding RNA sequence, homolog, fragment or variant thereof; or c-3. at least one 5'-UTR derived from a 5'-UTR of a NDUFA4 gene, or from a corresponding RNA sequence, homolog, fragment or variant thereof and at least one 3'-UTR derived from a 3'-UTR of a COX6B1 gene, or from a corresponding RNA sequence, homolog, fragment or variant thereof; or c-4. at least one 5'-UTR derived from a 5'-UTR of a NDUFA4 gene, or from a corresponding RNA sequence, homolog, fragment or variant thereof and at least one 3'-UTR derived from a 3'-UTR of a NDUFA1 gene, or from a corresponding RNA sequence, homolog, fragment or variant thereof; or c-5. at least one 5'-UTR derived from a 5'-UTR of a ATP5A1 gene, or from a corresponding RNA sequence, homolog, fragment or variant thereof and at least one 3'-UTR derived from a 3'-UTR of a PSMB3 gene, or from a corresponding RNA sequence, homolog, fragment or variant thereof; or d-1. at least one 5'-UTR derived from a 5'-UTR of a RPL31 gene, or from a corresponding RNA sequence, homolog, fragment or variant thereof and at least one 3'-UTR derived from a 3'-UTR of a PSMB3 gene, or from a corresponding RNA sequence, homolog, fragment or variant thereof or d-2. at least one 5'-UTR derived from a 5'-UTR of a ATP5A1 gene, or from a corresponding RNA sequence, homolog, fragment or variant thereof and at least one 3'-UTR derived from a 3'-UTR of a CASP1 gene, or from a corresponding RNA sequence, homolog, fragment or variant thereof; or d-3. at least one 5'-UTR derived from a 5'-UTR of a SLC7A3 gene, or from a corresponding RNA sequence, homolog, fragment or variant thereof and at least one 3'-UTR derived from a 3'-UTR of a GNAS gene, or from a corresponding RNA sequence, homolog, fragment or variant thereof; or d-4. at least one 5'-UTR derived from a 5'-UTR of a HSD17B4 gene, or from a corresponding RNA sequence, homolog, fragment or variant thereof and at least one 3'-UTR derived from a 3'-UTR of a NDUFA1 gene, or from a corresponding RNA sequence, homolog, fragment or variant thereof; or d-5. at least one 5'-UTR derived from a 5'-UTR of a SLC7A3 gene, or from a corresponding RNA sequence, homolog, fragment or variant thereof and at least one 3'-UTR derived from a 3'-UTR of a NDUFA1 gene, or from a corresponding RNA sequence, homolog, fragment or variant thereof; or e-1. at least one 5'-UTR derived from a 5'-UTR of a TUBB4B gene, or from a corresponding RNA sequence, homolog, fragment or variant thereof and at least one 3'-UTR derived from a 3'-UTR of a RPS9 gene, or from a corresponding RNA sequence, homolog, fragment or variant thereof; or e-2. at least one 5'-UTR derived from a 5'-UTR of a RPL31 gene, or from a corresponding RNA sequence, homolog, fragment or variant thereof and at least one 3'-UTR derived from a 3'-UTR of a RPS9 gene, or from a corresponding RNA sequence, homolog, fragment or variant thereof; or e-3. at least one 5'-UTR derived from a 5'-UTR of a MP68 gene, or from a corresponding RNA sequence, homolog, fragment or variant thereof and at least one 3'-UTR derived from a 3'-UTR of a RPS9 gene, or from a corresponding RNA sequence, homolog, fragment or variant thereof; or e-4. at least one 5'-UTR derived from a 5'-UTR of a NOSIP gene, or from a corresponding RNA sequence, homolog, fragment or variant thereof and at least one 3'-UTR derived from a 3'-UTR of a RPS9 gene, or from a corresponding RNA sequence, homolog, fragment or variant thereof; or e-5. at least one 5'-UTR derived from a 5'-UTR of a ATP5A1 gene, or from a corresponding RNA sequence, homolog, fragment or variant thereof and at least one 3'-UTR derived from a 3'-UTR of a RPS9 gene, or from a corresponding RNA sequence, homolog, fragment or variant thereof; or e-6. at least one 5'-UTR derived from a 5'-UTR of a ATP5A1 gene, or from a corresponding RNA sequence, homolog, fragment or variant thereof and at least one 3'-UTR derived from a 3'-UTR of a COX6B1 gene, or from a corresponding RNA sequence, homolog, fragment or variant thereof; or f-1. at least one 5'-UTR derived from a 5'-UTR of a ATP5A1 gene, or from a corresponding RNA sequence, homolog, fragment or variant thereof and at least one 3'-UTR derived from a 3'-UTR of a GNAS gene, or from a corresponding RNA sequence, homolog, fragment or variant thereof; or f-2. at least one 5'-UTR derived from a 5'-UTR of a ATP5A1 gene, or from a corresponding RNA sequence, homolog, fragment or variant thereof and at least one 3'-UTR derived from a 3'-UTR of a NDUFA1 gene, or from a corresponding RNA sequence, homolog, fragment or variant thereof- or f-3. at least one 5'-UTR derived from a 5'-UTR of a HSD17B4 gene, or from a corresponding RNA sequence, homolog, fragment or variant thereof and at least one 3'-UTR derived from a 3'-UTR of a COX6B1 gene, or from a corresponding RNA sequence, homolog, fragment or variant thereof; or f-4. at least one 5'-UTR derived from a 5'-UTR of a HSD17B4 gene, or from a corresponding RNA sequence, homolog, fragment or variant thereof and at least one 3'-UTR derived from a 3-UTR of a GNAS gene, or from a corresponding RNA sequence, homolog, fragment or variant thereof; or f-5. at least one 5'-UTR derived from a 5'-UTR of a MP68 gene, or from a corresponding RNA sequence, homolog, fragment or variant thereof and at least one 3'-UTR derived from a 3'-UTR of a COX6B1 gene, or from a corresponding RNA sequence, homolog, fragment or variant thereof; or g-1. at least one 5'-UTR derived from a 5'-UTR of a MP68 gene, or from a corresponding RNA sequence, homolog, fragment or variant thereof and at least one 3'-UTR derived from a 3'-UTR of a NDUFA1 gene, or from a corresponding RNA sequence, homolog, fragment or variant thereof; or g-2. at least one 5'-UTR derived from a 5'-UTR of a NDUFA4 gene, or from a corresponding RNA sequence, homolog, fragment or variant thereof and at least one 3'-UTR derived from a 3'-UTR of a CASP1 gene, or from a corresponding RNA sequence, homolog, fragment or variant thereof; or g-3. at least one 5'-UTR derived from a 5'-UTR of a NDUFA4 gene, or from a corresponding RNA sequence, homolog, fragment or variant thereof and at least one 3'-UTR derived from a 3'-UTR of a GNAS gene, or from a corresponding RNA sequence, homolog, fragment or variant thereof; or g-4. at least one 5'-UTR derived from a 5'-UTR of a NOSIP gene, or from a corresponding RNA sequence, homolog, fragment or variant thereof and at least one 3-UTR derived from a 3'-UTR of a CASP1 gene, or from a corresponding RNA sequence, homolog, fragment or variant thereof; or g-5. at least one 5'-UTR derived from a 5'-UTR of a RPL31 gene, or from a corresponding RNA sequence, homolog, fragment or variant thereof and at least one 3'-UTR derived from a 3'-UTR of a CASP1 gene, or from a corresponding RNA sequence, homolog, fragment or variant thereof; or
- h-1. at least one 5'-UTR derived from a 5'-UTR of a RPL31 gene, or from a corresponding RNA sequence, homolog, fragment or variant thereof and at least one 3'-UTR derived from a 3'-UTR of a COX8B1 gene, or from a corresponding RNA sequence, homolog, fragment or variant thereof; or
- h-2. at least one 5'-UTR derived from a 5'-UTR of a RPL31 gene, or from a corresponding RNA sequence, homolog, fragment or variant thereof and at least one 3'-UTR derived from a 3'-UTR of a GNAS gene, or from a corresponding RNA sequence, homolog, fragment or variant thereof; or
- h-3. at least one 5'-UTR derived from a 5'-UTR of a RPL31 gene, or from a corresponding RNA sequence, homolog, fragment or variant thereof and at least one 3'-UTR derived from a 3'-UTR of a NDUFA1 gene, or from a corresponding RNA sequence, homolog, fragment or variant thereof; or
- h-4. at least one 5'-UTR derived from a 5'-UTR of a SLC7A3 gene, or from a corresponding RNA sequence, homolog, fragment or variant thereof and at least one 3'-UTR derived from a 3'-UTR of a CASP1 gene, or from a corresponding RNA sequence, homolog, fragment or variant thereof; or
- h-5. at least one 5'-UTR derived from a 5'-UTR of a SLC7A3 gene, or from a corresponding RNA sequence, homolog, fragment or variant thereof and at least one 3'-UTR derived from a 3'-UTR of a COX6B1 gene, or from a corresponding RNA sequence, homolog, fragment or variant thereof; or
- i-1. at least one 5'-UTR derived from a 5'-UTR of a SLC7A3 gene, or from a corresponding RNA sequence, homolog, fragment or variant thereof and at least one 3-UTR derived from a 3'-UTR of a RPS9 gene, or from a corresponding RNA sequence, homolog, fragment or variant thereof.
- i-2. at least one 5'-UTR derived from a 5'-UTR of a RPL32 gene, or from a corresponding RNA sequence, homolog, fragment or variant thereof and at least one 3'-UTR derived from a 3'-UTR of a ALB7 gene, or from a corresponding RNA sequence, homolog, fragment or variant thereof.
- i-3. at least one 3'-UTR derived from a 3'-UTR of a alpha-globin gene gene, or from a corresponding RNA sequence, homolog, fragment or variant thereof.

Suitably, the artificial nucleic acid, particularly the RNA comprises at least one coding sequence encoding at least one antigenic peptide or protein as specified herein operably linked to a 3'-UTR and/or a 5'-UTR selected from a-1 (HSD17B4/PSMB3), a-2 (NDUFA4/PSMB3), a-3 (SLC7A3/PSMB3), a-4 (NOSIP/PSMB3), a-5 (MP68/PSMB3), b-1 (UBQLN2/RPS9), b-2 (ASAH1/RPS9), b-3 (HSD17B4/RPS9), b-4 (HSD17B4/CASP1), b-5 (NOSIP/COX6B1), c-1 (NDUFA4/RPS9), c-2 (NOSIP/NDUFA1), c-3 (NDUFA4/COX6B1), c-4 (NDUFA4/NDUFA1), c-5 (ATP5A1/PSMB3), d-1 (Rpl31/PSMB3), d-2 (ATP5A1/CASP1), d-3 (SLC7A3/GNAS), d-4 (HSD17B4/NDUFA1), d-5 (Slc7a3/Ndufa1), e-1 (TUBB4B/RPS9), e-2 (RPL31/RPS9), e-3 (MP68/RPS9), e-4 (NOSIP/RPS9), e-5 (ATP5A1/RPS9), e-6 (ATP5A1/COX6B1), f-1 (ATP5A1/GNAS), f-2 (ATP5A1/NDUFA1), f-3 (HSD17B4/COX6B1), f-4 (HSD17B4/GNAS), f-5 (MP68/COX6B1), g-1 (MP68/NDUFA1), g-2 (NDUFA4/CASP1), g-3 (NDUFA4/GNAS), g-4 (NOSIP/CASP1), g-5 (RPL31/CASP1), h-1 (RPL31/COX6B1), h-2 (RPL31/GNAS), h-3 (RPL31/NDUFA1), h-4 (Slc7a3/CASP1), h-5 (SLC7A3/COX6B1), i-1 (SLC7A3/RPS9), i-2 (RPL32/ALB7), or i-3 (α-globin gene).

Preferably, the artificial nucleic acid sequence, particularly the artificial RNA comprising at least one coding sequence as defined herein typically comprises a length of about 50 to about 20000, or 100 to about 20000 nucleotides, preferably of about 250 to about 20000 nucleotides, more preferably of about 500 to about 10000, even more preferably of about 500 to about 5000.

According to a further embodiment, the nucleic acid sequence according to the invention is an artificial nucleic acid sequence as defined herein.

In a preferred embodiment, the artificial nucleic acid is an artificial RNA, preferably an artificial mRNA.

The terms "RNA" and "mRNA" will be recognized and understood by the person of ordinary skill in the art, and are for example intended to be a ribonucleic acid molecule, i.e. a polymer consisting of nucleotides. These nucleotides are usually adenosine-monophosphate, uridine-monophosphate, guanosine-monophosphate and cytidine-monophosphate monomers which are connected to each other along a so-called backbone. The backbone is formed by phosphodiester bonds between the sugar, i.e. ribose, of a first and a phosphate moiety of a second, adjacent monomer. The specific succession of the monomers is called the RNA-sequence. Usually RNA may be obtainable by transcription of a DNA-sequence, e.g., inside a cell. In eukaryotic cells, transcription is typically performed inside the nucleus or the mitochondria. The mRNA (messenger RNA) usually provides the nucleotide sequence that may be translated into an amino-acid sequence of a particular peptide or protein. Typically, a mature mRNA comprises a 5'-cap, a 5'-UTR, a coding sequence, a 3'-UTR and a poly(A) sequence. Aside from messenger RNA, several non-coding types of RNA exist which may be involved in regulation of transcription and/or translation. In the context of the invention, the terms "RNA" and "mRNA" refer to synthetic nucleic acid molecules obtainable by e.g. RNA in vitro transcription or chemical RNA synthesis. The term "RNA" further encompasses RNA molecules, such as viral RNA, retroviral RNA and replicon RNA. In the context of the invention, RNA is a coding RNA, including mRNA and replicon RNA as defined herein.

In an embodiment, the artificial nucleic acid is an artificial RNA, preferably a replicon RNA.

The term "replicon RNA" will be recognized and understood by the person of ordinary skill in the art, and are for example intended to be optimized self-replicating artificial RNA constructs. Such constructs include replication elements (replicase) derived from alphaviruses and the substitution of the structural virus proteins with the artificial nucleic acid of interest (in the context of the invention, an artificial nucleic acid comprising at least one coding sequence encoding at least one antigenic amino acid sequence derived from a virus of the order Bunyavirales). Alternatively, the replicase may be provided on an independent construct comprising a replicase RNA sequence derived from e.g. Semliki forest virus (SFV), Sindbis virus (SIN), Venezuelan equine Encephalitis virus (VEE), Ross-River virus (RRV), or other viruses belonging to the alphavirus family. Downstream of the replicase lies a sub-genomic promoter that controls replication of the artificial nucleic acid of the invention, i.e. an artificial nucleic acid comprising at least one coding sequence encoding at least one antigenic amino acid sequence derived from a virus of the order Bunyavirales.

The artificial nucleic acid as defined herein, particularly the RNA as defined herein may be modified by the addition of a 5'-cap structure, which preferably stabilizes the nucleic acid as described herein.

The term "5'-cap structure" as used herein will be recognized and understood by the person of ordinary skill in the art, and is for example intended to refer to a modified nucleotide (cap analogue), particularly a guanine nucleotide, added to the 5'-end of a nucleic acid molecule, particularly of an RNA molecule, e.g. an mRNA molecule. Preferably, the 5'-cap is added using a 5'-5'-triphosphate linkage (also named m7GpppN). Further examples of 5'-cap structures include glyceryl, inverted deoxy abasic residue (moiety), 4',5' methylene nucleotide, 1-(beta-D-erythrofuranosyl) nucleotide, 4'-thio nucleotide, carbocyclic nucleotide, 1,5-anhydrohexitol nucleotide, L-nucleotides, alpha-nucleotide, modified base nucleotide, threo-pentofuranosyl nucleotide, acyclic 3',4'-seco nucleotide, acyclic 3,4-dihydroxybutyl nucleotide, acyclic 3,5 dihydroxypentyl nucleotide, 3'-3'-inverted nucleotide moiety, 3'-3'-inverted abasic moiety, 3'-2-inverted nucleotide moiety, 3'-2'-inverted abasic moiety, 1,4-butanediol phosphate, 3'-phosphoramidate, hexylphosphate, aminohexyl phosphate, 3'-phosphate, 3'phosphorothioate, phosphorodithioate, or bridging or non-bridging methylphosphonate moiety. Further modified 5'-cap structures which may be used in the context of the present invention are cap1 (additional methylation of the ribose of the adjacent nucleotide of m7GpppN), cap2 (additional methylation of the ribose of the 2nd nucleotide downstream of the m7GpppN), cap3 (additional methylation of the ribose of the 3rd nucleotide downstream of the m7GpppN), cap4 (additional methylation of the ribose of the 4th nucleotide downstream of the m7GpppN), ARCA (anti-reverse cap analogue), modified ARCA (e.g. phosphothioate modified ARCA), inosine, N1-methyl-guanosine, 2'-fluoro-guanosine, 7-deaza-guanosine, 8-oxo-guanosine, 2-amino-guanosine, LNA-guanosine, and 2-azido-guanosine.

A 5'-cap (cap0 or cap1) structure may also be formed in chemical RNA synthesis or RNA in vitro transcription (co-transcriptional capping) using cap analogues.

The term "cap analogue" as used herein will be recognized and understood by the person of ordinary skill in the art, and is for example intended to refer to a non-polymerizable di-nucleotide that has cap functionality in that it facilitates translation or localization, and/or prevents degradation of a nucleic acid molecule, particularly of an RNA molecule, when incorporated at the 5'-end of the nucleic acid molecule. Non-polymerizable means that the cap analogue will be incorporated only at the 5'-terminus because it does not have a 5' triphosphate and therefore cannot be extended in the 3'-direction by a template-dependent polymerase, particularly, by template-dependent RNA polymerase. Examples of cap analogues include, but are not limited to, a chemical structure selected from the group consisting of m7GpppG, m7GpppA, m7GpppC; unmethylated cap analogues (e.g. GpppG); dimethylated cap analogue (e.g. m2,7GpppG), trimethylated cap analogue (e.g. m2,2,7GpppG), dimethylated symmetrical cap analogues (e.g. m7Gpppm7G), or anti reverse cap analogues (e.g. ARCA; m7,2'OmeGpppG, m7,2'dGpppG, m7,3'OmeGpppG, m7,3'dGpppG and their tetraphosphate derivatives). Further cap analogues have been described previously (WO2008/016473, WO2008/157688, WO2009/149253, WO2011015347, and WO2013/059475). Further suitable cap analogons in that context are described in WO2017/066793, WO2017/066781, WO2017/066791, WO2017/066789, WO2017/066782, and WO2017/066797, and WO2018075827 wherein the disclosures referring to cap analogons are incorporated herewith by reference.

In embodiments, a modified cap1 structure is generated using a cap analogue as disclosed in WO2017/053297, WO2017/066793, WO2017/068781, WO2017/066791, WO2017/086789, WO2017/066782, WO2018075827 and WO2017/066797. In particular, any cap structures derivable from the structure disclosed in claim 1-5 of WO2017/053297 may be suitably used to co-transcriptionally generate a modified cap1 structure. Further, any cap structures derivable from the structure defined in claim 1 or claim 21 of WO2018075827 may be suitably used to co-transcriptionally generate a modified cap1 structure.

Accordingly, in preferred embodiments, the artificial nucleic acid as defined herein, particularly the RNA as defined herein comprises a 5'-cap structure, preferably an m7G, cap0, cap1 or cap2 structure.

The 5'-cap structure may suitably be added co-transcriptionally using cap-analogues as defined herein in an RNA in vitro transcription reaction as defined herein.

In other embodiments, the 5'-cap structure is added via enzymatic capping using capping enzymes (e.g. vaccinia virus capping enzymes, commercially available capping kits) to generate cap0 or cap1 or cap2 structures. In other embodiments, the 5'-cap structure (cap0, cap1) is added via enzymatic capping using immobilized capping enzymes, e.g. in a capping reactor (WO 2016/193226).

It has to be understood that m7G (cap0), cap1 and cap2 are structures that naturally occur in RNA that has been transcribed by cellular polymerase II enzymes. Therefore these structures are not considered as modification in the context of the invention. Accordingly, a modified artificial nucleic acid, particularly an RNA as defined herein may additionally comprise at least one further modification as defined herein (e.g. modified nucleotides as defined above).

Accordingly, the artificial nucleic acid as defined herein, particularly the RNA may comprise a 5'-cap structure, preferably m7G (m7G(5')), m7G(5')ppp(5)(2'OMeA), or m7G(5)ppp(5)(2'OMeG).

Suitable mRNA Constructs:

Any of the above modifications may be applied to the artificial nucleic acid of the invention, in particular, to the DNA and/or RNA of the present invention, and further to any DNA or RNA as used in the context of the present invention and may be, if suitable or necessary, be combined with each other in any combination, provided, these combinations of modifications do not interfere with each other in the respective nucleic acid sequence. A person skilled in the art will be able to take his choice accordingly.

The artificial nucleic acid sequence according to the invention, particularly the artificial mRNA according to the present invention which comprises at least one coding sequence encoding at least one antigenic peptide or protein derived from at least one virus of the order Bunyavirales as defined herein may comprise a 5'-UTR and/or a 3'-UTR suitably containing at least one histone stem-loop. The 3'-UTR of the mRNA sequence according to the invention preferably comprises also a poly(A) and/or a poly(C) sequence as defined herein. The single elements of the 3'-UTR may occur therein in any order from 5' to 3' along the sequence of the mRNA sequence of the present invention. In addition, further elements as described herein, may also be contained, such as a stabilizing sequence as defined herein (e.g. derived from the UTR of a globin gene), IRES sequences, miRNA binding sites etc. Each of the elements may also be repeated in the mRNA sequence according to the invention at least once (particularly in multicistronic constructs), preferably twice or more.

Accordingly the artificial RNA of the invention, preferably the mRNA of the invention may suitably comprise, preferably in 5'- to 3'-direction, the following elements a)-i):
a) a 5'-cap structure preferably as defined herein;
b) optionally, a 5'-UTR element, preferably as defined herein;
c) at least one coding sequence, preferably as defined herein;
d) optionally, a 3'-UTR element, preferably as defined herein;
e) optionally, a poly(A) sequence, preferably as defined herein;
f) optionally, a poly(C) sequence, preferably as defined herein;
g) optionally a histone stem-loop, preferably as defined herein;
h) optionally, 3'-terminal sequence element as specified herein, preferably according to SEQ ID NOs: 17522-17541;
i) optionally, a poly(A) sequence, preferably obtained using enzymatic polyadenylation.

In further preferred embodiments the RNA comprises the following elements preferably in 5'- to 3'-direction:
a) 5'-cap structure, preferably as specified herein, most preferably m7G(5'), m7G(5')ppp(5'(2'OMeA), or m7G(5)ppp(5)(2'OMeG);
b) 3'-UTR and 5'-UTR element according to a-1, a-2, a-3, a-4, a-5, b-1, b-2, b-3, b-4, b-5, c-1, c-2, c-3, c-4, c-5, d-1, d-2, d-3, d-4, d-5, e-1, e-2, e-3, e-4, e-5, e-6, f-1, f-2, f-3, f-4, f-5, g-1, g-2, g-3, g-4, g-5, h-1, h-2, h-3, h-4, h-5, i-1, i-2, or i-3, as specified herein;
c) at least one coding sequence as specified herein, wherein said coding sequence is located between said 5'-UTR and said 3'-UTR, preferably downstream of said 5'-UTR and upstream of said 3'-UTR, wherein the coding sequence is preferably selected from any one specified herein;
d) optionally, poly(A) sequence, preferably as specified herein;
e) optionally, poly(C) sequence, preferably as specified herein;
f) optionally, histone stem-loop, preferably as specified herein;
g) optionally, 3'-terminal sequence element as specified herein, preferably according to according to SEQ ID NOs: 17522-17541.

In further preferred embodiments the RNA comprises the following elements preferably in 5'- to 3'-direction:
a) 5'-cap structure, preferably as specified herein, most preferably m7G(5'), m7G(5')ppp(5)(2'OMeA), or m7G(5)ppp(5)(2'OMeG);
b) 3'-UTR and 5'-UTR element according to a-1, a-2, a-3, a-4, a-5, b-1, b-2, b-3, b-4, b-5, c-1, c-2, c-3, c-4, c-5, d-1, d-2, d-3, d-4, d-5, e-1, e-2, e-3, e-4, e-5, e-6, f-1, f-2, f-3, f-4, f-5, g-1, g-2, g-3, g-4, g-5, h-1, h-2, h-3, h-4, h-5, i-1, i-2, or i-3, as specified herein;
c) at least one coding sequence as specified herein, wherein said coding sequence is located between said 5'-UTR and said 3'-UTR, preferably downstream of said 5'-UTR and upstream of said 3'-UTR, wherein the coding sequence is preferably selected from any one specified herein;
d) a 3'-terminal sequence element as specified herein, preferably according to according to SEQ ID NOs: 17522-17541.

In preferred embodiments, the artificial RNA of the invention, preferably the mRNA of the invention may suitably comprise, preferably in 5'- to 3'-direction, the following elements a)-h):
a) a 5'-cap structure as defined herein, preferably m7GpppN;
b) optionally, a 5'-UTR element as defined herein, preferably comprising or consisting of a nucleic acid sequence according to SEQ ID NO: 2, or a fragment or variant of any of these sequences;
c) at least one coding sequence as defined herein, comprising or consisting of a nucleic acid sequence according to SEQ ID NOs: 2569-16578, 16582-16644, 16648-16710, 16714-16776, 16780-16839, 16850-17089, 17095-17199, 17209-17424, 17428-17487 encoding a peptide or protein derived from a virus of the order Bunyavirales, or fragment or variant of any of these sequences; or comprising or consisting of a nucleic acid sequence according to SEQ ID NOs: 3028-3171, 4110-4321, 5363-5506, 6055-6198, 6747-6890, 7439-7582, 8131-8274, 9213-9424, 10856-11067, 12499-12710, 14142-14353, 15785-15996, 17095-17199 encoding a peptide or protein derived from a virus of the genus Orthobunyavirus; or fragment or variant of any of these sequences, or comprising or consisting of a nucleic acid sequence according to SEQ ID NOs: 2569-2922, 3261-3505, 4904-5257, 5596-5949, 6288-6641, 6980-7333, 7672-8025, 8364-8608, 10007-10251, 11650-11894, 13293-13537, 14936-15180, 16582-16644, 16648-16710, 16714-16776, 16800-16839 encoding a peptide or protein derived from a virus of the genus Orthohantavirus, or fragment or variant of any of these sequences; or comprising or consisting of a nucleic acid sequence according to SEQ ID NOs: 3172-3260, 4322-4903, 5507-5595, 6199-6287, 6891-6979, 7583-7671, 8275-8363, 9425-10006, 11068-11649, 12711-13292, 14354-14935, 15997-16578, 17209-17424, 17428-17487 encoding a peptide or protein derived from a virus of the genus Phlebovirus, or fragment or variant of any of these sequences; or comprising or consisting of a nucleic acid sequence according to SEQ ID NOs: 2923-3027, 3506-4109, 5258-5362, 5950-6054, 6642-6746, 7334-7438, 8026-8130, 8609-9212, 10252-10855, 11895-12498, 13538-14141, 15181-15784, 16850-17089 encoding a peptide or protein derived from a virus of the genus Orthonairovirus, or fragment or variant of any of these sequences;
d) optionally, a poly(A) sequence, as defined herein, preferably comprising 64 adenosines;
e) optionally, a 3'-UTR element as defined herein, preferably comprising or consisting of a nucleic acid sequence according to SEQ ID NOs: 10, 14 or 16, or a fragment or variant of any of these sequences;
f) optionally, a poly(C) sequence as defined herein, preferably comprising 30 cytosines:
g) optionally a histone stem-loop as defined herein, preferably comprising or consisting of a nucleic acid sequence according to SEQ ID NO: 18, or a fragment or variant of any of these sequences; and
h) optionally, a poly(A) sequence, preferably obtained using enzymatic polyadenylation.

In particularly preferred embodiments, the artificial RNA of the invention, preferably the mRNA of the invention may suitably comprise, preferably in 5'- to 3'-direction, the following elements a)-h):
a) a 5'-cap structure as defined herein, preferably m7GpppN,
b) optionally, a 5'-UTR element as defined herein, preferably comprising or consisting of a nucleic acid sequence according to SEQ ID NO: 2, or a fragment or variant of any of these sequences;
c) at least one coding sequence as defined herein, preferably comprising or consisting of a nucleic acid sequence according to SEQ ID NOs: 3188-3189, 4344-4654, 5523-5524, 9447-9757, 6215-6216, 11090-11400, 6907-6908, 12733-13043, 7599-7600, 8291-8292, 14376-14686, 16019-16329, 17209-17424 encoding a peptide or protein derived from RVFV, or fragment or variant of any of these sequences; or comprising or consisting of a nucleic acid sequence according to SEQ ID NOs: 3212-3260, 4692-4903, 5547-5595, 9795-10006, 6239-6287, 11438-11649, 6931-6979, 13081-13292, 7623-7671, 8315-8363, 14724-14935, 16367-16578, 17428-17487 encoding a peptide or protein derived from SFTSV, or fragment or variant of any of these sequences; or comprising or consisting of a nucleic acid sequence according to SEQ ID NOs: 2923-3012, 3506-4104, 5258-5347, 8609-9207, 5950-6039, 10252-10850, 6642-6731, 11895-12493, 7334-7423, 8026-8115, 13538-14136, 15181-15779, 16850-17089 encoding a peptide or protein derived from CCHFV, or fragment or variant of any of these sequences;

d) optionally, a poly(A) sequence, as defined herein, preferably comprising 64 adenosines;

e) optionally, a 3'-UTR element as defined herein, preferably comprising or consisting of a nucleic acid sequence according to SEQ ID NOs: 10, 14 or 16, or a fragment or variant of any of these sequences; f) optionally, a poly(C) sequence as defined herein, preferably comprising 30 cytosines;

g) optionally a histone stem-loop as defined herein, preferably comprising or consisting of a nucleic acid sequence according to SEQ ID NO: 18, or a fragment or variant of any of these sequences; and h) optionally, a poly(A) sequence, preferably obtained using enzymatic polyadenylation.

Suitable mRNA constructs according to the invention are provided in Tables 6-9. Each of the Tables 6-9 provide mRNA constructs as defined herein, wherein Table 6 provides suitable mRNA constructs encoding antigenic peptides or proteins derived from selected viruses of the genus Orthobunyavirus, Table 7 provides suitable mRNA constructs encoding antigenic peptides or proteins derived from selected viruses of the genus Orthohantavirus, Table 8 provides suitable mRNA constructs encoding antigenic peptides or proteins derived from selected viruses of the genus Phlebovirus, and Table 9 provides suitable mRNA constructs encoding antigenic peptides or proteins derived from selected viruses of the genus Orthonairovirus.

In each of the Tables 6-9, each row corresponds to an antigenic peptide or protein in the context of the invention, wherein the virus (Column B, "Virus") and the respective peptide or protein (Column D, "Protein") and the corresponding NCBI Accession Numbers (Column C, "NCBI Accession No.") are indicated. Column A indicates the type of sequence ("cds" or "mRNA product") wherein the "mRNA product" comprises the respective coding sequence ("cds") and other sequence elements as defined herein (UTRs, sequences coding for secretory signal peptides, histone stem loop etc.). Column E ("SEQ ID NOs of wild type nucleic acid") provides SEQ ID NOs corresponding to wild type coding sequences and corresponding mRNA constructs comprising the respective coding sequence. Column F ("SEQ ID NOs of CAI maximized nucleic acid") provides SEQ ID NOs corresponding to CAI maximized nucleic acid coding sequences and corresponding mRNA constructs comprising the respective CAI maximized nucleic acid coding sequence. Column G ("SEQ ID NOs of human codon usage adapted nucleic acid") provides SEQ ID NOs corresponding to human codon usage adapted nucleic acid coding sequences and corresponding mRNA construct comprising the respective human codon usage adapted nucleic acid coding sequences. Column H ("SEQ ID NOs of G/C optimized nucleic acid") provides SEQ ID NOs corresponding to G/C optimized nucleic acid coding sequences and corresponding mRNA construct comprising the respective G/C optimized nucleic acid coding sequences. Column I ("SEQ ID NOs of G/C content modified nucleic acid") provides SEQ ID NOs corresponding to GC content modified nucleic acid coding sequences and corresponding mRNA construct comprising the respective G/C content modified nucleic acid coding sequences.

For example, Table 7 provides suitable mRNA constructs encoding antigenic peptides or proteins derived from selected viruses of the genus Orthohantavirus (rows 1-12). Therein, e.g. row 1 provides coding sequences ("cds") and mRNA sequences ("mRNA product") for a Nucleoprotein N (indicated in Column D of row 1) derived from ANDV Chile-9717869 (indicated in Column B of row 1) with the NCBI accession number AF291702.1 (indicated in Column C of row 1). Suitable mRNA constructs encoding said antigen are provided in the following Columns E-I of row 1. For example, Column H of row 1 provides SEQ ID NOs of mRNA constructs comprising G/C optimized nucleic acid coding sequences (SEQ ID NOs: 16615, 16636), wherein the mRNA constructs comprise G/C optimized coding sequences according to SEQ ID NO: 16595.

The same principle as exemplified above applies for the other Tables 6-9. Accordingly, suitable mRNA constructs in the context of the invention can be derived from those tables, with an indication of which antigen is encoded (virus, antigen, NCBI accession number) and which coding sequence (wild type, CAI maximized, human codon usage adapted, G/C optimized, G/C content modified) is comprised in said mRNA constructs.

TABLE 6 mRNA constructs encoding antigenic proteins from viruses of the genus Orthobunyavirus

| Row | Column A Sequence Type | Column B Virus | Column C NCBI Accession No. | Column D Protein | Column E SEQ ID NOs of wild type nucleic acid | Column F SEQ ID NOs of CAI maximized nucleic acid | Column G SEQ ID NOs of human codon usage adapted nucleic acid | Column H SEQ ID NOs of G/C optimized nucleic acid | Column I SEQ ID NOs of G/C content modified nucleic acid |
|---|---|---|---|---|---|---|---|---|---|
| 1 | CDS | LACV Human/78 | NC_004110.1 | N | 17095, 17096 | 17105 | 17110 | 17115 | 17120, 17125 |
|  | mRNA product | LACV Human/78 | NC_004110.1 | N | 17130, 17131, 17165, 17166 | 17140, 17175 | 17145, 17180 | 17150, 17185 | 17155, 17160, 17190, 17195 |
| 2 | CDS | LACV Human/78 | NC_004109.1 | GP | 17097, 17098 | 17106 | 17111 | 17116 | 17121, 17126 |
|  | mRNA product | LACV Human/78 | NC_004109.1 | GP | 17132, 17133, 17167, 17168 | 17141, 17176 | 17146, 17181 | 17151, 17186 | 17156, 17161, 17191, 17196 |

TABLE 6-continued mRNA constructs encoding antigenic proteins from viruses of the genus Orthobunyavirus

| Row | Column A Sequence Type | Column B Virus | Column C NCBI Accession No. | Column D Protein | Column E SEQ ID NOs of wild type nucleic acid | Column F SEQ ID NOs of CAI maximized nucleic acid | Column G SEQ ID NOs of human codon usage adapted nucleic acid | Column H SEQ ID NOs of G/C optimized nucleic acid | Column I SEQ ID NOs of G/C content modified nucleic acid |
|---|---|---|---|---|---|---|---|---|---|
| 3 | CDS | LACV Human/78 | NC_004109.1 | IgE-leader_Gn-NSm-Gc | 17099, 17100 | 17107 | 17112 | 17117 | 17122, 17127 |
|  | mRNA product | LACV Human/78 | NC_004109.1 | IgE-leader_Gn-NSm-Gc | 17134, 17135, 17169, 17170 | 17142, 17177 | 17147, 17182 | 17152, 17187 | 17157, 17162, 17192, 17197 |
| 4 | CDS | LACV Human/78 | NC_004109.1 | SP(GP)_Gn-4aa-Gc | 17101, 17102 | 17108 | 17113 | 17118 | 17123, 17128 |
|  | mRNA product | LACV Human/78 | NC_004109.1 | SP(GP)_Gn-4aa-Gc | 17136, 17137, 17171, 17172 | 17143, 17178 | 17148, 17183 | 17153, 17188 | 17158, 17163, 17193, 17198 |
| 5 | CDS | LACV Human/78 | NC_004109.1 | IgE-leader_Gn-4aa-Gc | 17103, 17104 | 17109 | 17114 | 17119 | 17124, 17129 |
|  | mRNA product | LACV Human/78 | NC_004109.1 | IgE-leader_Gn-4aa-Gc | 17138, 17139, 17173, 17174 | 17144, 17179 | 17149, 17184 | 17154, 17189 | 17159, 17164, 17194, 17199 |

Abbreviation: 4aa: 4 amino acids; Gc: glycoprotein C; Gn: glycoprotein N; GP: glycoprotein precursor; IgE-leader: leader sequence/signal peptide of human immunoglobulin E (IgE); LACV: La Crosse virus; N: nucleoprotein; NSm: non-structural protein M; SP-GP: signal peptide of glycoprotein precursor

TABLE 7 mRNA constructs encoding antigenic proteins from viruses of the genus Orthohantavirus

| Row | Column A Sequence Type | Column B Virus | Column C NCBI Accession No. | Column D Protein | Column E SEQ ID NOs of wild type nucleic acid | Column F SEQ ID NOs of CAI maximized nucleic acid | Column G SEQ ID NOs of human codon usage adapted nucleic acid | Column H SEQ ID NOs of G/C optimized nucleic acid | Column I SEQ ID NOs of G/C content modified nucleic acid |
|---|---|---|---|---|---|---|---|---|---|
| 1 | CDS | ANDV Chile-9717869 | AF291702.1 | N | 16582, 16583 | 16588 | 16591 | 16594 | 16597, 16600 |
|  | mRNA product | ANDV Chile-9717869 | AF291702.1 | N | 16603, 16604, 16624, 16625 | 16609, 16630 | 16612, 16633 | 16615, 16636 | 16618, 16639, 16621, 16642 |
| 2 | CDS | ANDV Chile-9717869 | AF291703.2 | GP | 16584, 16585 | 16589 | 16592 | 16595 | 16598, 16601 |
|  | mRNA product | ANDV Chile-9717869 | AF291703.2 | GP | 16605, 16606, 16626, 16627 | 16610, 16631 | 16613, 16634 | 16616, 16637 | 16619, 16640, 16622, 16643 |
| 3 | CDS | ANDV Chile-9717869 | AF291703.2 | IgE-leader_Gn-Gc | 16586, 16587 | 16590 | 16593 | 16596 | 16599, 16602 |
|  | mRNA product | ANDV Chile-9717869 | AF291703.2 | IgE-leader_Gn-Gc | 16607, 16608, 16628, 16629 | 16611, 16632 | 16614, 16635 | 16617, 16638 | 16620, 16641, 16623, 16644 |
| 4 | CDS | DOBV DOBV/Ano-Poroia/Afl9/1999 | NC_005233.1 | N | 16648, 16649 | 16654 | 16657 | 16660 | 16663, 16666 |
|  | mRNA product | DOBV DOBV/Ano-Poroia/Afl9/1999 | NC_005233.1 | N | 16669, 16670, 16690, 16691 | 16675, 16696 | 16678, 16699 | 16681, 16702 | 16684, 16705, 16687, 16708 |
| 5 | CDS | DOBV DOBV/Ano-Poroia/Afl9/1999 | NC_005234.1 | GP | 16650, 16651 | 16655 | 16658 | 16661 | 16664, 16667 |
|  | mRNA product | DOBV DOBV/Ano-Poroia/Afl9/1999 | NC_005234.1 | GP | 16671, 16672, 16692, 16693 | 16676, 16697 | 16679, 16700 | 16682, 16703 | 16685, 16706, 16688, 16709 |
| 6 | CDS | DOBV DOBV/Ano-Poroia/Afl9/1999 | NC_005234.1 | IgE-leader_Gn-Gc | 16652, 16653 | 16656 | 16659 | 16662 | 16665, 16668 |
|  | mRNA product | DOBV DOBV/Ano-Poroia/Afl9/1999 | NC_005234.1 | IgE-leader_Gn-Gc | 16673, 16674, 16694, 16695 | 16677, 16698 | 16680, 16701 | 16683, 16704 | 16686, 16707, 16689, 16710 |

TABLE 7-continued mRNA constructs encoding antigenic proteins from viruses of the genus Orthohantavirus

| Row | Column A Sequence Type | Column B Virus | Column C NCBI Accession No. | Column D Protein | Column E SEQ ID NOs of wild type nucleic acid | Column F SEQ ID NOs of CAI maximized nucleic acid | Column G SEQ ID NOs of human codon usage adapted nucleic acid | Column H SEQ ID NOs of G/C optimized nucleic acid | Column I SEQ ID NOs of G/C content modified nucleic acid |
|---|---|---|---|---|---|---|---|---|---|
| 7 | CDS | HTNV 76-118/POR | KT885049.1 | N | 16714, 16715 | 16720 | 16723 | 16726 | 16729, 16732 |
|   | mRNA product | HTNV 76-118/POR | KT885049.1 | N | 16735, 16736, 16756, 16757 | 16741, 16762 | 16744, 16765 | 16747, 16768 | 16750, 16771, 16753, 16774 |
| 8 | CDS | HTNV 76-118/POR | KT885048.1 | GP | 16716, 16717 | 16721 | 16724 | 16727 | 16730, 16733 |
|   | mRNA product | HTNV 76-118/POR | KT885048.1 | GP | 16737, 16738, 16758, 16759 | 16742, 16763 | 16745, 16766 | 16748, 16769 | 16751, 16772, 16754, 16775 |
| 9 | CDS | HTNV 76-118/POR | KT885048.1 | IgE-leader_Gn-Gc | 16718, 16719 | 16722 | 16725 | 16728 | 16731, 16734 |
|   | mRNA product | HTNV 76-118/POR | KT885048.1 | IgE-leader_Gn-Gc | 16739, 16740, 16760, 16761 | 16743, 16764 | 16746, 16767 | 16749, 16770 | 16752, 16773, 16755, 16776 |
| 10 | CDS | PUUV K27 | L08804.1 | N | 16780 | 16785 | 16788 | 16791 | 16794, 16797 |
|   | mRNA product | PUUV K27 | L08804.1 | N | 16800, 16820 | 16805, 16825 | 16808, 16828 | 16811, 16831 | 16814, 16834, 16817, 16837 |
| 11 | CDS | PUUV K27 | L08754.1 | GP | 16781, 16782 | 16786 | 16789 | 16792 | 16795, 16798 |
|   | mRNA product | PUUV K27 | L08754.1 | GP | 16801, 16802, 16821, 16822 | 16806, 16826 | 16809, 16829 | 16812, 16832 | 16815, 16835, 16818, 16838 |
| 12 | CDS | PUUV K27 | L08754.1 | IgE-leader_Gn-Gc | 16783, 16784 | 16787 | 16790 | 16793 | 16796, 16799 |
|   | mRNA product | PUUV K27 | L08754.1 | IgE-leader_Gn-Gc | 16803, 16804, 16823, 16824 | 16807, 16827 | 16810, 16830 | 16813, 16833 | 16816, 16836, 16819, 16839 |

Abbreviation: ANDV: Andes hantavirus; DOBV: Dobrava-Belgrade hantavirus; Gc: glycoprotein C; Gn: glycoprotein N; GP: glycoprotein precursor; HTNV: Haantan virus; IgE-leader: leader sequence/signal peptide of human immunoglobulin E (IgE); N: nucleoprotein; PUUV: Puumala hantavirus

TABLE 8 mRNA constructs encoding antigenic proteins from viruses of the genus Phlebovirus

| Row | Column A Sequence Type | Column B Virus | Column C NCBI Accession No. | Column D Protein | Column E SEQ ID NOs of wild type nucleic acid | Column F SEQ ID NOs of CAI maximized nucleic acid | Column G SEQ ID NOs of human codon usage adapted nucleic acid | Column H SEQ ID NOs of G/C optimized nucleic acid | Column I SEQ ID NOs of G/C content modified nucleic acid |
|---|---|---|---|---|---|---|---|---|---|
| 1 | CDS | RVFV ZH-548 | DQ380151.1 | N | 17209, 17210 | 17227 | 17236 | 17245, 17254 | 17263, 17272 |
|   | mRNA product | RVFV ZH-548 | DQ380151.1 | N | 17281, 17282, 17353, 17354 | 17299, 17371 | 17308, 17380 | 17317, 17326, 17389, 17398 | 17335, 17344, 17407, 17416 |
| 2 | CDS | RVFV ZH-548 | DQ380206.1 | GP | 17211, 17212 | 17228 | 17237 | 17246, 17255 | 17264, 17273 |
|   | mRNA product | RVFV ZH-548 | DQ380206.1 | GP | 17283, 17284, 17355, 17356 | 17300, 17372 | 17309, 17381 | 17318, 17327, 17390, 17399 | 17336, 17345, 17408, 17417 |
| 3 | CDS | RVFV ZH-548 | DQ380206.1 | Gn-Gc | 17213, 17214 | 17229 | 17238 | 17247, 17256 | 17265, 17274 |
|   | mRNA product | RVFV ZH-548 | DQ380206.1 | Gn-Gc | 17285, 17286, 17357, 17358 | 17301, 17373 | 17310, 17382 | 17319, 17328, 17391, 17400 | 17337, 17346, 17409, 17418 |
| 4 | CDS | RVFV ZH-548 | DQ380206.1 | Gne_SP-Gn_Gc | 17215, 17216 | 17230 | 17239 | 17248, 17257 | 17266, 17275 |
|   | mRNA product | RVFV ZH-548 | DQ380206.1 | Gne_SP-Gn_Gc | 17287, 17288, 17359, 17360 | 17302, 17374 | 17311, 17383 | 17320, 17329, 17392, 17401 | 17338, 17347, 17410, 17419 |
| 5 | CDS | RVFV ZH-548 | DQ380206.1 | IgE-leader_Gn(delSP)-Gc variant1 | 17217, 17218 | 17231 | 17240 | 17249, 17258 | 17267, 17276 |
|   | mRNA product | RVFV ZH-548 | DQ380206.1 | IgE-leader_Gn(delSP)-Gc variant1 | 17289, 17290, 17361, 17362 | 17303, 17375 | 17312, 17384 | 17321, 17330, 17393, 17402 | 17339, 17348, 17411, 17420 |
| 6 | CDS | RVFV ZH-548 | DQ380206.1 | IgE-leader_Gn(delSP)-Gc variant2 | 17219, 17220 | 17232 | 17241 | 17250, 17259 | 17268, 17277 |
|   | mRNA product | RVFV ZH-548 | DQ380206.1 | IgE-leader_Gn(delSP)-Gc variant2 | 17291, 17292, 17363, 17364 | 17304, 17376 | 17313, 17385 | 17322, 17331, 17394, 17403 | 17340, 17349, 17412, 17421 |

TABLE 8-continued mRNA constructs encoding antigenic proteins from viruses of the genus Phlebovirus

| Row | Column A Sequence Type | Column B Virus | Column C NCBI Accession No. | Column D Protein | Column E SEQ ID NOs of wild type nucleic acid | Column F SEQ ID NOs of CAI maximized nucleic acid | Column G SEQ ID NOs of human codon usage adapted nucleic acid | Column H SEQ ID NOs of G/C optimized nucleic acid | Column I SEQ ID NOs of G/C content modified nucleic acid |
|---|---|---|---|---|---|---|---|---|---|
| 7 | CDS | RVFV ZH-548 | DQ380206.1 | IgE-leader__Gn (delSP) variant1 | 17221, 17222 | 17233 | 17242 | 17251, 17260 | 17269, 17278 |
|   | mRNA product | RVFV ZH-548 | DQ380206.1 | IgE-leader__Gn (delSP) variant1 | 17293, 17294, 17365, 17366 | 17305, 17377 | 17314, 17386 | 17323, 17332, 17395, 17404 | 17341, 17350, 17413, 17422 |
| 8 | CDS | RVFV ZH-548 | DQ380206.1 | IgE-leader__Gn (delSP) variant2 | 17223, 17224 | 17234 | 17243 | 17252, 17261 | 17270, 17279 |
|   | mRNA product | RVFV ZH-548 | DQ380206.1 | IgE-leader__Gn (delSP) variant2 | 17295, 17296, 17367, 17368 | 17306, 17378 | 17315, 17387 | 17324, 17333, 17396, 17405 | 17342, 17351, 17414, 17423 |
| 9 | CDS | RVFV ZH-548 | DQ380206.1 | IgE-leader__Gc | 17225, 17226 | 17235 | 17244 | 17253, 17262 | 17271, 17280 |
|   | mRNA product | RVFV ZH-548 | DQ380206.1 | IgE-leader__Gc | 17297, 17298, 17369, 17370 | 17307, 17379 | 17316, 17388 | 17325, 17334, 17397, 17406 | 17343, 17352, 17415, 17424 |
| 10 | CDS | SFTSV HB29 | NC_018137.1 | N | 17428 | 17433 | 17436 | 17439 | 17442, 17445 |
|   | mRNA product | SFTSV HB29 | NC_018137.1 | N | 17448, 17468 | 17453, 17473 | 17456, 17476 | 17459, 17479 | 17462, 17465, 17482, 17485 |
| 11 | CDS | SFTSV HB29 | NC_018138.1 | GP | 17429, 17430 | 17434 | 17437 | 17440 | 17443, 17446 |
|   | mRNA product | SFTSV HB29 | NC_018138.1 | GP | 17449, 17450, 17469, 17470 | 17454, 17474 | 17457, 17477 | 17460, 17480 | 17463, 17466, 17483, 17486 |
| 12 | CDS | SFTSV HB29 | NC_018138.1 | IgE-leader__Gn-Gc | 17431, 17432 | 17435 | 17438 | 17441 | 17444, 17447 |
|   | mRNA product | SFTSV HB29 | NC_018138.1 | IgE-leader__Gn-Gc | 17451, 17452, 17471, 17472 | 17455, 17475 | 17458, 17478 | 17461, 17481 | 17464, 17467, 17484, 17487 |

Abbreviation: Gc: glycoprotein C; Gn: glycoprotein N; Gn(delSP): glycoprotein N lacking the signal peptide; Gne: glycoprotein ectodomain/glycoprotein N lacking the transmembrane domain and the cytoplasmic tail; GP: glycoprotein precursor; IgE-leader: leader sequence/signal peptide of human immunoglobulin E (IgE); N: nucleoprotein; NSm: non-structural protein M; RVFV: Rift Valley fever virus; SFTSV: Severe fever with thrombocytopenia syndrome virus; SP-Gn: signal peptide of glycoprotein N; SP-GP: signal peptide of glycoprotein precursor

TABLE 9 mRNA constructs encoding antigenic proteins from viruses of the genus Orthonairovirus

| Row | Column A Sequence Type | Column B Virus | Column C NCBI Accession No. | Column D Protein | Column E SEQ ID NOs of wild type nucleic acid | Column F SEQ ID NOs of CAI maximized nucleic acid | Column G SEQ ID NOs of human codon usage adapted nucleic acid | Column H SEQ ID NOs of G/C optimized nucleic acid | Column I SEQ ID NOs of G/C content modified nucleic acid |
|---|---|---|---|---|---|---|---|---|---|
| 1 | CDS | CCHFV 10200 | NC_005302.1/ U88410.1 | N | 16850, 16851 | 16870 | 16880 | 16890, 16900 | 16910, 16920 |
|   | mRNA product | CCHFV 10200 | NC_005302.1/ U88410.1 | N | 16930, 16931, 17010, 17011 | 16950, 17030 | 16960, 17040 | 16970, 16980, 17050, 17060 | 16990, 17000, 17070, 17080 |
| 2 | CDS | CCHFV Turkey-Kelkit06 | GQ337053.1 | N | 16852, 16853 | 16871 | 16881 | 16891, 16901 | 16911, 16921 |
|   | mRNA product | CCHFV Turkey-Kelkit06 | GQ337053.1 | N | 16932, 16933, 17012, 17013 | 16951, 17031 | 16961, 17041 | 16971, 16981, 17051, 17061 | 16991, 17001, 17071, 17081 |
| 3 | CDS | CCHFV 10200 | U39455.2 | GP | 16854, 16855 | 16872 | 16882 | 16892, 16902 | 16912, 16922 |
|   | mRNA product | CCHFV 10200 | U39455.2 | GP | 16934, 16935, 17014, 17015 | 16952, 17032 | 16962, 17042 | 16972, 16982, 17052, 17062 | 16992, 17002, 17072, 17082 |
| 4 | CDS | CCHFV IbAr10200 | AF467768.2 | GP | 16856, 16857 | 16873 | 16883 | 16893, 16903 | 16913, 16923 |
|   | mRNA product | CCHFV IbAr10200 | AF467768.2 | GP | 16936, 16937, 17016, 17017 | 16953, 17033 | 16963, 17043 | 16973, 16983, 17053, 17063 | 16993, 17003, 17073, 17083 |
| 5 | CDS | CCHFV Turkey-Kelkit06 | GQ337054.1 | GP | 16858, 16859 | 16874 | 16884 | 16894, 16904 | 16914, 16924 |
|   | mRNA product | CCHFV Turkey-Kelkit06 | GQ337054.1 | GP | 16938, 16939, 17018, 17019 | 16954, 17034 | 16964, 17044 | 16974, 16984, 17054, 17064 | 16994, 17004, 17074, 17084 |

TABLE 9-continued mRNA constructs encoding antigenic proteins from viruses of the genus Orthonairovirus

| Row | Column A Sequence Type | Column B Virus | Column C NCBI Accession No. | Column D Protein | Column E SEQ ID NOs of wild type nucleic acid | Column F SEQ ID NOs of CAI maximized nucleic acid | Column G SEQ ID NOs of human codon usage adapted nucleic acid | Column H SEQ ID NOs of G/C optimized nucleic acid | Column I SEQ ID NOs of G/C content modified nucleic acid |
|---|---|---|---|---|---|---|---|---|---|
| 6 | CDS | CCHVF 10200 | U39455.2 | SP-GP_Gn-NSm-Gc | 16860, 16861 | 16875 | 16885 | 16895, 16905 | 16915, 16925 |
|   | mRNA product | CCHVF 10200 | U39455.2 | SP-GP_Gn-NSm-Gc | 16940, 16941, 17020, 17021 | 16955, 17035 | 16965, 17045 | 16975, 16985, 17055, 17065 | 16995, 17005, 17075, 17085 |
| 7 | CDS | CCHVF 10200 | U39455.2 | IgE-leader_Gn-NSm-Gc | 16862, 16863 | 16876 | 16886 | 16896, 16906 | 16916, 16926 |
|   | mRNA product | CCHVF 10200 | U39455.2 | IgE-leader_Gn-NSm-Gc | 16942, 16943, 17022, 17023 | 16956, 17036 | 16966, 17046 | 16976, 16986, 17056, 17066 | 16996, 17006, 17076, 17086 |
| 8 | CDS | CCHVF 10200 | U39455.2 | IgE-leader_Gn-4aa-Gc | 16864, 16865 | 16877 | 16887 | 16897, 16907 | 16917, 16927 |
|   | mRNA product | CCHVF 10200 | U39455.2 | IgE-leader_Gn-4aa-Gc | 16944, 16945, 17024, 17025 | 16957, 17037 | 16967, 17047 | 16977, 16987, 17057, 17067 | 16997, 17007, 17077, 17087 |
| 9 | CDS | CCHVF 10200 | U39455.2 | IgE-leader_Gn | 16866, 16867 | 16878 | 16888 | 16898, 16908 | 16918, 16928 |
|   | mRNA product | CCHVF 10200 | U39455.2 | IgE-leader_Gn | 16946, 16947, 17026, 17027 | 16958, 17038 | 16968, 17048 | 16978, 16988, 17058, 17068 | 16998, 17008, 17078, 17088 |
| 10 | CDS | CCHVF 10200 | U39455.2 | IgE-leader_Gc | 16868, 16869 | 16879 | 16889 | 16899, 16909 | 16919, 16929 |
|   | mRNA product | CCHVF 10200 | U39455.2 | IgE-leader_Gc | 16948, 16949, 17028, 17029 | 16959, 17039 | 16969, 17049 | 16979, 16989, 17059, 17069 | 16999, 17009, 17079, 17089 |

Abbreviation: 4aa: 4 amino acids; CCHFV: Crimean-Congo hemorrhagic fever virus; Gc: glycoprotein C; Gn: glycoprotein N; GP: glycoprotein precursor; IgE-leader: leader sequence/signal peptide of human immunoglobulin E (IgE); N: nucleoprotein; NSm: non-structural protein M; SP-GP: signal peptide of glycoprotein precursor In preferred embodiments the artificial RNA comprises or consists of an RNA sequence which is identical or at least 50%, 60%, 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 16603-16644, 16669-16710, 16735-16710, 16800-16839, 16930-17089, 17130-17199, 17281-17424, 17448-17487, and as defined in Table 6-9 encoding a peptide or protein derived from a virus of the order Bunyavirales and, optionally, a secretory signal sequence as defined herein, or a fragment or variant of any of these sequences.

In preferred embodiments the artificial RNA comprises or consists of an RNA sequence which is identical or at least 50%, 60%, 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 17130-17199, and as defined in Table 6, encoding a peptide or protein derived from a virus of the genus Orthobunyavirus and, optionally, a secretory signal sequence as defined herein, or a fragment or variant of any of these sequences.

In embodiments, the artificial RNA comprises or consists of an RNA sequence which is identical or at least 50%, 60%, 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 17130-17199 encoding a peptide or protein derived from LACV and, optionally, a secretory signal sequence as defined herein, or a fragment or variant of any of these sequences.

Suitable mRNA sequences encoding antigenic peptides or proteins derived from a virus of the genus Orthobunyavirus can be derived from Table 6. Therein, mRNA sequences encoding antigenic peptides or proteins derived from LACV are provided (rows 1-5 of Table 6). These mRNA constructs encode LACV Nucleoprotein N ("mRNA product" SEQ ID NOs as provided in Table 6, row 1, Columns E-I); LACV GP ("mRNA product" SEQ ID NOs as provided in Table 6, row 2, Columns E-I); LACV Gn, NSm and Gc, additionally comprising an N-terminal heterologous signal peptide IgE-leader ("mRNA product" SEQ ID NOs as provided in Table 6, row 3, Columns E-I); LACV Gn and Gc, wherein Gn and Gc are separated by a short peptide linker (4aa), additionally comprising an N-terminal signal peptide ("mRNA product" SEQ ID NOs as provided in Table 6, row 4, Columns E-I); LACV Gn and Gc, wherein Gn and Gc are separated by a short peptide linker (4aa), additionally comprising an N-terminal heterologous signal peptide IgE-leader ("mRNA product" SEQ ID NOs as provided in Table 6, row 5, Columns E-I).

In preferred embodiments the artificial RNA comprises or consists of an RNA sequence which is identical or at least 50%, 60%, 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 16603-16644, 16669-16710, 16735-16776, 16800-16839 and as defined in Table 7 encoding a peptide or protein derived from a virus of the genus Orthohantavirus and, optionally, a secretory signal sequence as defined herein, or a fragment or variant of any of these sequences.

In embodiments, the artificial RNA comprises or consists of an RNA sequence which is identical or at least 50%, 60%, 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 16603-16644 encoding a peptide or protein derived from ANDV and, optionally, a secretory signal sequence as defined herein, or a fragment or variant of any of these sequences.

In embodiments, the artificial RNA comprises or consists of an RNA sequence which is identical or at least 50%, 60%, 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 16669-16689 encoding a peptide or protein derived from DOBV and, optionally, a secretory signal sequence as defined herein, or a fragment or variant of any of these sequences.

In embodiments, the artificial RNA comprises or consists of an RNA sequence which is identical or at least 50%, 60%, 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 16735-16776 encoding a peptide or protein derived from HTNV and, optionally, a secretory signal sequence as defined herein, or a fragment or variant of any of these sequences.

In embodiments, the artificial RNA comprises or consists of an RNA sequence which is identical or at least 50%, 60%, 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 16800-16839 encoding a peptide or protein derived from PUUV and, optionally, a secretory signal sequence as defined herein, or a fragment or variant of any of these sequences.

Suitable mRNA sequences encoding antigenic peptides or proteins derived from a virus of the genus Orthobunyavirus can be derived from Table 7. Therein, mRNA sequences encoding antigenic peptides or proteins derived from ANDV (rows 1-3 of Table 7), DOBV (rows 4-6 of Table 7), HTNV (rows 7-9 of Table 7) and PUUV (rows 7-9 of Table 7) are provided. These mRNA constructs encode ANDV Nucleoprotein N ("mRNA product" SEQ ID NOs as provided in Table 7, row 1, Columns E-I); ANDV GP ("mRNA product" SEQ ID NOs as provided in Table 7, row 2, Columns E-I); ANDV Gn and Gc, additionally comprising an N-terminal heterologous signal peptide IgE-leader ("mRNA product" SEQ ID NOs as provided in Table 7, row 2, Columns E-I); DOBV Nucleoprotein N ("mRNA product" SEQ ID NOs as provided in Table 7, row 4, Columns E-I); DOBV GP ("mRNA product" SEQ ID NOs as provided in Table 7, row 5, Columns E-I); DOBV Gn and Gc, additionally comprising an N-terminal heterologous signal peptide IgE-leader ("mRNA product" SEQ ID NOs as provided in Table 7, row 6, Columns E-I); HTNV Nucleoprotein N ("mRNA product" SEQ ID NOs as provided in Table 7, row 7, Columns E-I); HTNV GP ("mRNA product" SEQ ID NOs as provided in Table 7, row 8, Columns E-I); HTNV Gn and Gc, additionally comprising an N-terminal heterologous signal peptide IgE-leader ("mRNA product" SEQ ID NOs as provided in Table 7, row 9, Columns E-I); PUUV Nucleoprotein N ("mRNA product" SEQ ID NOs as provided in Table 7, row 10, Columns E-I); PUUV GP ("mRNA product" SEQ ID NOs as provided in Table 7, row 11, Columns E-I); PUUV Gn and Gc, additionally comprising an N-terminal heterologous signal peptide IgE-leader ("mRNA product" SEQ ID NOs as provided in Table 7, row 12, Columns E-I).

In preferred embodiments the artificial RNA comprises or consists of an RNA sequence which is identical or at least 50%, 60%, 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 17281-17424, 17448-17487 and as defined in Table 8 encoding a peptide or protein derived from a virus of the genus Phlebovirus and, optionally, a secretory signal sequence as defined herein, or a fragment or variant of any of these sequences.

In particularly preferred embodiments the artificial RNA comprises or consists of an RNA sequence which is identical or at least 50%, 60%, 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 17281-17424 encoding a peptide or protein derived from RVFV and, optionally, a secretory signal sequence as defined herein, or a fragment or variant of any of these sequences.

In particularly preferred embodiments the artificial RNA comprises or consists of an RNA sequence which is identical or at least 50%, 60%, 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 17448-17487 encoding a peptide or protein derived from SFTSV and, optionally, a secretory signal sequence as defined herein, or a fragment or variant of any of these sequences.

Suitable mRNA sequences encoding antigenic peptides or proteins derived from a virus of the genus Phlebovirus can be derived from Table 8. Therein, mRNA sequences encoding antigenic peptides or proteins derived from RVFV (rows 1-9 of Table 8) and SFTSV (rows 10-12 of Table 8) are provided.

These mRNA constructs encode RVFV Nucleoprotein N ("mRNA product" SEQ ID NOs as provided in Table 8, row 1, Columns E-I); RVFV GP ("mRNA product" SEQ ID NOs as provided in Table 8, row 2, Columns E-I); RVFV Gn and Gc ("mRNA product" SEQ ID NOs as provided in Table 8, row 3, Columns E-I); RVFV glycoprotein ectodomain/glycoprotein N lacking the transmembrane domain and the cytoplasmic tail (Gne), SP-signal peptide of glycoprotein precursor (SP-GP), Gn and Gc ("mRNA product" SEQ ID NOs as provided in Table 8, row 4, Columns E-I); RVFV Gn(delSP) (glycoprotein N lacking the signal peptide) and Gc additionally comprising an N-terminal heterologous signal peptide IgE-leader ("mRNA product" SEQ ID NOs as provided in Table 8, row 5-6, Columns E-I); RVFV Gn(delSP) (glycoprotein N lacking the signal peptide) additionally comprising an N-terminal heterologous signal peptide IgE-leader ("mRNA product" SEQ ID NOs as provided in Table 8, row 7-8, Columns E-I); RVFV Gc additionally comprising an N-terminal heterologous signal peptide IgE-leader ("mRNA product" SEQ ID NOs as provided in Table 8, row 9, Columns E-I); SFTSV Nucleoprotein N ("mRNA product" SEQ ID NOs as provided in Table 8, row 10, Columns E-I); SFTSV GP ("mRNA product" SEQ ID NOs as provided in Table 8, row 11, Columns E-I); SFTSV Gn and Gc, additionally comprising an N-terminal heterologous signal peptide IgE-leader ("mRNA product" SEQ ID NOs as provided in Table 8, row 12, Columns E-I);

In preferred embodiments the artificial RNA comprises or consists of an RNA sequence which is identical or at least 50%, 60%, 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 16930-17089, and as defined in Table 9 encoding a peptide or protein derived from a virus of the genus Orthonairovirus and, optionally, a secretory signal sequence as defined herein, or a fragment or variant of any of these sequences.

In particularly preferred embodiments the artificial RNA comprises or consists of an RNA sequence which is identical or at least 50%, 60%, 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 16930-17089 encoding a peptide or protein derived from CCHFV and, optionally, a secretory signal sequence as defined herein, or a fragment or variant of any of these sequences.

Suitable mRNA sequences encoding antigenic peptides or proteins derived from a virus of the genus Orthonairovirus can be derived from Table 9. Therein, mRNA sequences encoding antigenic peptides or proteins derived from CCHFV (rows 1-10 of Table 9) are provided. These mRNA constructs encode CCHFV Nucleoprotein N ("mRNA product" SEQ ID NOs as provided in Table 9, row 1-2, Columns E-I); CCHFV GP ("mRNA product" SEQ ID NOs as provided in Table 9, row 3-5, Columns E-I); CCHFV Gn, NSm and Gc, additionally comprising an N-terminal SP-GP signal peptide of glycoprotein precursor ("mRNA product" SEQ ID NOs as provided in Table 9, row 6, Columns E-I); CCHFV Gc, NSm, and Gc, additionally comprising an N-terminal heterologous signal peptide IgE-leader ("mRNA product" SEQ ID NOs as provided in Table 9, row 7, Columns E-I); CCHFV Gn and Gc, wherein Gn and Gc are separated by a short peptide linker (4aa), additionally comprising an N-terminal heterologous signal peptide IgE-leader ("mRNA product" SEQ ID NOs as provided in Table 9, row 8, Columns E-I); CCHFV Gn additionally comprising an N-terminal heterologous signal peptide IgE-leader ("mRNA product" SEQ ID NOs as provided in Table 9, row 9, Columns E-I); CCHFV Gn additionally comprising an N-terminal heterologous signal peptide IgE-leader ("mRNA product" SEQ ID NOs as provided in Table 9, row 10, Columns E-I).

The artificial RNA according to the present invention may be prepared using any method known in the art, including chemical synthesis such as e.g. solid phase RNA synthesis, as well as in vitro methods, such as RNA in vitro transcription reactions.

In a preferred embodiment, the artificial nucleic acid as defined herein, preferably the RNA as defined herein, is obtained by RNA in vitro transcription. Accordingly, the RNA of the invention is preferably an in vitro transcribed RNA.

The terms "RNA in vitro transcription" or "in vitro transcription" relate to a process wherein RNA is synthesized in a cell-free system (in vitro). DNA, particularly plasmid DNA (or PCR product), is typically used as template for the generation of RNA transcripts. RNA may be obtained by DNA-dependent in vitro transcription of an appropriate DNA template, which according to the present invention is preferably a linearized plasmid DNA template. The promoter for controlling in vitro transcription can be any promoter for any DNA-dependent RNA polymerase. Particular examples of DNA-dependent RNA polymerases are the T7, T3, and SP6 RNA polymerases. A DNA template for in vitro RNA transcription may be obtained by cloning of a nucleic acid, in particular cDNA corresponding to the respective RNA to be in vitro transcribed, and introducing it into an appropriate vector for in vitro transcription, for example into plasmid DNA. In a preferred embodiment of the present invention the DNA template is linearized with a suitable restriction enzyme, before it is transcribed in vitro. The cDNA may be obtained by reverse transcription of mRNA or chemical synthesis. Moreover, the DNA template for in vitro RNA synthesis may also be obtained by gene synthesis.

Reagents used in RNA in vitro transcription typically include: a DNA template (linearized plasmid DNA or PCR product) with a promoter sequence that has a high binding affinity for its respective RNA polymerase such as bacteriophage-encoded RNA polymerases (17, T3, SP6, or Syn5); ribonucleotide triphosphates (NTPs) for the four bases (adenine, cytosine, guanine and uracil); optionally, a cap analogue as defined herein (e.g. m7G(5')ppp(5')G (m7G)); optionally, further modified nucleotides as defined herein; a DNA-dependent RNA polymerase capable of binding to the promoter sequence within the DNA template (e.g. T7, T3, SP6, or Syn5 RNA polymerase); optionally, a ribonuclease (RNase) inhibitor to inactivate any contaminating RNase; optionally, a pyrophosphatase to degrade pyrophosphate, which may inhibit transcription; MgCl2, which supplies Mg2+ ions as a co-factor for the polymerase; a buffer (TRIS or HEPES) to maintain a suitable pH value, which can also contain antioxidants (e.g. DTT), and/or polyamines such as spermidine at optimal concentrations, or a buffer system as disclosed in WO2017/109161.

In embodiments, the nucleotide mixture used in RNA in vitro transcription may additionally contain modified nucleotides as defined herein. In embodiments, the nucleotide mixture (i.e. the fraction of each nucleotide in the mixture) may be optimized for the given RNA sequence, preferably as described WO2015/188933.

In embodiment where more than one different artificial nucleic acid as defined herein has to be produced, e.g. where 2, 3, 4, 5, 6, 7, 8, 9, 10 or even more different artificial nucleic acids have to be produced (e.g. encoding different antigenic peptides, proteins of Bunyavirales), procedures as described in WO2017/109134 may be suitably used.

In the context of nucleic acid vaccine production, it may be required to provide GMP-grade RNA. GMP-grade RNA may be suitably produced using a manufacturing process approved by regulatory authorities. Accordingly, in a particularly preferred embodiment, RNA production is performed under current good manufacturing practice (GMP), implementing various quality control steps on DNA and RNA level, according to WO2016/180430. Accordingly, the RNA of the invention is a GMP-grade RNA, particularly a GMP-grade RNA mRNA.

The obtained RNA products are preferably purified using PureMessenger® (CureVac, Tübingen, Germany; RP-HPLC according to WO2008/077592) and/or tangential flow filtration (as described in WO2016/193206).

In a preferred embodiment, the RNA, particularly the purified RNA, is lyophilized according to WO2016/165831 or WO2011/069586 to yield a temperature stable dried artificial nucleic acid (powder) as defined herein. The RNA of the invention, particularly the purified RNA may also be dried using spray-drying or spray-freeze drying according to WO2016/184575 or WO2016/84576 to yield a temperature stable artificial nucleic acid (powder) as defined herein. Accordingly, in the context of manufacturing and purifying nucleic acids, particularly RNA, the disclosures of WO2017/109161, WO2015/188933, WO2016/180430, WO2008/077592, WO2016/193206, WO2016/165831, WO2011/069586, WO2016/84575, and WO2016/84576 are incorporated herewith by reference.

Accordingly, in preferred embodiments the RNA is a dried RNA, particularly a dried mRNA.

The term "dried RNA" as used herein has to be understood as RNA that has been lyophilized, or spray-dried, or spray-freeze dried as defined above to obtain a temperature stable dried RNA (powder).

Accordingly, in preferred embodiments the RNA is a purified RNA, particularly purified mRNA.

The term "purified RNA" as used herein has to be understood as RNA which has a higher purity after certain purification steps (e.g. HPLC, TFF, precipitation steps) than the starting material (e.g. in vitro transcribed RNA). Typical impurities that are essentially not present in purified RNA comprise peptides or proteins (e.g. enzymes derived from DNA dependent RNA in vitro transcription, e.g. RNA polymerases, RNases. BSA, pyrophosphatase, restriction endonuclease, DNase), spermidine, abortive RNA sequences, RNA fragments, free nucleotides (modified nucleotides, conventional NTPs, cap analogue), plasmid DNA fragments, buffer components (HEPES, TRIS, MgCl2) etc. Other impurities that may be derived from e.g. fermentation procedures comprise bacterial impurities (bioburden, bacterial DNA) or impurities derived from purification procedures (organic solvents etc.). Accordingly, it is desirable in this regard for the "degree of RNA purity" to be as close as possible to 100%. It is also desirable for the degree of RNA purity that the amount of full length RNA transcripts is as close as possible to 100%. Accordingly "purified RNA" as used herein has a degree of purity of more than 70%, 75%, 80%, 85%, very particularly 90%, 91%, 92%, 93%, 94%, 95%, 96%, 97%, 98% and most favorably 99% or more. The degree of purity may for example be determined by an analytical HPLC, wherein the percentages provided above correspond to the ratio between the area of the peak for the target RNA and the total area of all peaks representing the by-products. Alternatively, the degree of purity may for example be determined by an analytical agarose gel electrophoresis or capillary gel electrophoresis.

In a further aspect, the present invention concerns a polypeptide encoded by the inventive artificial nucleic acid as described herein, particularly by the artificial RNA as described herein.

Suitably, the polypeptide is preferably encoded by a nucleic acid sequence comprising or consisting of at least one coding sequence being identical or at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs: 2569-16578, 16582-16644, 16648-16710, 16714-16776, 16780-16839, 16850-17089, 17095-17199, 17209-17424, 17428-17487 or a fragment or variant of these sequences, and, optionally, by comprising or consisting of at least one additional coding sequence being identical or at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs: 66-233 or a fragment or variant of these sequences.

Preferably, the polypeptide or fragment thereof is immunogenic, preferably immunogenic to an extend allowing for an induction of an immune response in a subject, e.g. a human subject.

In preferred embodiments, the polypeptide comprises at least one protein or peptides being identical or at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs: 234-2568, 16579-16581, 16645-16647, 16711-16713, 16777-16779, 16840-16849, 17090-17094, 17200-17208, 17425-17427 or a fragment or variant of these sequences. In further embodiments, the inventive polypeptides comprises at least one further peptide or protein element being identical or at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs 38-65 or a fragment or variant of these sequences.

Composition, Pharmaceutical Composition, Immunogenic Composition:

In a further aspect, the present invention relates to a composition comprising at least one artificial nucleic acid as described herein, particularly at least one artificial RNA as described herein and/or at least one polypeptide as described herein, and, optionally, at least one pharmaceutically acceptable carrier.

The composition comprising at least one artificial nucleic acid, particularly at least one artificial RNA, and/or at least one polypeptide as defined herein is preferably a pharmaceutical composition, and/or an immunogenic composition.

The term "pharmaceutically acceptable carrier" as used herein preferably includes the liquid or non-liquid basis of the composition, the pharmaceutical composition, and/or the immunogenic composition. If the inventive composition is provided in liquid form, the carrier will preferably be water, typically pyrogen-free water; isotonic saline or buffered (aqueous) solutions, e.g. phosphate, citrate etc. buffered solutions. Water or preferably a buffer, more preferably an aqueous buffer, may be used, containing a sodium salt, preferably at least 50 mM of a sodium salt, a calcium salt, preferably at least 0.01 mM of a calcium salt, and optionally a potassium salt, preferably at least 3 mM of a potassium salt. According to a preferred embodiment, the sodium, calcium and, optionally, potassium salts may occur in the form of their halogenides, e.g. chlorides, iodides, or bromides, in the form of their hydroxides, carbonates, hydrogen carbonates, or sulfates, etc. Without being limited thereto, examples of sodium salts include e.g. NaCl, NaI, NaBr, $Na_2CO_3$, $NaHCO_3$, $Na_2SO_4$, examples of the optional potassium salts include e.g. KCl, KI, KBr, $K_2CO_3$, $KHCO_3$, $K_2SO_4$, and examples of calcium salts include e.g. $CaCl_2$, $CaI_2$, $CaBr_2$, $CaCO_3$, $CaSO_4$, $Ca(OH)_2$. Furthermore, organic anions of the aforementioned cations may be contained in the buffer.

Furthermore, one or more compatible solid or liquid fillers or diluents or encapsulating compounds may be used as well, which are suitable for administration to a person. The term "compatible" as used herein means that the constituents of the inventive composition are capable of being mixed with the at least one artificial nucleic acid of the composition, in such a manner that no interaction occurs, which would substantially reduce the biological activity or the pharmaceutical effectiveness of the inventive composition under typical use conditions. Pharmaceutically acceptable carriers, fillers and diluents must, of course, have sufficiently high purity and sufficiently low toxicity to make them suitable for administration to a person to be treated. Some examples of compounds which can be used as pharmaceutically acceptable carriers, fillers or constituents thereof are sugars, such as, for example, lactose, glucose, trehalose and sucrose; starches, such as, for example, corn starch or potato starch; dextrose; cellulose and its derivatives, such as, for example, sodium carboxymethylcellulose, ethylcellulose, cellulose acetate; powdered tragacanth; malt; gelatin; tallow; solid glidants, such as, for example, stearic acid, magnesium stearate; calcium sulfate; vegetable oils, such as, for example, groundnut oil, cottonseed oil, sesame oil, olive oil, corn oil and oil from theobroma; polyols, such as, for example, polypropylene glycol, glycerol, sorbitol, mannitol and polyethylene glycol; alginic acid.

Further additives, which may be included in the composition are emulsifiers, such as, for example, Tween; wetting agents, such as, for example, sodium lauryl sulfate; colouring agents; taste-imparting agents, pharmaceutical carriers; tablet-forming agents; stabilizers; antioxidants; preservatives.

In embodiments, the composition as defined herein may comprise a plurality or at least more than one of the artificial nucleic acids, particularly more than one of the artificial RNA as defined herein and/or a plurality or at least more than one of the polypeptides as defined herein.

Suitably, the composition, the pharmaceutical composition, and/or the immunogenic composition as defined herein may comprise at least one, or a plurality, or at least more than one of the artificial nucleic acids as defined herein, preferably a plurality or at least more than one of the artificial nucleic acids according to SEQ ID NOs: 2569-16578, 16582-16644, 16648-16710, 16714-16776, 16780-16839, 16850-17089, 17095-17199, 17209-17424, 17428-17487 or a fragment or variant of any of these sequences, and/or a plurality or at least more than one of the polypeptides as defined herein, preferably a plurality or at least more than one of the amino acid sequences according to SEQ ID NOs 38-65 or a fragment or variant of any of these sequences.

Suitably, the composition, the pharmaceutical composition, and/or the immunogenic composition as defined herein may comprise at least one, or a plurality, or at least more than one of the artificial nucleic acids as defined herein, preferably a plurality or at least more than one of the artificial nucleic acids according to SEQ ID NOs: 16603-16644, 16669-16710, 16735-16710, 16800-16839, 16930-17089, 17130-17199, 17281-17424, 17448-17487 or a fragment or variant of any of these sequences.

In embodiments, the composition, the pharmaceutical composition, and/or the immunogenic composition may comprise either only one type or species of artificial nucleic acid, preferably RNA, or at least two different artificial nucleic acids, preferably RNA. In particular, the inventive composition may comprise at least two artificial nucleic acids as described herein, wherein each of the at least two artificial nucleic acids comprises at least one coding sequence encoding at least one amino acid sequence comprising a different Bunyavirales antigenic peptides, proteins, polyproteins as described herein, preferably derived from a pathogen, preferably human pathogen of the order Bunyavirales as defined herein.

Alternatively, the composition, the pharmaceutical composition, and/or the immunogenic composition may comprise at least two artificial nucleic acids as described herein, wherein each of the at least two artificial nucleic acids comprises at least one coding sequence encoding at least one polypeptide comprising at least two different Bunyavirales antigenic peptides, proteins, polyproteins as described herein, preferably of a virus as defined above.

In another embodiment, the composition, the pharmaceutical composition, and/or the immunogenic composition may also comprise at least two different artificial nucleic acids, which are bi- or multicistronic nucleic acids as described herein and wherein each of the artificial nucleic acids encodes at least two polypeptides, each comprising at least one Bunyavirales antigenic peptides, proteins, polyproteins, or a fragment or variant thereof as defined herein.

Alternatively, the composition, the pharmaceutical composition, and/or the immunogenic composition may comprise at least two different polypeptides, preferably comprising at least two different antigenic peptides, proteins, polyproteins derived from Bunyavirales as described herein.

Alternatively, the composition, the pharmaceutical composition, and/or the immunogenic composition of the present invention may comprise at least one artificial nucleic acid comprising at least one nucleic acid sequence according to the invention, wherein the at least one nucleic acid sequence encodes at least two, three, four, five, six, seven, eight, nine, ten, eleven or twelve distinct antigenic peptides or proteins derived from viruses of the order Bunyavirales as defined herein or a fragment or variant thereof.

In this context it is particularly preferred that the at least one nucleic acid comprised in the composition is a bi- or multicistronic nucleic acid, particularly a bi- or multicistronic nucleic acid as defined herein, which encodes the at least two, three, four, five, six, seven, eight, nine, ten, eleven or twelve distinct antigenic peptides or protein derived from a virus of the order Bunyavirales. Mixtures between these embodiments are also envisaged, such as compositions, pharmaceutical compositions, and/or the immunogenic compositions comprising more than one nucleic acid sequences, wherein at least one nucleic acid sequence may be monocistronic, while at least one other nucleic acid sequence may be bi- or multicistronic.

Preferably, the composition, the pharmaceutical composition, and/or the immunogenic composition comprises a plurality or more than one of the nucleic sequences according to the invention, wherein each nucleic acid sequence comprises at least one coding sequence encoding at least one antigenic peptide or protein derived from a virus of the order Bunyavirales or a fragment or variant thereof.

In a particularly preferred embodiment, the composition comprises at least 2, 3, 4, 5, 6, 7, 8, 9, 10 or even more different artificial nucleic acids each encoding at least one antigenic peptide or protein derived from genetically the same Bunyavirales virus or a fragment or variant thereof.

The terms "same" or "same Bunyavirales virus" as used in the context of a virus, e.g. "same virus", have to be understood as genetically the same. Particularly, said (genetically) same virus expresses the same proteins or peptides, wherein all proteins or peptides have the same amino acid sequence. In the broadest sense, "same" virus, e.g. "same" virus of the order Bunyavirales has to be understood as genetically "same" virus of the order Bunyavirales. Particularly, said (genetically) same viruses express essentially the same proteins, peptides or polyproteins, wherein these protein, peptide or polyproteins preferably do not differ in their amino acid sequence(s).

In another preferred embodiment each nucleic acid sequence encodes at least one different Bunyavirales antigenic peptide or protein derived from proteins of (genetically) different Bunyavirales or a fragment or variant thereof. In a particularly preferred embodiment, the composition comprises at least 2, 3, 4, 5, 6, 7, 8, 9, 10 or even more different artificial nucleic acids each encoding at least one peptide or protein derived from a different Bunyavirales virus or a fragment or variant thereof.

The terms "different" or "different Bunyavirales virus" as used throughout the present specification in the context of a virus, e.g. "different" virus, has to be understood as the difference between at least two respective viruses, wherein the difference is manifested on the RNA genome of the respective different virus. In the broadest sense, "different" virus, e.g. "different" virus of the order Bunyavirales has to be understood as genetically "different" virus of the order Bunyavirales. Particularly, said (genetically) different viruses express at least one different protein, peptide or polyprotein, wherein the at least one different protein, peptide or polyprotein preferably differs in at least one amino acid.

Complexation and Formulation of the Artificial Nucleic Acid:

In a preferred embodiment the at least one artificial nucleic acid as defined herein, preferably the artificial RNA as defined herein, comprised in the composition, the pharmaceutical composition, the immunogenic composition as defined herein, is complexed or at least partially complexed with one or more cationic or polycationic compound preferably with cationic or polycationic polymer, cationic or polycationic polysaccharide, cationic or polycationic lipid, cationic or polycationic protein, cationic or polycationic peptide, or any combinations thereof.

The term "cationic or polycationic compound" as used herein will be recognized and understood by the person of ordinary skill in the art, and are for example intended to refer to a charged molecule, which is positively charged at a pH value ranging from about 1 to 9, at a pH value ranging from about 3 to 8, at a pH value ranging from about 4 to 8, at a pH value ranging from about 5 to 8, more preferably at a pH value ranging from about 6 to 8, even more preferably at a pH value ranging from about 7 to 8, most preferably at a physiological pH, e.g. ranging from about 7.2 to about 7.5. Accordingly, a cationic component, e.g. a cationic peptide, cationic protein, cationic polymer, cationic polysaccharide, cationic lipid may be any positively charged compound or polymer which is positively charged under physiological conditions. A "cationic or polycationic peptide or protein" may contain at least one positively charged amino acid, or more than one positively charged amino acid, e.g. selected from Arg, His, Lys or Orn. Accordingly. "polycationic" components are also within the scope exhibiting more than one positive charge under the given conditions.

Cationic or polycationic compounds, being particularly preferred in this context may be selected from the following list of cationic or polycationic peptides or proteins of fragments thereof: protamine, nucleoline, spermine or spermidine, or other cationic peptides or proteins, such as poly-L-lysine (PLL), poly-arginine, basic polypeptides, cell penetrating peptides (CPPs), including HIV-binding peptides, HIV-1 Tat (HIV), Tat-derived peptides, Penetratin, VP22 derived or analog peptides, HSV VP22 (Herpes simplex), MAP, KALA or protein transduction domains (PTDs), PpT620, prolin-rich peptides, arginine-rich peptides, lysine-rich peptides, MPG-peptide(s), Pep-1, L-oligomers, Calcitonin peptide(s), Antennapedia-derived peptides, pAntp, pIsl, FGF, Lactoferrin, Transportan, Buforin-2, Bac715-24, SynB, SynB(1), pVEC, hCT-derived peptides, SAP, or histones. More preferably, the nucleic acid as defined herein, preferably the mRNA as defined herein, is complexed with one or more polycations, preferably with protamine or oligofectamine, most preferably with protamine. In this context protamine is particularly preferred.

Further preferred cationic or polycationic compounds, which can be used as transfection or complexation agent may include cationic polysaccharides, for example chitosan, polybrene etc.; cationic lipids, e.g. DOTMA, DMRIE, di-C14-amidine, DOTIM, SAINT, DC-Chol, BGTC, CTAP, DOPC, DODAP, DOPE: Dioleyl phosphatidylethanolamine, DOSPA, DODAB, DOIC, DMEPC, DOGS, DIMRI, DOTAP, DC-6-14, CLIP1, CLIP6, CLIP9, oligofectamine; or cationic or polycationic polymers, e.g. modified polyaminoacids, such as beta-aminoacid-polymers or reversed polyamides, etc., modified polyethylenes, such as PVP etc., modified acrylates, such as pDMAEMA etc., modified amidoamines such as pAMAM etc., modified polybetaaminoester (PBAE), such as diamine end modified 1,4 butanediol diacrylate-co-5-amino-1-pentanol polymers, etc., dendrimers, such as polypropylamine dendrimers or pAMAM based dendrimers, etc., polyimine(s), such as PEI, poly(propyleneimine), etc., polyallylamine, sugar backbone based polymers, such as cyclodextrin based polymers, dextran based polymers, etc., silan backbone based polymers, such as PMOXA-PDMS copolymers, etc., blockpolymers consisting of a combination of one or more cationic blocks (e.g. selected from a cationic polymer as mentioned above) and of one or more hydrophilic or hydrophobic blocks (e.g. polyethyleneglycole); etc.

In embodiments, the composition comprises at least one artificial nucleic acid as described herein, which is complexed with one or more polycationic compounds and/or a polymeric carrier, and at least one free nucleic acid, wherein the at least one complexed nucleic acid is preferably identical to the at least one artificial nucleic acid according to the present invention.

The term "polymeric carrier" as used herein will be recognized and understood by the person of ordinary skill in the art, and are for example intended to refer to a compound that facilitates transport and/or complexation of another compound (cargo). A polymeric carrier is typically a carrier that is formed of a polymer. A polymeric carrier may be associated to its cargo (nucleic acid, RNA) by covalent or non-covalent interaction In this context it is particularly preferred that the at least one artificial nucleic acid, particularly at least one artificial RNA of the inventive composition is complexed at least partially with a cationic or polycationic compound and/or a polymeric carrier, preferably cationic proteins or peptides. In this context, the disclosure of WO2010/037539 and WO2012/113513 is incorporated herewith by reference. Partially means that only a part of the artificial nucleic acid is complexed with a cationic compound and that the rest of the artificial nucleic acid is (comprised in the inventive pharmaceutical composition, immunogenic composition) in uncomplexed form ("free").

Further preferred cationic or polycationic proteins or peptides may be derived from formula (Arg)l;(Lys)m;(His)n;(Orn)o;(Xaa)x of the patent application WO2009/030481, the disclosure of WO2009/030481 relating thereto incorporated herewith by reference.

According to a preferred embodiment, the composition of the present invention comprises the nucleic acid as defined herein, preferably an RNA, and a polymeric carrier. A polymeric carrier used according to the invention might be a polymeric carrier formed by disulfide-crosslinked cationic components. The disulfide-crosslinked cationic components may be the same or different from each other. The polymeric carrier can also contain further components. It is also particularly preferred that the polymeric carrier used according to the present invention comprises mixtures of cationic peptides, proteins or polymers and optionally further components as defined herein, which are crosslinked by disulfide bonds as described herein.

In this context, polymeric carriers according to formula {(Arg);(Lys)m;(His)n;(Orn)o;(Xaa')x(Cys)y} and formula Cys,{(Arg);(Lys)m;(His)n;(Orn)o;(Xaa)x}Cys2 of the patent application WO2012013326 are preferred, the disclosure of WO2012/013326 relating thereto incorporated herewith by reference.

In this context, the cationic components, which form basis for the polymeric carrier by disulfide-crosslinkage, are typically selected from any suitable cationic or polycationic peptide, protein or polymer suitable for this purpose, particular any cationic or polycationic peptide, protein or polymer capable of complexing the mRNA as defined herein or a further nucleic acid comprised in the composition, and thereby preferably condensing the mRNA or the nucleic acid. The cationic or polycationic peptide, protein or polymer, is preferably a linear molecule, however, branched cationic or polycationic peptides, proteins or polymers may also be used.

Every disulfide-crosslinking cationic or polycationic protein, peptide or polymer of the polymeric carrier, which may be used to complex the mRNA according to the invention or any further nucleic acid comprised in the (pharmaceutical)

composition or vaccine of the present invention contains at least one —SH moiety, most preferably at least one cysteine residue or any further chemical group exhibiting an —SH moiety, capable of forming a disulfide linkage upon condensation with at least one further cationic or polycationic protein, peptide or polymer as cationic component of the polymeric carrier as mentioned herein.

As defined above, the polymeric carrier, which may be used to complex the nucleic acid of the present invention or any further nucleic acid comprised in the (pharmaceutical) composition or vaccine according to the invention may be formed by disulfide-crosslinked cationic (or polycationic) components. Preferably, such cationic or polycationic peptides or proteins or polymers of the polymeric carrier, which comprise or are additionally modified to comprise at least one —SH moiety, are selected from, proteins, peptides and polymers as defined herein for complexation agent.

In a further particular embodiment, the polymeric carrier which may be used to complex the nucleic acid as defined herein or any further nucleic acid comprised in the (pharmaceutical) composition or vaccine according to the invention may be derived from a polymeric carrier molecule according formula (L-P$^1$—S—S—P$^2$—S—S—P$^3$-L) of the patent application WO2011/026641, the disclosure of WO2011/026641 relating thereto incorporated herewith by reference.

In other embodiments, the composition, which is preferably a pharmaceutical composition, an immunogenic composition or a vaccine, comprises at least one artificial nucleic acid as described herein, wherein the at least one artificial nucleic acid is complexed or associated with polymeric carriers and, optionally, with at least one lipid component as described in the PCT applications PCT/EP2016/06322, PCT/EP2016/063227, PCT/EP2016/063229, PCT/EP2016/063226. In this context, the disclosures of PCT/EP2016/06322, PCT/EP2016/063227, PCT/EP2016/063229, PCT/EP2016/063226 is herewith incorporated by reference.

In preferred embodiments, the polymeric carrier compound is formed by, or comprises or consists of the peptide elements CysArg12Cys (SEQ ID NO: 21) or CysArg12 (SEQ ID NO: 22) or TrpArg12Cys (SEQ ID NO: 23). In particularly preferred embodiments, the polymeric carrier compound consists of a $(R_{12}C)$—$(R_{12}C)$ dimer, a $(WR_{12}C)$—$(WR_{12}C)$ dimer, or a $(CR_{12})$—$(CR_{12}C)$—$(CR_{12})$ trimer, wherein the individual peptide elements in the dimer (e.g. (WR12C)), or the trimer (e.g. (CR12)), are connected via —SH groups.

In embodiments, where the complexed nucleic acid, preferably the RNA is complexed with cationic or polycationic peptides or proteins as the carrier compound, the nitrogen/phosphate ratio of the complexed RNA ranges from about 0.1 to about 20, or from about 0.2 to about 15, or from about 2 to about 15, or from about 2 to about 12, wherein the N/P ratio is defined as the mole ratio of the nitrogen atoms of the basic groups of the cationic peptide or polymer to the phosphate groups of the nucleic acid, preferably the RNA.

Accordingly, the composition as defined herein, comprising at least one artificial complexed nucleic acid as defined herein, wherein the N/P ratio of the at least one artificial nucleic acid, preferably the RNA as defined herein, to the one or more cationic or polycationic compound as defined herein, preferably protamine, is in the range of about 0.1 to 20, including a range of about 0.3 to 4, of about 0.5 to 2, of about 0.7 to 2 and of about 0.7 to 1.5.

Suitably, the at least one artificial nucleic acid as defined herein, preferably the RNA as defined herein, is complexed with one or more cationic or polycationic compounds as defined herein, in a weight ratio selected from a range of about 6:1 (w/w) to about 0.25:1 (w/w), more preferably from about 5:1 (w/w) to about 0.5:1 (w/w), even more preferably of about 4:1 (w/w) to about 1:1 (w/w) or of about 3:1 (w/w) to about 1:1 (w/w), and most preferably a ratio of about 3:1 (w/w) to about 2:1 (w/w) of nucleic acid to cationic or polycationic compound and/or with a polymeric carrier; or optionally in a nitrogen/phosphate ratio of nucleic acid to cationic or polycationic component and/or polymeric carrier in the range of about 0.1-10, preferably in a range of about 0.3-4 or 0.3-1, and most preferably in a range of about 0.5-1 or 0.7-1, and even most preferably in a range of about 0.3-0.9 or 0.5-0.9.

In this context it is particularly preferred that the at least one artificial nucleic acid as defined herein, preferably the RNA as defined herein, is complexed with protamine.

Suitably, the complexed nucleic acid, preferably the complexed RNA is complexed with protamine by addition of protamine-trehalose solution to the RNA sample at a RNA: protamine weight to weight ratio (w/w) of 2:1.

In a preferred embodiment, the composition, the pharmaceutical composition, the immunogenic composition is obtained in two separate steps in order to obtain both, an efficient immunostimulatory effect and efficient translation of the nucleic acid, particularly the RNA according to the invention. Therein, a so called "adjuvant component" is prepared by complexing—in a first step—a nucleic acid, preferably an mRNA as defined herein of the adjuvant component with a cationic or polycationic compound as defined herein (preferably proamine) in a specific ratio as defined above (preferably weight ratio (w/w) of 2:1).

In preferred embodiments, the composition as defined herein comprises the at least one artificial nucleic acid as defined herein, particularly at least one artificial RNA as defined herein which is complexed with one or more cationic or polycationic compounds (e.g. protamine), and at least one free artificial nucleic acid.

Suitably, the free nucleic acid, particularly the RNA as defined herein, which is comprised in the composition, the pharmaceutical composition, the immunogenic composition, may be identical or different to the nucleic acid, particularly RNA which is comprised in the adjuvant component of the composition, depending on the specific requirements of therapy.

In preferred embodiments, the at least one complexed artificial nucleic acid as defined herein, particularly at least one artificial RNA (e.g. protamine complexed RNA) is identical to the at least one free artificial nucleic acid.

The composition, the pharmaceutical composition, the immunogenic composition as defined herein comprises the nucleic acid, particularly the RNA as defined herein, which encodes at least one antigenic peptide or protein as defined herein and wherein said RNA is present in the composition partially as free RNA and partially as complexed RNA. Preferably, the RNA as defined herein is complexed as described above and the same RNA is then added as free RNA, wherein preferably the compound (e.g. protamine), which is used for complexing the RNA is not present in free form in the composition at the moment of addition of the free RNA component.

Preferably, the molar ratio of the nucleic acid, particularly the RNA of the adjuvant component (e.g. protamine-complexed RNA) to the free nucleic acid, particularly the free RNA may be selected from a molar ratio of about 0.001:1 to about 1:0.001, including a ratio of about 1:1.

Preferably the ratio of complexed nucleic acid, particularly the RNA of the adjuvant component (e.g. protamine-complexed RNA), to free nucleic acid, particularly the free RNA, may be selected from a range of about 5:1 (w/w) to about 1:10 (w/w), more preferably from a range of about 4:1 (w/w) to about 1:8 (w/w), even more preferably from a range of about 3:1 (w/w) to about 1:5 (w/w) or 1:3 (w/w), wherein the ratio is most preferably about 1:1 (w/w).

With respect to a composition comprising an adjuvant component as defined herein and a free RNA component as defined herein, the disclosure of WO2009/144230 is incorporated herewith by reference. Such a composition comprising an adjuvant component as defined herein (e.g. protamine complexed RNA) and a free RNA component as defined herein may be generated using means and methods as disclosed in 40 WO2016/165825.

In a specific embodiment, the nucleic acid, particularly the RNA as defined herein is complexed with a peptide polymer (e.g. a polymeric carrier as defined herein) comprising HO-PEG5000-S-(S-CHHHHHHRRR-RHHHHHHC-S-)7-S-PEG5000-OH, wherein PEG5000 denotes a polyethylene glycol (PEG) moiety having a molecular weight of approximately 5000 Da. The sequence of the peptide is provided in the sequence protocol (SEQ ID NO: 24).

In other embodiments, the composition comprises at least one RNA, wherein the at least one RNA is complexed or associated with polymeric carriers and, optionally, with at least one lipid component as described in WO2017/212008A1, WO2017/212006A1, WO2017/212007A1, and WO2017/212009A1. In this context, the disclosures of WO2017/212008A1, WO2017212006A1, WO2017/212007A1, and WO2017/212009A1 are herewith incorporated by reference.

In a particularly preferred embodiment, the polymeric carrier is a peptide polymer, preferably a polyethylene glycol/peptide polymer as defined above, and a lipid component, preferably a lipidoid component, more preferably lipidoid component.

A lipidoid compound, also simply referred to as lipidoid, is a lipid-like compound, i.e. an amphiphilic compound with lipid-like physical properties. In the context of the present invention the term lipid is considered to also encompass lipidoid compounds.

In preferred embodiment of the second aspect, the at least one RNA is complexed or associated with a polymeric carrier, preferably with a polyethylene glycopeptide polymer as defined above, and a lipidoid component, wherein the lipidoid component is a compound according to formula A

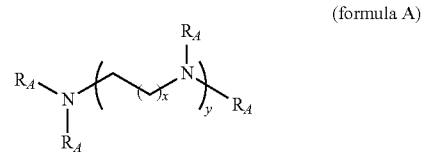

(formula A)

wherein

R$_A$ is independently selected for each occurrence an unsubstituted, cyclic or acyclic, branched or unbranched C$_{1-20}$ aliphatic group; a substituted or unsubstituted, cyclic or acyclic, branched or unbranched C$_{1-20}$ heteroaliphatic group; a substituted or unsubstituted aryl; a substituted or unsubstituted heteroaryl;

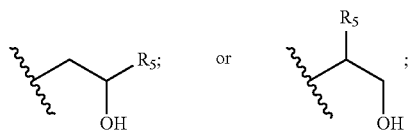

wherein at least one R$_A$ is

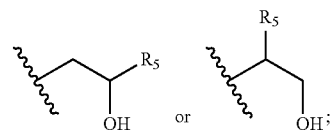

R$_5$ is independently selected for each occurrence of from an unsubstituted, cyclic or acyclic, branched or unbranched C$_{8-16}$ aliphatic; a substituted or unsubstituted aryl; or a substituted or unsubstituted heteroaryl;

each occurrence of x is an integer from 1 to 10;

each occurrence of y is an integer from 1 to 10;

or a pharmaceutically acceptable salt thereof.

In a preferred embodiment, the lipidoid component is 3-C12-OH according to formula B (formula B)

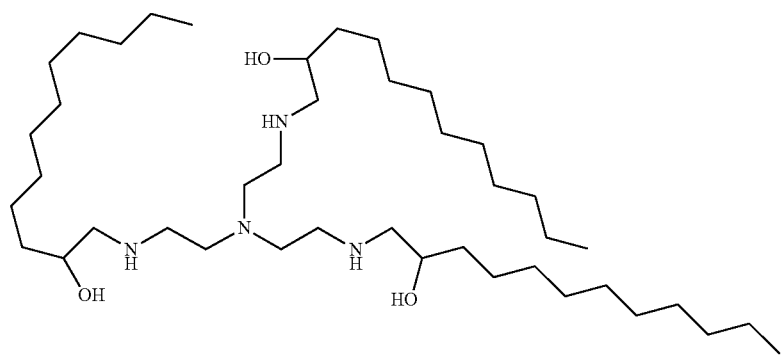

In preferred embodiments, the peptide polymer comprising lipidoid 3-C12-OH as specified above is used to complex the at least one RNA of the first aspect to form complexes having an N/P ratio from about 0.1 to about 20, or from about 0.2 to about 15, or from about 2 to about 15, or from about 2 to about 12, wherein the N/P ratio is defined as the mole ratio of the nitrogen atoms of the basic groups of the cationic peptide or polymer to the phosphate groups of the nucleic acid. In that context, the disclosure of WO2017/21200A1, in particular Claims 1 to 10 of WO2017212009A1, and the specific disclosure relating thereto is herewith incorporated by reference.

In preferred embodiments, the composition, which is preferably a pharmaceutical composition, an immunogenic composition, comprises at least one artificial nucleic acid as described herein, wherein the at least one artificial nucleic acid is complexed or associated with one or more lipids (e.g. cationic lipids and/or neutral lipids), thereby forming liposomes, lipid nanoparticles (LNPs), lipoplexes, and/or nanoliposomes.

In the context of the present invention, the term "lipid nanoparticle", also referred to as "LNP", is not restricted to any particular morphology, and include any morphology generated when a cationic lipid and optionally one or more further lipids are combined. e.g. in an aqueous environment and/or in the presence of an RNA. For example, a liposome, a lipid complex, a lipoplex and the like are within the scope of a lipid nanoparticle (LNP).

LNPs typically comprise a cationic lipid and one or more excipient selected from neutral lipids, charged lipids, steroids and polymer conjugated lipids (e.g. PEGylated lipid). The nucleic acid may be encapsulated in the lipid portion of the LNP or an aqueous space enveloped by some or the entire lipid portion of the LNP. The RNA or a portion thereof may also be associated and complexed with the LNP. An LNP may comprise any lipid capable of forming a particle to which the nucleic acids are attached, or in which the one or more nucleic acids are encapsulated. Preferably, the LNP comprising nucleic acids comprises one or more cationic lipids, and one or more stabilizing lipids. Stabilizing lipids include neutral lipids and PEGylated lipids.

In one embodiment, the LNP consists essentially of (i) at least one cationic lipid; (ii) a neutral lipid; (iii) a sterol, e.g., cholesterol; and (iv) a PEG-lipid, e.g. PEG-DMG or PEG-cDMA, in a molar ratio of about 20-0% cationic lipid:5-25% neutral lipid:25-55% sterol; 0.5-15% PEG-lipid.

In that context, a preferred sterol is cholesterol. The sterol can be about 10 mol % to about 60 mol % or about 25 mol % to about 40 mol % of the lipid particle. In one embodiment, the sterol is about 10, 15, 20, 25, 30, 35, 40, 45, 50, 55, or about 60 mol % of the total lipid present in the lipid particle. In another embodiment, the LNPs include from about 5% to about 50% on a molar basis of the sterol, e.g., about 15% to about 45%, about 20% to about 40%, about 48%, about 40%, about 38.5%, about 35%, about 34.4%, about 31.5% or about 31% on a molar basis (based upon 100% total moles of lipid in the lipid nanoparticle).

The cationic lipid of an LNP may be cationisable, i.e. it becomes protonated as the pH is lowered below the pK of the ionizable group of the lipid, but is progressively more neutral at higher pH values. At pH values below the pK, the lipid is then able to associate with negatively charged nucleic acids. In certain embodiments, the cationic lipid comprises a zwitterionic lipid that assumes a positive charge on pH decrease.

The LNP may comprise any further cationic or cationisable lipid, i.e. any of a number of lipid species which carry a net positive charge at a selective pH, such as physiological pH.

Such lipids include, but are not limited to, N,N-dioleyl-N,N-dimethylammonium chloride (DODAC); N-(2,3-dioleyloxy)propyl)-N,N,N-trimethylammonium chloride (DOTMA); N,N-distearyl-N,N-dimethylammonium bromide (DDAB); N-(2,3dioleoyloxy)propyl)-N,N,N-trimethylammonium chloride (DOTAP); 3-(N—(N',N'dimethylaminoethane)-carbamoyl)cholesterol (DC-Chol), N-(1-(2,3-dioleoyloxy)propyl)N-2-(sperminecarboxamido)ethyl)-N, N-dimethylammonium trifluoracetate (DOSPA), dioctadecylamidoglycyl carboxyspermine (DOGS), 1,2-dioleoyl-3-dimethylammonium propane (DODAP), N,N-dimethyl-2,3-dioleoyloxy)propylamine(DODMA), and N-(1, 2dimyristyloxyprop-3-yl)-N,N-dimethyl-N-hydroxyethylammonium bromide (DMRIE).

Additionally, a number of commercial preparations of cationic lipids are available which can be used in the present invention. These include, for example, LIPOFECTIN® (commercially available cationic liposomes comprising DOTMA and 1,2-dioleoyl-sn-3phosphoethanolamine (DOPE), from GIBCO/BRL, Grand Island, N.Y.); LIPOFECTAMINE® (commercially available cationic liposomes comprising N-(1-(2,3dioleyloxy)propyl)-N-(2-(sperminecarboxamido)ethyl)-N,N-dimethylammonium trifluoroacetate (DOSPA) and (DOPE), from GIBCO/BRL); and TRANSFECTAM® (commercially available cationic lipids comprising dioctadecylamidoglycyl carboxyspermine (DOGS) in ethanol from Promega Corp., Madison, Wis.). The following lipids are cationic and have a positive charge at below physiological pH: DODAP, DODMA, DMDMA, 1,2-dinoleyloxy-N,N-dimethylaminopropane (DLinDMA), 1,2-dilinolenyloxy-N,N-dimethylaminopropane (DLenDMA).

The further cationic lipid may also be an amino lipid. Representative amino lipids include, but are not limited to, 1,2-dilinoleyoxy-3-(dimethylamino)acetoxypropane (DLin-DAC), 1,2-dilinoleyoxy-3morpholinopropane (DLin-MA), 1,2-dilinoleoyl-3-dimethylaminopropane (DLinDAP), 1,2-dilinoleylthio-3-dimethylaminopropane (DLin-S-DMA), 1-linoleoyl-2-linoleyloxy-3dimethylaminopropane (DLin-2-DMAP), 1,2-dilinoleyloxy-3-trimethylaminopropane chloride salt (DLin-TMA.Cl), 1,2-dilinoleoyl-3-trimethylaminopropane chloride salt (DLin-TAP.Cl), 1,2-dilinoleyloxy-3-(N-methylpiperazino)propane (DLin-MPZ), 3-(N, Ndilinoleylamino)-1,2-propanediol (DLinAP), 3-(N,N-dioleylamino)-1,2-propanediol (DOAP), 1,2-dilinoleyloxo-3-(2-N,N-dimethylamino)ethoxypropane (DLin-EG-DMA), and 2,2-dilinoleyl-4-dimethylaminomethyl-[1,3]-dioxolane (DLin-K-DMA), 2,2-dilinoleyl-4-(2-dimethylaminoethyl)-[I,3]-dioxolane (DLin-KC2-DMA); dilinoley-methyl-4-dimethylaminobutyrate (DLin-MC3-DMA); MC3 (US20100324120).

Other suitable (cationic) lipids are disclosed in WO2009086558, WO2009/127060, WO2010/048536, WO2010/054406, WO2010/088537, WO2010/129709, WO2011/153493, US2011/0256175, US20120128760, US2012/0027803, and U.S. Pat. No. 8,158,601. In that context, the disclosures of WO2009/086558, WO2009/127060, WO2010/048536, WO2010/054406, WO2010088537, WO2010/129709, WO2011/153493, US2011/0256175, US2012/0128760, US2012/0027803, and U.S. Pat. No. 8,158,601 are incorporated herewith by reference.

In one embodiment, the at least one RNA may be formulated in an aminoalcohol lipidoid. Aminoalcohol lipidoids which may be used in the present invention may be prepared by the methods described in U.S. Pat. No. 8,450,298, herein incorporated by reference in its entirety. Suitable (ionizable) lipids can also be the compounds as disclosed in Tables 1, 2 and 3 and as defined in claims 1-24 of WO2017/075531A1, hereby incorporated by reference.

In another embodiment, ionizable lipids can also be the compounds as disclosed in WO2015074085A1 (i.e. ATX-001 to ATX-032 or the compounds as specified in claims 1-26), U.S. Appl. No. 61/905,724 and Ser. No. 15/614,499 or U.S. Pat. Nos. 9,593,077 and 9,567,296 hereby incorporated by reference in their entirety.

In that context, any lipid derived from generic formula (X1)

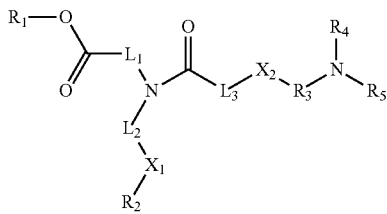

wherein, Ri and R2 are the same or different, each a linear or branched alkyl consisting of 1 to 9 carbons, an alkenyl or alkynyl consisting of 2 to 11 carbons, U and L2 are the same or different, each a linear alkylene or alkenylene consisting of 5 to 18 carbons, or forming a heterocycle with N, Xi is a bond, or is —CO—O— whereby -L2-CO—O—R2 is formed, X2 is S or O, L3 is a bond or a linear or branched alkylene consisting of 1 to 6 carbons, or forming a heterocycle with N, R3 is a linear or branched alkylene consisting of 1 to 6 carbons, and R4 and R are the same or different, each hydrogen or a linear or branched alkyl consisting of 1 to 6 carbons; or a pharmaceutically acceptable salt thereof may be suitably used.

In other embodiments, suitable cationic lipids can also be the compounds as disclosed in WO2017/117530A1 (i.e. lipids 13, 14, 15, 16, 17, 18, 19, 20, or the compounds as specified in the claims), hereby incorporated by reference in its entirety.

In that context, any lipid derived from generic formula (X2)

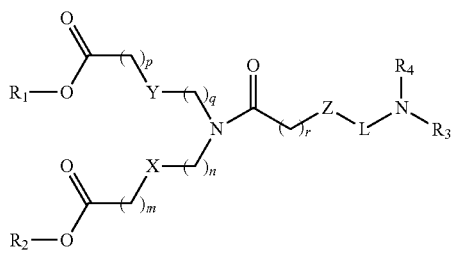

wherein
X is a linear or branched alkylene or alkenylene, monocyclic, bicyclic, or tricyclic arene or heteroarene;
Y is a bond, an ethene, or an unsubstituted or substituted aromatic or heteroaromatic ring; Z is S or 0;
L is a linear or branched alkylene of 1 to 6 carbons;
R-3 and R4 are independently a linear or branched alkyl of 1 to 6 carbons;
Ri and R2 are independently a linear or branched alkyl or alkenyl of 1 to 20 carbons; r is 0 to 6; and
m, n, p, and q are independently 1 to 18;
wherein when n=q, m=p, and Ri=R2, then X and Y differ;
wherein when X=Y, n=q, m=p, then Ri and R2 differ;
wherein when X=Y, n=q, and Ri=R2, then m and p differ; and
wherein when X=Y, m=p, and Ri=R2, then n and q differ;
or a pharmaceutically acceptable salt thereof.

In preferred embodiments, a lipid may be used derived from formula (X2), wherein, X is a bond, linear or branched alkylene, alkenylene, or monocyclic, bicyclic, or tricyclic arene or heteroarene; Y is a monocyclic, bicyclic, or tricyclic arene or heteroarene; Z is S or O; L is a linear or branched alkylene of 1 to 6 carbons; R3 and R4 are independently a linear or branched alkyl of 1 to 6 carbons; Ri and R2 are independently a linear or branched alkyl or alkenyl of 1 to 20 carbons; r is 0 to 6; and m, n, p, and q are independently 1 to 18; or a pharmaceutically acceptable salt thereof may be suitably used.

In preferred embodiments, ionizable lipids may also be selected from the lipids disclosed in WO2018078053A1 (i.e. lipids derived form formula I, II, and III of WO2018078053A1, or lipids as specified in Claims 1 to 12 of WO2018078053A1), the disclosure of WO2018078053A1 hereby incorporated by reference in its entirety. In that context, lipids disclosed in Table 7 of WO2018078053A1 (e.g. lipids derived from formula I-1 to I-41) and lipids disclosed in Table 8 of WO2018078053A1 (e.g. lipids derived from formula I-1 to II-36) may be suitably used in the context of the invention. Accordingly, formula I-1 to formula I-41 and formula II-1 to formula II-36 of WO2018078053A1, and the specific disclosure relating thereto, are herewith incorporated by reference.

In a particularly preferred embodiment the LNP comprises a cationic lipid with the formula (III) according to the patent application PCT/EP2016/075929. In this context, the disclosure of PCT/EP2016075929 relating to cationic lipids is incorporated herewith by reference.

In particularly preferred embodiments of the second aspect, a suitable lipid may be a cationic lipid according to formula (III)

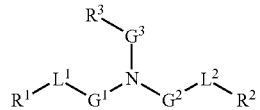

or a pharmaceutically acceptable salt, tautomer, prodrug or stereoisomer thereof, wherein, R1, R2, R3, L1, L2, G1, G2, and G3 are as below.

Formula (III) is further defined in that:
one of $L^1$ or $L^2$ is —O(C=O)—, —(C=O)O—, —C(=O)—, —O—, —S(O)$_x$—, —S—S—, —C(=O)S—, SC(=O)—, —NR$^a$C(=O)—, —C(=O)NR$^a$—, —NR$^a$C(=O)NR$^a$—, —OC(=O)NR$^a$— or —NR$^a$C(=O)O—, and the other of $L^1$ or $L^2$ is —O(C=O)—, —(C=O)O—, —C(=O)—, —O—, —S(O)$_x$—, —S—S—, —C(=O)S—, SC(=O)—, —NR$^a$C(=O)—, —C(=O)NR$^a$—, —NR$^a$C(=O)NR$^a$—, —OC(=O)NR$^a$— or —NR$^a$C(=O)O— or a direct bond;
$G^1$ and $G^2$ are each independently unsubstituted $C_1$-$C_{12}$ alkylene or $C_1$-$C_{12}$ alkenylene;

$G^3$ is $C_1$-$C_{24}$ alkylene, $C_1$-$C_{24}$ alkenylene, $C_3$-$C_8$ cycloalkylene, $C_3$-$C_8$ cycloalkenylene;

$R^a$ is H or $C_1$-$C_{12}$ alkyl;

$R^1$ and $R^2$ are each independently $C_6$-$C_{24}$ alkyl or $C_6$-$C_{24}$ alkenyl;

$R^3$ is H, $OR^5$, CN, —C(=O)$OR^4$, —OC(=O)$R^4$ or —$NR^5$C(=O)$R^4$;

$R^4$ is $C_1$-$C_{12}$ alkyl;

$R^5$ is H or $C_1$-$C_6$ alkyl; and x is 0, 1 or 2.

In some of the foregoing embodiments of formula (III), the lipid has one of the following structures (IIIA) or (IIIB):

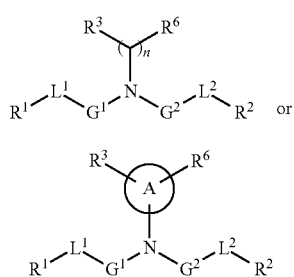

(IIIA)

(IIIB)

wherein:

A is a 3 to 8-membered cycloalkyl or cycloalkylene ring; $R^6$ is, at each occurrence, independently H, OH or $C_1$-$C_{24}$ alkyl; n is an integer ranging from 1 to 15.

In some of the foregoing embodiments of formula (III), the lipid has structure (IIIA), and in other embodiments, the lipid has structure (IIIB).

In other embodiments of formula (III), the lipid has one of the following structures (IIIC) or (IIID):

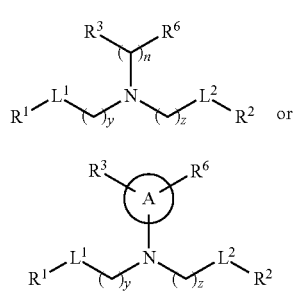

(IIIC)

(IIID)

wherein y and z are each independently integers ranging from 1 to 12.

In any of the foregoing embodiments of formula (III), one of $L^1$ or $L^2$ is —O(C=O)—. E.g., in some embodiments each of $L^1$ and $L^2$ are —O(C=O)—. In some different embodiments of any of the foregoing, $L^1$ and $L^2$ are each independently —(C=O)O— or —O(C=O)—. E.g., in some embodiments each of $L^1$ and $L^2$ is —(C=O)O—.

In preferred embodiments of the second aspect, the cationic lipid of the LNP is a compound of formula III, wherein:

$L^1$ and $L^2$ are each independently —O(C=O)— or (C=O)—O—;

$G^3$ is $C_1$-$C_{24}$ alkylene or $C_1$-$C_{24}$ alkenylene; and $R^3$ is H or $OR^5$.

In some different embodiments of formula (III), the lipid has one of the following structures (IIIE) or (IIIF):

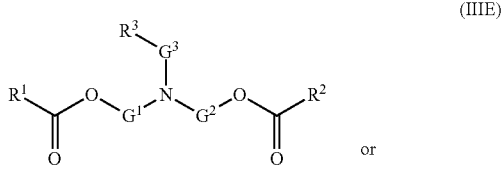

(IIIE)

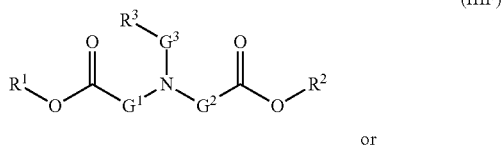

(IIIF)

or

In some of the foregoing embodiments of formula (III), the lipid has one of the following structures (IIIG), (IIIH), (IIII), or (IIIJ):

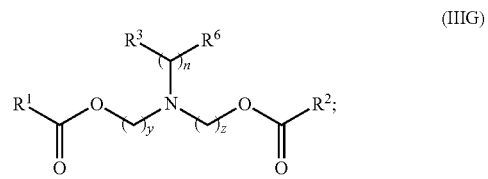

(IIIG)

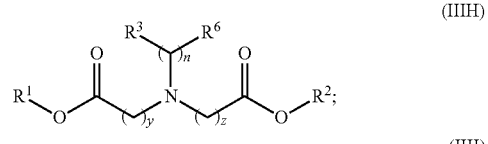

(IIIH)

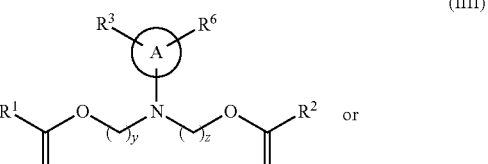

(IIII)

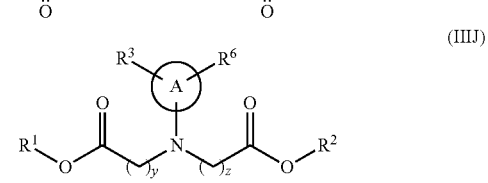

(IIIJ)

In some of the foregoing embodiments of formula (III), n is an integer ranging from 2 to 12, e.g. from 2 to 8 or from 2 to 4. In some embodiments, n is 3, 4, 5 or 6. In some embodiments, n is 3. In some embodiments, n is 4. In some embodiments, n is 5. In some embodiments, n is 6. In some other of the foregoing embodiments of formula (III), y and z are each independently an integer ranging from 2 to 10. E.g., in some embodiments, y and z are each independently an integer ranging from 4 to 9 or from 4 to 6. In some of the foregoing embodiments of formula (III), $R^6$ is H. In other of the foregoing embodiments, $R^6$ is $C_1$-$C_{24}$ alkyl. In other embodiments, $R^6$ is OH. In some embodiments of formula (III), $G^3$ is unsubstituted. In other embodiments, G3 is substituted. In various different embodiments, $G^3$ is linear $C_1$-$C_{24}$ alkylene or linear $C_1$-$C_{24}$ alkenylene. In some other foregoing embodiments of formula (III), $R^1$ or $R^2$, or both, is $C_6$-$C_{24}$ alkenyl. E.g., in some embodiments, $R^1$ and $R^2$ each, independently have the following structure:

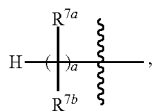

wherein:

$R^{7a}$ and $R^{7b}$ are, at each occurrence, independently H or $C_1$-$C_{12}$ alkyl; and a is an integer from 2 to 12, wherein $R^{7a}$, $R^{7b}$ and a are each selected such that $R^1$ and $R^2$ each independently comprise from 6 to 20 carbon atoms. E.g., in some embodiments a is an integer ranging from 5 to 9 or from 8 to 12. In some of the foregoing embodiments of formula (III), at least one occurrence of $R^{7a}$ is H. In some embodiments, $R^{7a}$ is H at each occurrence. In other different embodiments of the foregoing, at least one occurrence of $R^{7b}$ is $C_1$-$C_8$ alkyl. E.g., in some embodiments, $C_1$-$C_8$ alkyl is methyl, ethyl, n-propyl, iso-propyl, n-butyl, iso-butyl, tert-butyl, n-hexyl or n-octyl.

In different embodiments of formula (III), $R^1$ or $R^2$, or both, has one of the following structures:

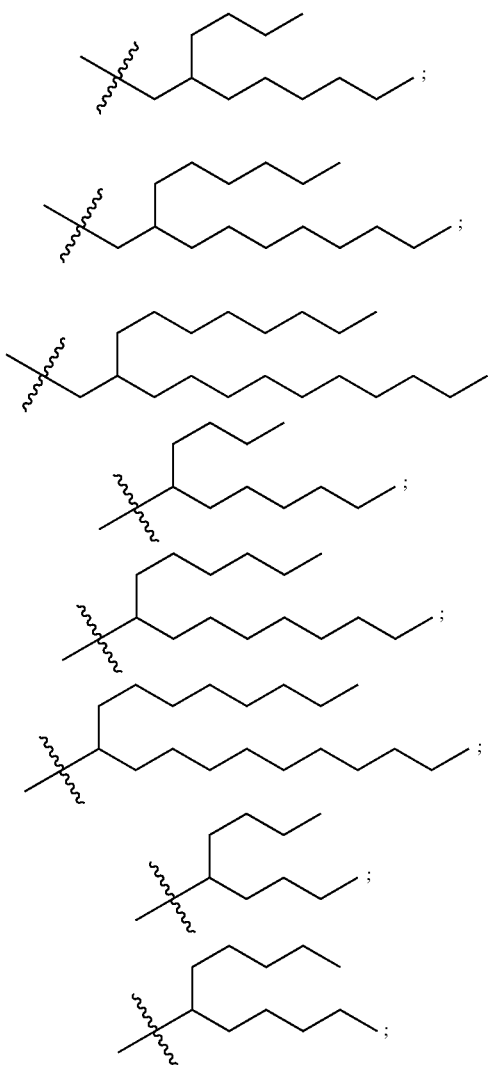

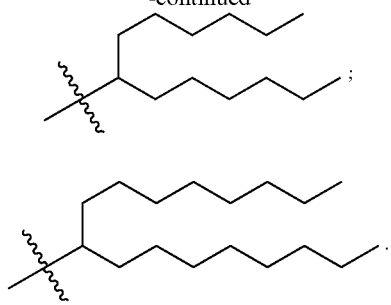

In preferred embodiments of the second aspect, the cationic lipid of the LNP is a compound of formula III, wherein:

$L^1$ and $L^2$ are each independently —O(C=O)— or (C=O)—O—; and $R^1$ and $R^2$ each independently have one of the following structures:

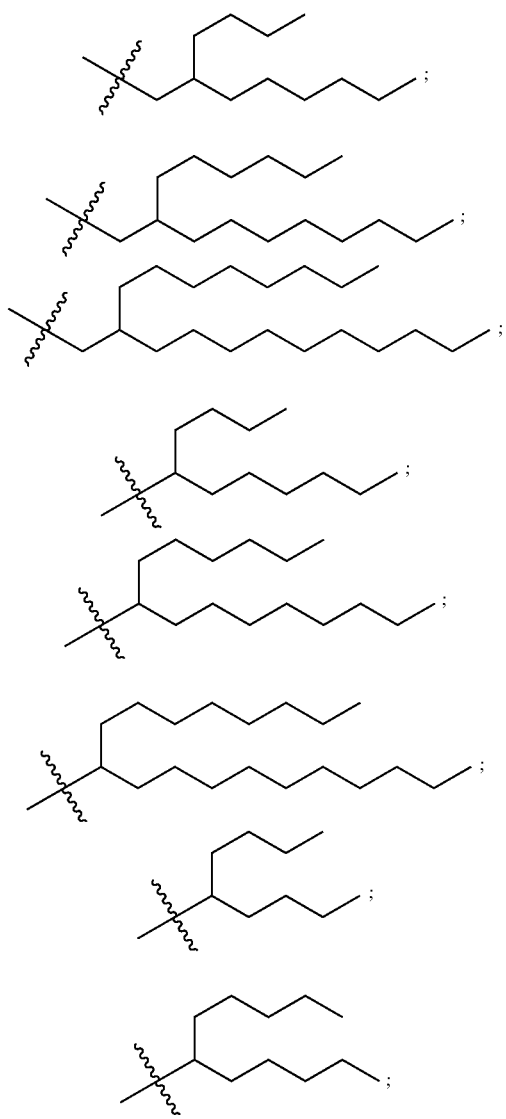

-continued

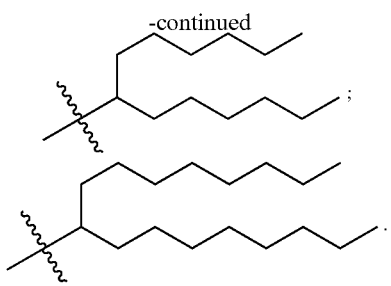

In some of the foregoing embodiments of formula (III), $R^3$ is OH, CN, —C(=O)OR$^4$, —OC(=O)R$^4$ or —NHC(=O)R$^4$. In some embodiments, $R^4$ is methyl or ethyl.

In preferred embodiments of the second aspect, the cationic lipid of the LNP is a compound of formula II, wherein $R^3$ is OH.

In particularly preferred embodiment of the second aspect, the at least one RNA is complexed with one or more lipids thereby forming LNPs, wherein the cationic lipid of the LNP is selected from structures III-1 to III-36 (see Table A).

TABLE A

Representative lipid compounds derived from formula (III)

| No. | Structure |
|---|---|
| III-1 | 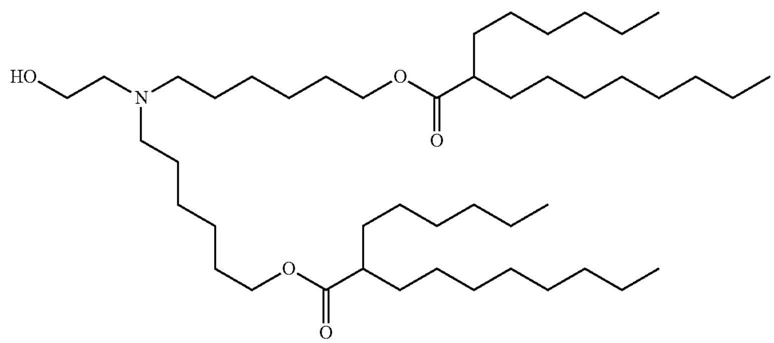 [SMILES: CCCCCCCCC(CCCCCC)C(=O)OCCCCCCN(CCO)CCCCCCOC(=O)C(CCCCCC)CCCCCCCC] |
| III-2 | 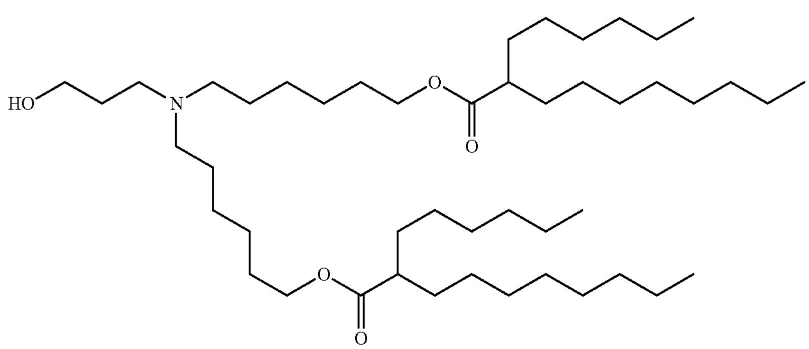 [SMILES: CCCCCCCCC(CCCCCC)C(=O)OCCCCCCN(CCCO)CCCCCCOC(=O)C(CCCCCC)CCCCCCCC] |
| III-3 | 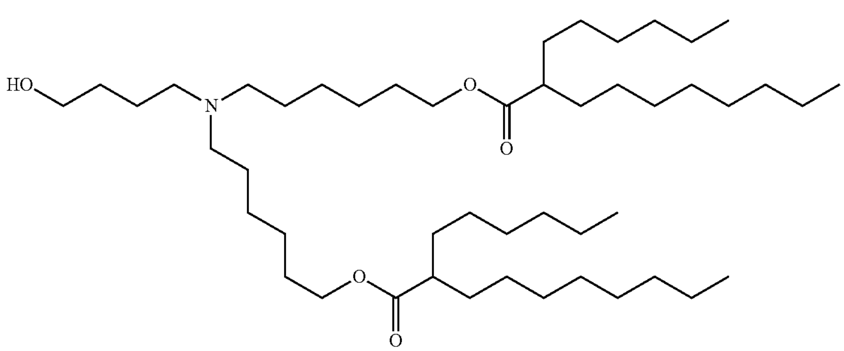 [SMILES: CCCCCCCCC(CCCCCC)C(=O)OCCCCCCN(CCCCO)CCCCCCOC(=O)C(CCCCCC)CCCCCCCC] |

TABLE A-continued

Representative lipid compounds derived from formula (III)

| No. | Structure |
|---|---|
| III-4 | 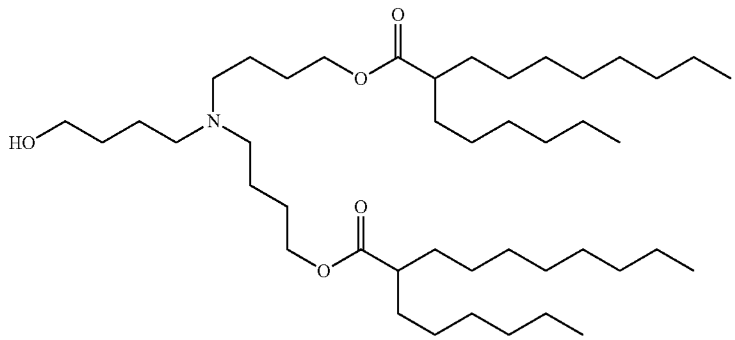 [SMILES: CCCCCCCCC(CCCCCC)C(=O)OCCCCN(CCCCO)CCCCOC(=O)C(CCCCCC)CCCCCCCC] |
| III-5 | 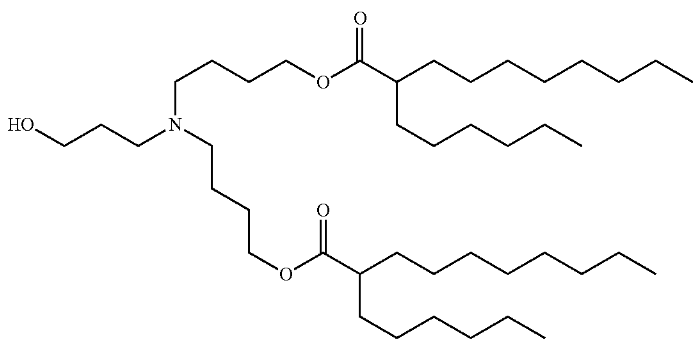 [SMILES: CCCCCCCCC(CCCCCC)C(=O)OCCCCN(CCCO)CCCCOC(=O)C(CCCCCC)CCCCCCCC] |
| III-6 | 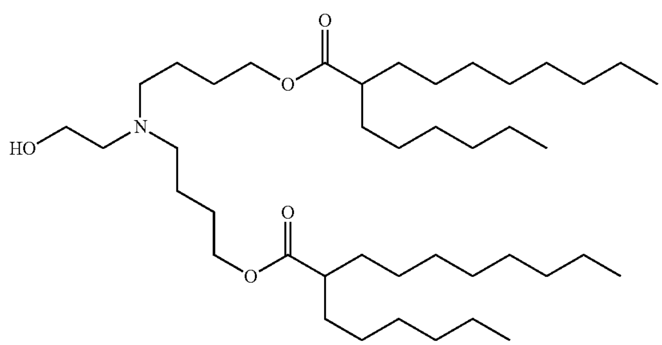 [SMILES: CCCCCCCCC(CCCCCC)C(=O)OCCCCN(CCO)CCCCOC(=O)C(CCCCCC)CCCCCCCC] |
| III-7 | 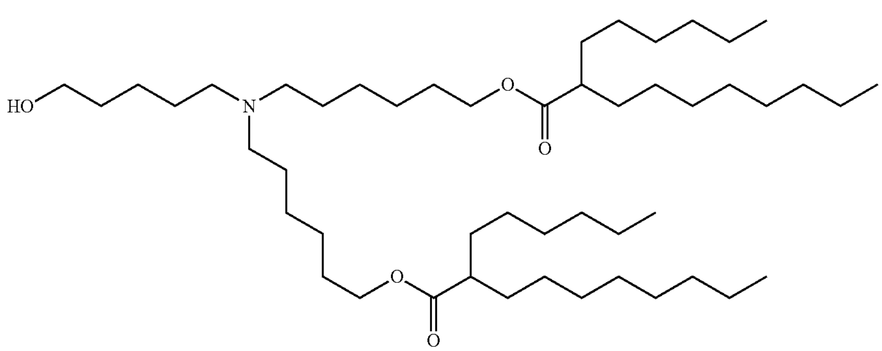 [SMILES: CCCCCCCCC(CCCCCC)C(=O)OCCCCCCN(CCCCCO)CCCCCCOC(=O)C(CCCCCC)CCCCCCCC] |

TABLE A-continued

Representative lipid compounds derived from formula (III)

| No. | Structure |
|---|---|
| III-8 | 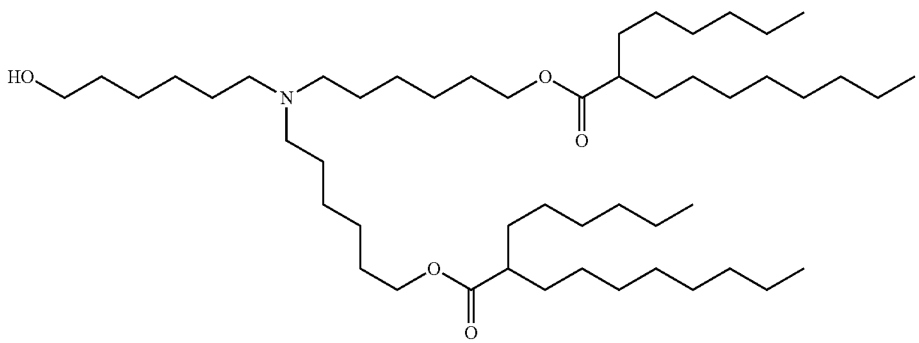 [SMILES: CCCCCCCCC(CCCCCC)C(=O)OCCCCCCN(CCCCCCO)CCCCCCOC(=O)C(CCCCCC)CCCCCCCC] |
| III-9 | 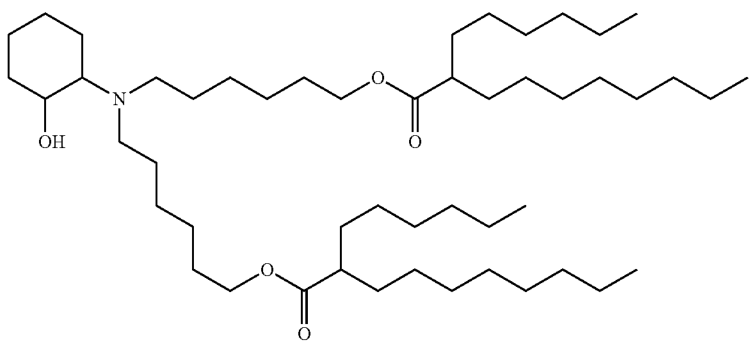 [SMILES: CCCCCCCCC(CCCCCC)C(=O)OCCCCCCN(CCCCCCOC(=O)C(CCCCCC)CCCCCCCC)C1CCCCC1O] |
| III-10 | 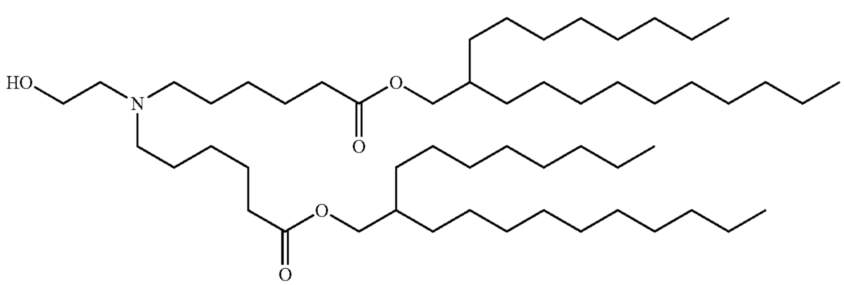 [SMILES: CCCCCCCCCCC(CCCCCCCC)COC(=O)CCCCCN(CCO)CCCCCC(=O)OCC(CCCCCCCC)CCCCCCCCCC] |
| III-11 | 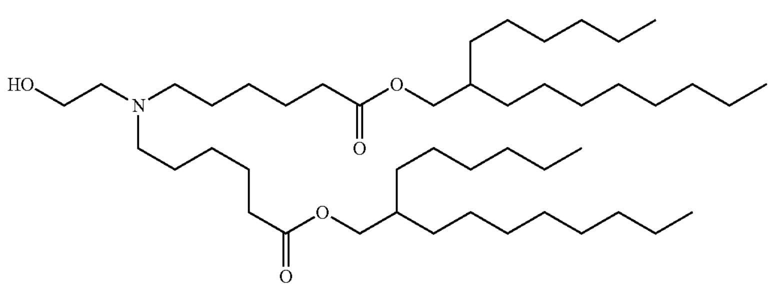 [SMILES: CCCCCCCCC(CCCCCC)COC(=O)CCCCCN(CCO)CCCCCC(=O)OCC(CCCCCC)CCCCCCCC] |
| III-12 | 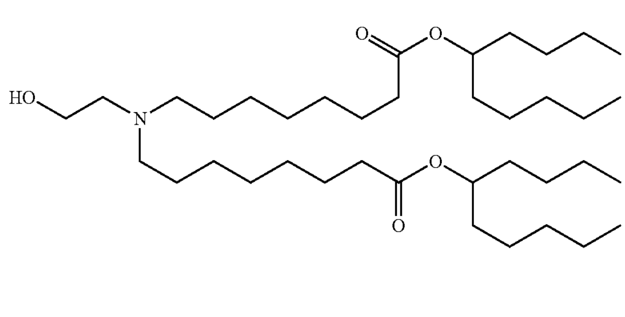 [SMILES: CCCCCC(CCCC)OC(=O)CCCCCCCN(CCO)CCCCCCCC(=O)OC(CCCC)CCCCC] |

TABLE A-continued
Representative lipid compounds derived from formula (III)
| No. | Structure |
|---|---|
| III-13 | 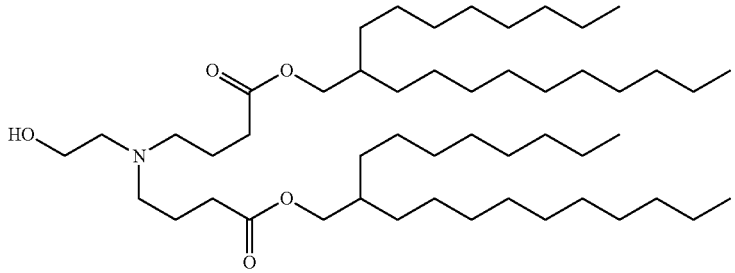 [SMILES: CCCCCCCCCCC(CCCCCCCC)COC(=O)CCCN(CCO)CCCC(=O)OCC(CCCCCCCC)CCCCCCCCCC] |
| III-14 | 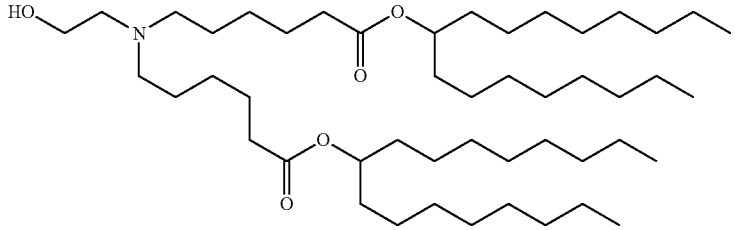 [SMILES: CCCCCCCCC(CCCCCCCC)OC(=O)CCCCCN(CCO)CCCCCC(=O)OC(CCCCCCCC)CCCCCCCC] |
| III-15 | 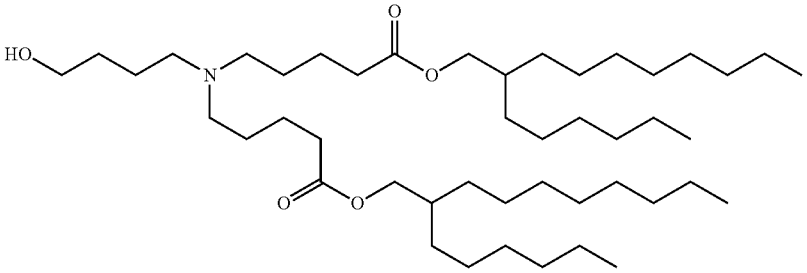 [SMILES: CCCCCCCCC(CCCCCC)COC(=O)CCCCN(CCCCO)CCCCC(=O)OCC(CCCCCC)CCCCCCCC] |
| III-16 | 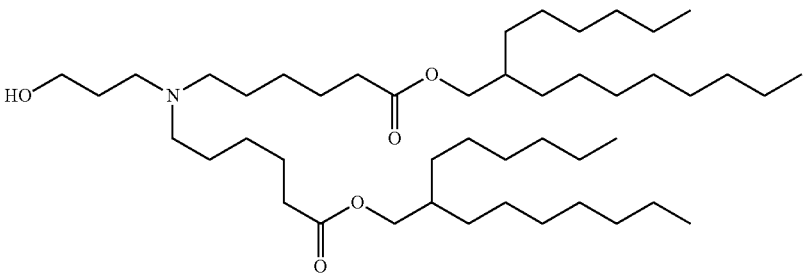 [SMILES: CCCCCCCCC(CCCCCC)COC(=O)CCCCCN(CCCO)CCCCCC(=O)OCC(CCCCCC)CCCCCCC] |
| III-17 | 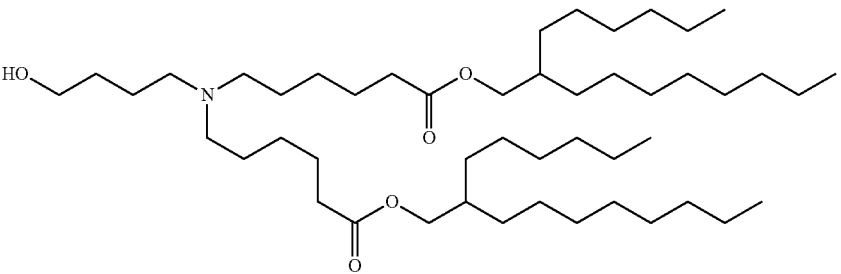 [SMILES: CCCCCCCCC(CCCCCC)COC(=O)CCCCCN(CCCCO)CCCCCC(=O)OCC(CCCCCC)CCCCCCCC] |

TABLE A-continued
Representative lipid compounds derived from formula (III)
| No. | Structure |
|---|---|
| III-18 | 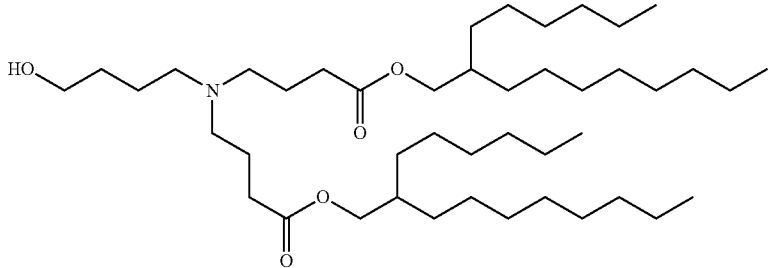 [SMILES: CCCCCCCCC(CCCCCC)COC(=O)CCCN(CCCCO)CCCC(=O)OCC(CCCCCC)CCCCCCCC] |
| III-19 | 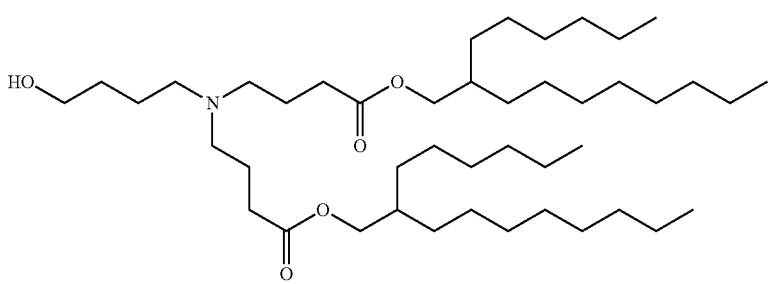 [SMILES: CCCCCCCCC(CCCCCC)COC(=O)CCCN(CCCCO)CCCC(=O)OCC(CCCCCC)CCCCCCCC] |
| III-20 | 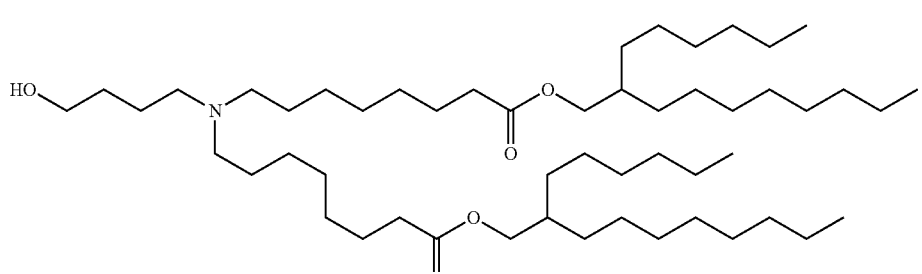 |
| III-21 | 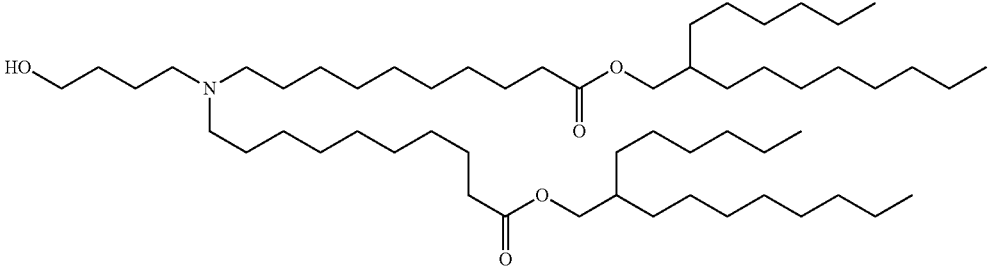 [SMILES: CCCCCCCCC(CCCCCC)COC(=O)CCCCCCCCCN(CCCCO)CCCCCCCCCC(=O)OCC(CCCCCC)CCCCCCCC] |
| III-22 | 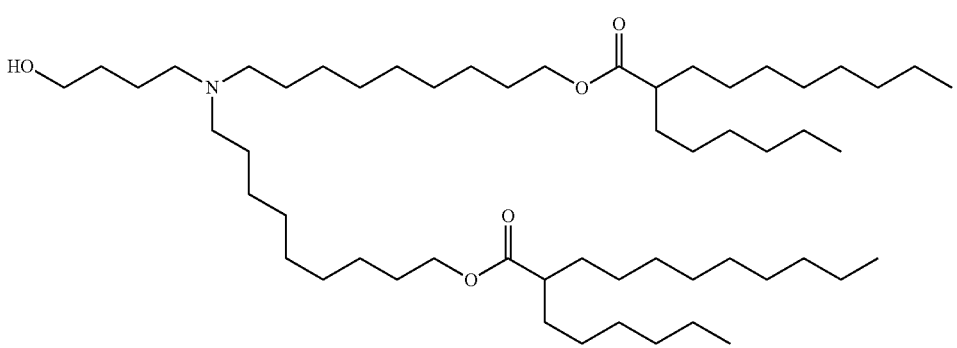 [SMILES: CCCCCCCCCC(CCCCCC)C(=O)OCCCCCCCCCN(CCCCO)CCCCCCCCCOC(=O)C(CCCCCC)CCCCCCCC] |

TABLE A-continued

Representative lipid compounds derived from formula (III)

| No. | Structure |
|---|---|
| III-23 | 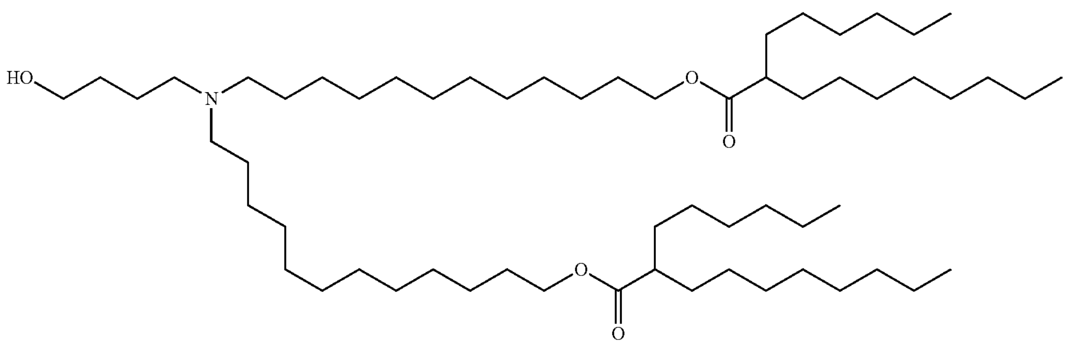 [SMILES: CCCCCCCCC(CCCCCC)C(=O)OCCCCCCCCCCCCN(CCCCO)CCCCCCCCCCCCOC(=O)C(CCCCCC)CCCCCCCC] |
| III-24 | 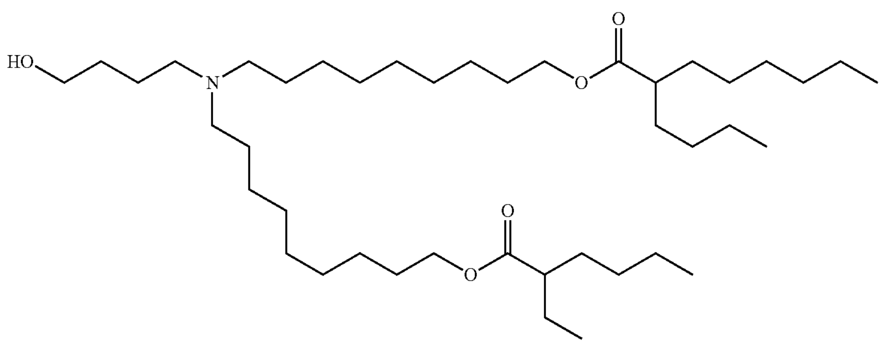 [SMILES: CCCCCCC(CCCC)C(=O)OCCCCCCCCCN(CCCCO)CCCCCCCCCOC(=O)C(CC)CCCC] |
| III-25 | 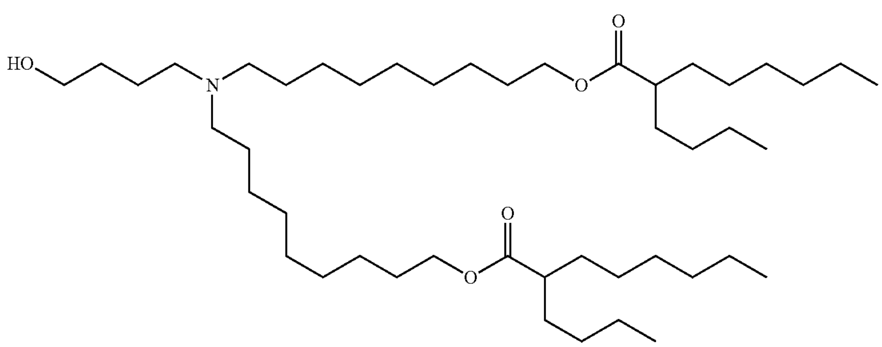 [SMILES: CCCCCCC(CCCC)C(=O)OCCCCCCCCCN(CCCCO)CCCCCCCCCOC(=O)C(CCCC)CCCCCC] |
| III-26 | 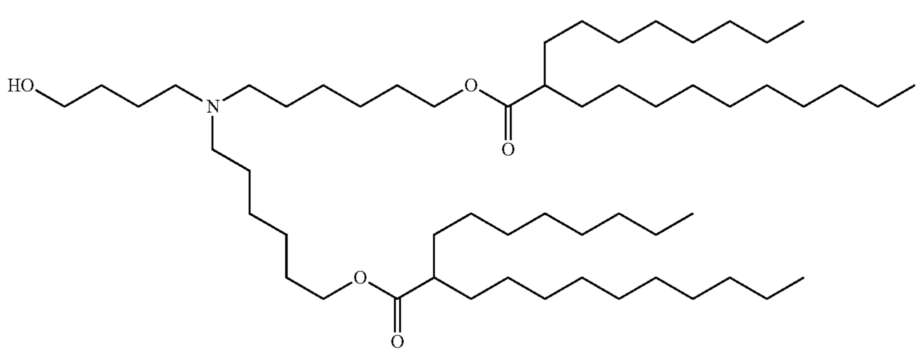 [SMILES: CCCCCCCCCCC(CCCCCCCC)C(=O)OCCCCCCN(CCCCO)CCCCCCOC(=O)C(CCCCCCCC)CCCCCCCCCC] |

TABLE A-continued

Representative lipid compounds derived from formula (III)

| No. | Structure |
|---|---|
| III-27 | 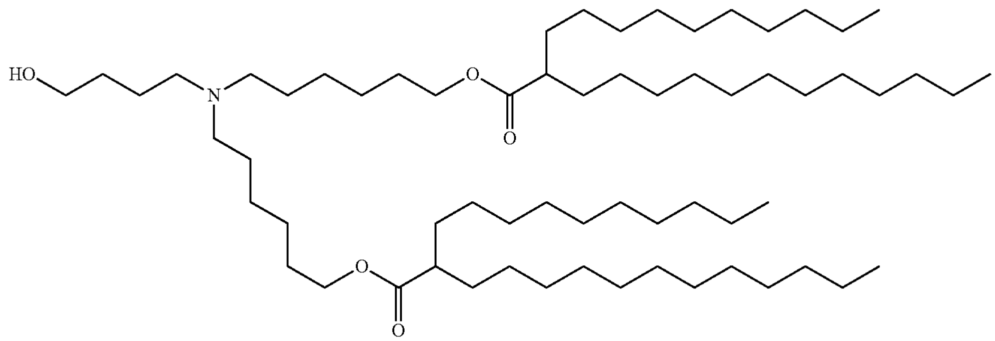 [SMILES: CCCCCCCCCCCCC(CCCCCCCCCC)C(=O)OCCCCCCN(CCCCO)CCCCCCOC(=O)C(CCCCCCCCCC)CCCCCCCCCCCC] |
| III-28 | 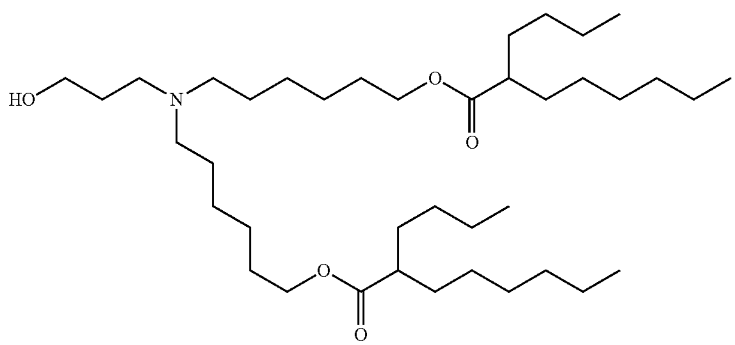 [SMILES: CCCCCCC(CCCC)C(=O)OCCCCCCN(CCCO)CCCCCCOC(=O)C(CCCC)CCCCCC] |
| III-29 | 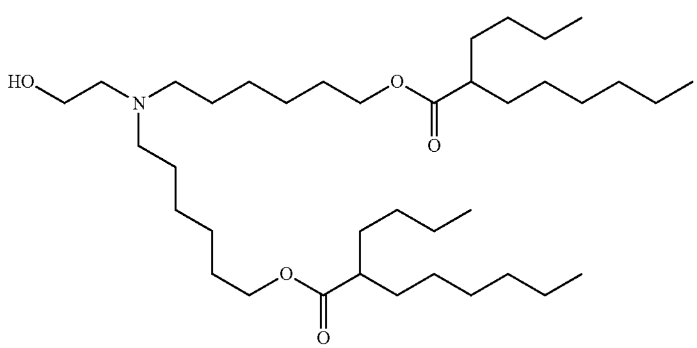 [SMILES: CCCCCCC(CCCC)C(=O)OCCCCCCN(CCO)CCCCCCOC(=O)C(CCCC)CCCCCC] |
| III-30 | 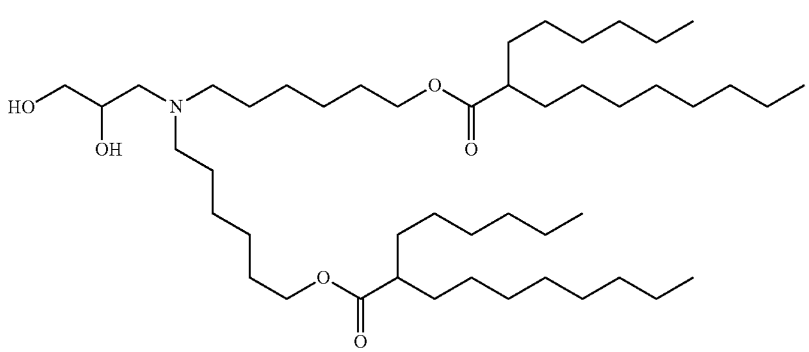 [SMILES: CCCCCCCCC(CCCCCC)C(=O)OCCCCCCN(CCCCCCOC(=O)C(CCCCCC)CCCCCCCC)CC(O)CO] |

TABLE A-continued

Representative lipid compounds derived from formula (III)

| No. | Structure |
|---|---|
| III-31 | 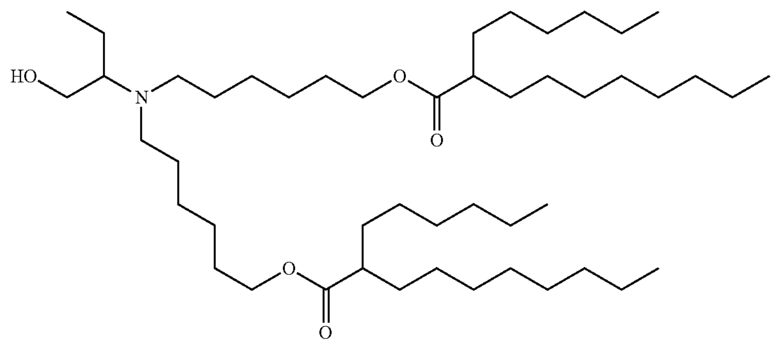 [SMILES: CCCCCCCCC(CCCCCC)C(=O)OCCCCCCN(CCCCCCOC(=O)C(CCCCCC)CCCCCCCC)C(CC)CO] |
| III-32 | 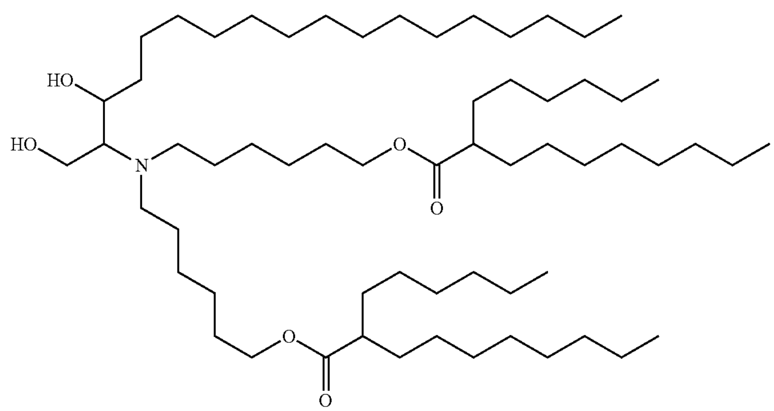 [SMILES: CCCCCCCCCCCCCCCC(O)C(CO)N(CCCCCCOC(=O)C(CCCCCC)CCCCCCCC)CCCCCCOC(=O)C(CCCCCC)CCCCCCCC] |
| III-33 | 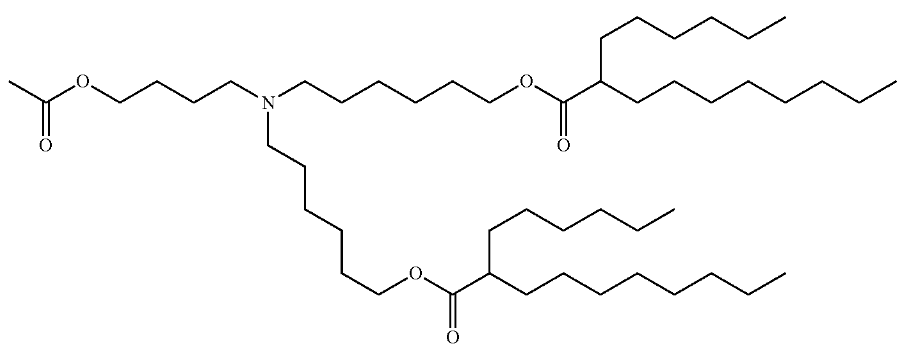 |
| III-34 | 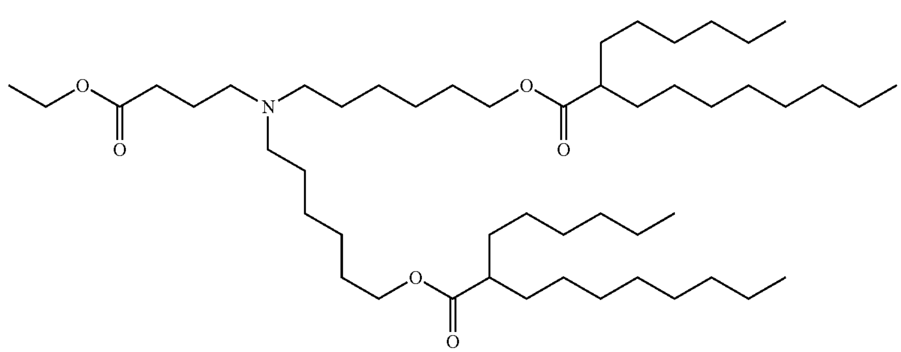 [SMILES: CCCCCCCCC(CCCCCC)C(=O)OCCCCCCN(CCCCCCOC(=O)C(CCCCCC)CCCCCCCC)CCCC(=O)OCC] |

TABLE A-continued

Representative lipid compounds derived from formula (III)

| No. | Structure |
|---|---|
| III-35 | 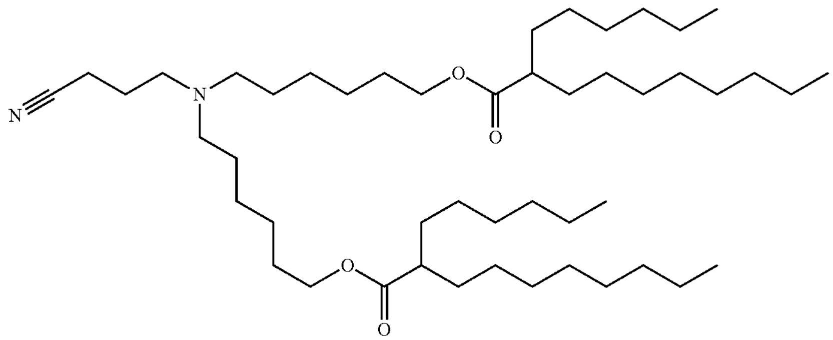 [SMILES: CCCCCCCCC(CCCCCC)C(=O)OCCCCCCN(CCCC#N)CCCCCCOC(=O)C(CCCCCC)CCCCCCCC] |
| III-36 | 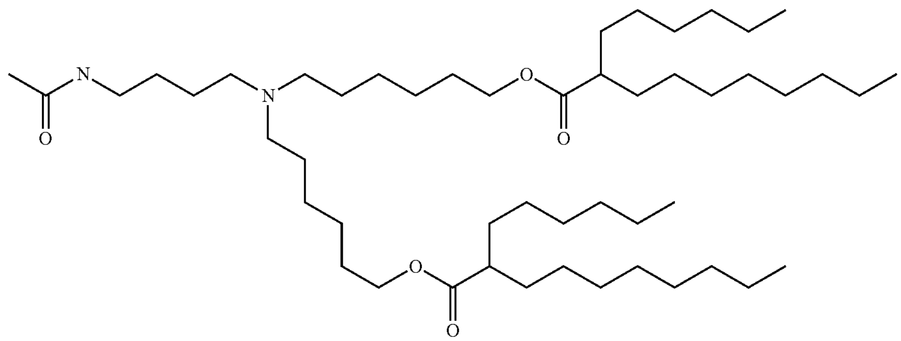 [SMILES: CCCCCCCCC(CCCCCC)C(=O)OCCCCCCN(CCCCCCOC(=O)C(CCCCCC)CCCCCCCC)CCCCNC(C)=O] |

In some embodiments, the LNP comprises a lipid of formula (III), at least one RNA of the first aspect, and one or more excipient selected from neutral lipids, steroids and PEGylated lipids. In some embodiments the lipid of formula (III) is compound III-3. In some embodiments the lipid of formula (III) is compound III-7.

In preferred embodiments, the LNP comprises a cationic lipid selected from:

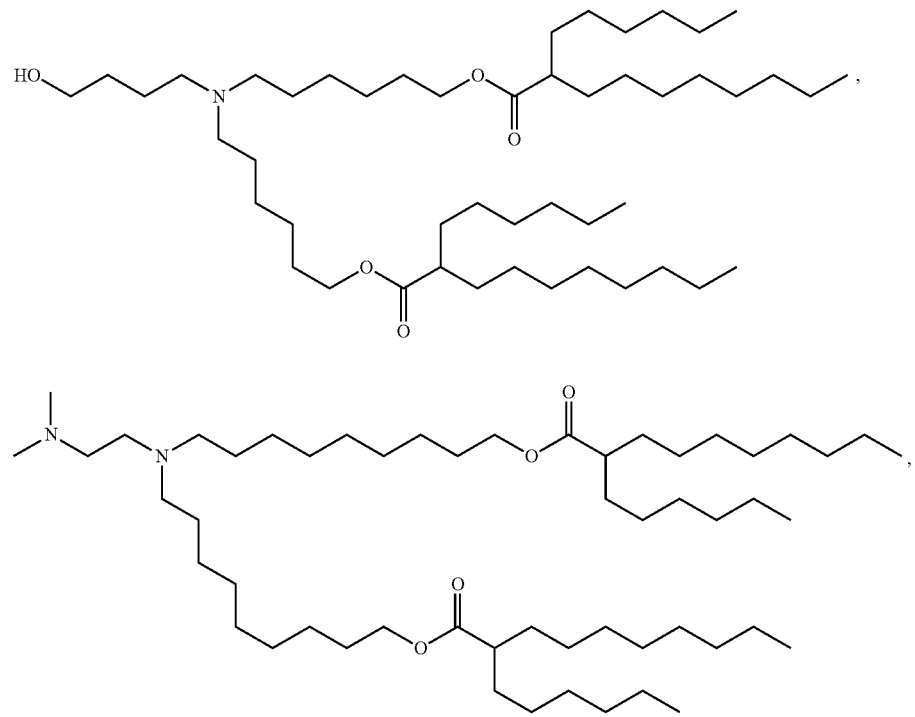

-continued

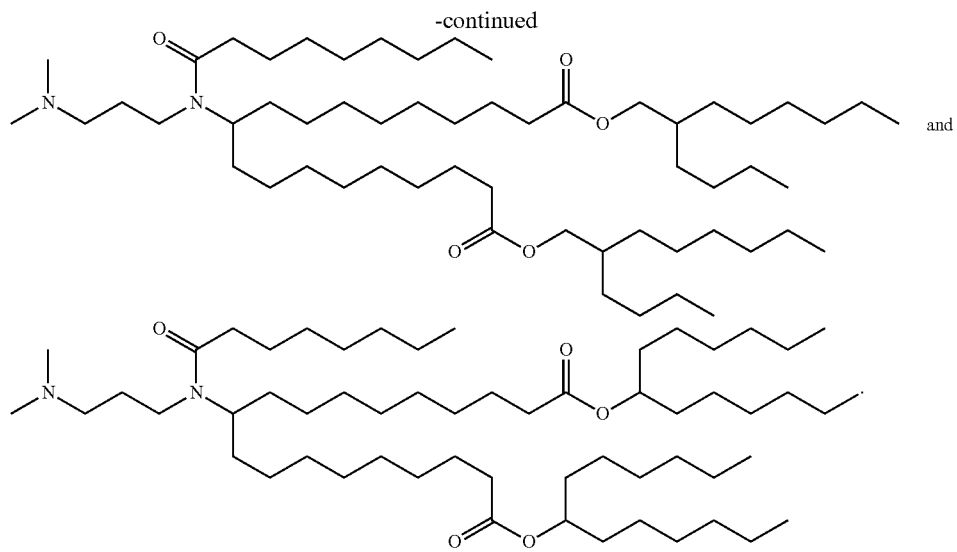

In particularly preferred embodiment of the second aspect, the at least one RNA is complexed with one or more lipids thereby forming LNPs, wherein the LNP comprises the following cationic lipid (lipid according to formula III-3 of Table A):

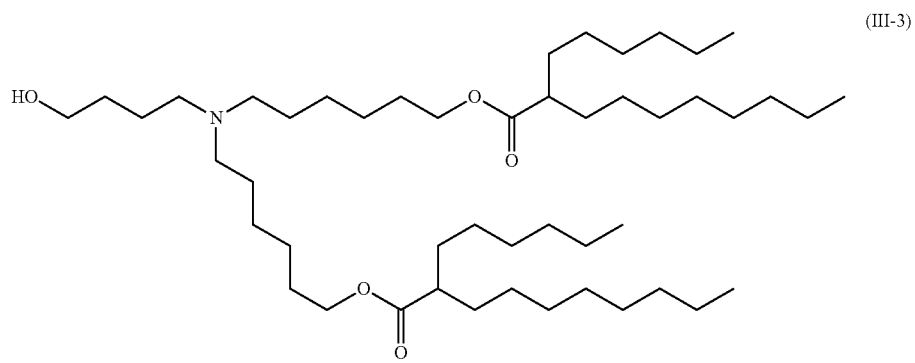 [SMILES: CCCCCCCCC(CCCCCC)C(=O)OCCCCCCN(CCCCO)CCCCCCOC(=O)C(CCCCCC)CCCCCCCC]

(III-3)

In certain embodiments, the cationic lipid as defined herein, preferably as disclosed in Table A more preferably cationic lipid compound III-3, is present in the LNP in an amount from about 30 to about 95 mole percent, relative to the total lipid content of the LNP. If more than one cationic lipid is incorporated within the LNP, such percentages apply to the combined cationic lipids.

In one embodiment, the cationic lipid is present in the LNP in an amount from about 30 to about 70 mole percent. In one embodiment, the cationic lipid is present in the LNP in an amount from about 40 to about 60 mole percent, such as about 40, 41, 42, 43, 44, 45, 46, 47, 48, 49, 50, 51, 52, 53, 54, 55, 56, 57, 58, 59 or 60 mole percent, respectively. In embodiments, the cationic lipid is present in the LNP in an amount from about 47 to about 48 mole percent, such as about 47.0, 47.1, 47.2, 47.3, 47.4, 47.5, 47.6, 47.7, 47.8, 47.9, 50.0 mole percent, respectively, wherein 47.7 mole percent are particularly preferred.

In some embodiments, the cationic lipid is present in a ratio of from about 20 mol % to about 70 or 75 mol % or from about 45 to about 65 mol % or about 20, 25, 30, 35, 40, 45, 50, 55, 60, 65, or about 70 mol % of the total lipid present in the LNP. In further embodiments, the LNPs comprise from about 25% to about 75% on a molar basis of cationic lipid, e.g., from about 20 to about 70%, from about 35 to about 65%, from about 45 to about 65%, about 60%, about 57.5%, about 57.1%, about 50% or about 40% on a molar basis (based upon 100% total moles of lipid in the LNP). In some embodiments, the ratio of cationic lipid to RNA is from about 3 to about 15, such as from about 5 to about 13 or from about 7 to about 11.

In some embodiments of the invention the LNP comprises a combination or mixture of any the lipids described above.

Other suitable (cationic) lipids are disclosed in WO2009/086558 WO2009/127060, WO2010/048536, WO2010/054406, WO2010/088537, WO2010/129709, WO2011/153493, US2011/0256175, US2012/0128760, US2012/0027803, U.S. Pat. No. 8,158,601, WO2016/118724, WO2016/118725, WO2017/070613, WO2017/070620, WO2017/099823, and WO2017/112865. In that context, the disclosures of WO2009086558, WO2009/127060, WO2010/048536, WO2010/054406, WO2010/088537, WO2010/129709, WO2011/153493, US2011/0256175, US2012/0128760, US2012/0027803, U.S. Pat. No. 8,158, 601, WO2016/118724, WO2016/118725, WO2017/070613, WO2017/070620, WO2017/099823, and WO2017/112865 specifically relating to (cationic) lipids suitable for LNPs are incorporated herewith by reference.

In some embodiments, the lipid is selected from the group consisting of 98N12-5. C12-200, and ckk-E12.

In some embodiments, amino or cationic lipids as defined herein have at least one protonatable or deprotonatable group, such that the lipid is positively charged at a pH at or below physiological pH (e.g. pH 7.4), and neutral at a second pH, preferably at or above physiological pH. It will, of course, be understood that the addition or removal of protons as a function of pH is an equilibrium process, and that the reference to a charged or a neutral lipid refers to the nature of the predominant species and does not require that all of lipids have to be present in the charged or neutral form. Lipids having more than one protonatable or deprotonatable group, or which are zwitterionic, are not excluded and may likewise suitable in the context of the present invention.

In some embodiments, the protonatable lipids have a pKa of the protonatable group in the range of about 4 to about 11, e.g., a pKa of about 5 to about 7.

LNPs can comprise two or more (different) cationic lipids. The cationic lipids may be selected to contribute different advantageous properties. E.g., cationic lipids that differ in properties such as amine pKa, chemical stability, half-life in circulation, half-life in tissue, net accumulation in tissue, or toxicity can be used in the LNP. In particular, the cationic lipids can be chosen so that the properties of the mixed-LNP are more desirable than the properties of a single-LNP of individual lipids.

The amount of the permanently cationic lipid or lipidoid may be selected taking the amount of the nucleic acid cargo into account. In one embodiment, these amounts are selected such as to result in an N/P ratio of the nanoparticle(s) or of the composition in the range from about 0.1 to about 20. In this context, the N/P ratio is defined as the mole ratio of the nitrogen atoms ("N") of the basic nitrogen-containing groups of the lipid or lipidoid to the phosphate groups ("P") of the RNA which is used as cargo. The N/P ratio may be calculated on the basis that, for example, 1 µg RNA typically contains about 3 nmol phosphate residues, provided that the RNA exhibits a statistical distribution of bases. The "N"-value of the lipid or lipidoid may be calculated on the basis of its molecular weight and the relative content of permanently cationic and—if present—cationisable groups.

In certain embodiments, the LNP comprises one or more additional lipids which stabilize the formation of particles during their formation.

Suitable stabilizing lipids include neutral lipids and anionic lipids. The term "neutral lipid" refers to any one of a number of lipid species that exist in either an uncharged or neutral zwitterionic form at physiological pH. Representative neutral lipids include diacylphosphatidylcholines, diacylphosphatidylethanolamines, ceramides, sphingomyelins, dihydro sphingomyelins, cephalins, and cerebrosides.

Exemplary neutral lipids include, for example, distearoylphosphatidylcholine (DSPC), dioleoylphosphatidylcholine (DOPC), dipalmitoylphosphatidylcholine (DPPC), dioleoylphosphatidylglycerol (DOPG), dipalmitoylphosphatidylglycerol (DPPG), dioleoyl-phosphatidylethanolamine (DOPE), palmitoyloleoylphosphatidykcholine (POPC), palmitoyloleoyl-phosphatidylethanolamine (POPE) and dioleoyl-phosphatidylethanolamine 4-(N-maleimidomethyl)-cyclohexane-1carboxylate (DOPE-mal), dipalmitoyl phosphatidyl ethanolamine (DPPE), dimyristoylphosphoethanolamine (DMPE), distearoyl-phosphatidylethanolamine (DSPE), 16-O-monomethyl PE, 16-O-dimethyl PE, 18-1-trans PE, 1-stearioyl-2-oleoylphosphatidyethanol amine (SOPE), and 1,2-dielaidoyl-sn-glycero-3-phophoethanolamine (transDOPE).

In one embodiment, the neutral lipid is 1,2-distearoyl-sn-glycero-3phosphocholine (DSPC).

In some embodiments, the LNPs comprise a neutral lipid selected from DSPC, DPPC, DMPC, DOPC, POPC, DOPE and SM. In various embodiments, the molar ratio of the cationic lipid to the neutral lipid ranges from about 2:1 to about 8:1.

In some embodiments, the cholesterol may be PEGylated.

The sterol can be about 10 mol % to about 60 mol % or about 25 mol % to about 40 mol % of the lipid particle. In one embodiment, the sterol is about 10, 15, 20, 25, 30, 35, 40, 45, 50, 55, or about 60 mol % of the total lipid present in the lipid particle. In another embodiment, the LNPs include from about 5% to about 50% on a molar basis of the sterol, e.g., about 15% to about 45%, about 20% to about 40%, about 48%, about 40%, about 38.5%, about 35%, about 34.4%, about 31.5% or about 31% on a molar basis (based upon 100% total moles of lipid in the LNP).

LNP in vivo characteristics and behavior can be modified by addition of a hydrophilic polymer coating. e.g. polyethylene glycol (PEG), to the LNP surface to confer steric stabilization. Furthermore, LNPs can be used for specific targeting by attaching ligands (e.g. antibodies, peptides, and carbohydrates) to its surface or to the terminal end of the attached PEG chains (e.g. via PEGylated lipids).

In some embodiments, the LNPs comprise a polymer conjugated lipid. The term "polymer conjugated lipid" refers to a molecule comprising both a lipid portion and a polymer portion. An example of a polymer conjugated lipid is a PEGylated lipid. The term "PEGylated lipid" refers to a molecule comprising both a lipid portion and a polyethylene glycol portion. PEGylated lipids are known in the art and include 1-(monomethoxy-polyethyleneglycol)-2,3-dimyristoylglycerol (PEG-s-DMG) and the like.

In certain embodiments, the LNP comprises an additional, stabilizing-lipid which is a polyethylene glycol-lipid (PEGylated lipid). Suitable polyethylene glycol-lipids include PEG-modified phosphatidylethanolamine, PEG-modified phosphatidic acid, PEG-modified ceramides (e.g. PEG-CerC14 or PEG-CerC20), PEG-modified dialkylamines, PEG-modified diacylglycerols, PEG-modified dialkylglycerols. Representative polyethylene glycol-lipids include PEG-c-DOMG, PEG-c-DMA, and PEG-s-DMG. In one embodiment, the polyethylene glycol-lipid is N-[(methoxy poly(ethylene glycol)$_{2000}$)carbamyl]-1,2-dimyristyloxlpropyl-3-amine (PEG-c-DMA). In one embodiment, the polyethylene glycol-lipid is PEG-c-DOMG). In other embodiments, the LNPs comprise a PEGylated diacylglycerol (PEG-DAG) such as 1-(monomethoxy-polyethylenegycol)-2,3-dimyristoylglycerol (PEG-DMG), a PEGylated phosphatidylethanoloamine (PEG-PE), a PEG succinate diacylglycerol (PEG-S-DAG) such as 4-O-(2',3'-di (tetradecanoyloxy)propyl-1-O-(ω-methoxy(polyethoxy) ethyl)butanedioate (PEG-S-DMG), a PEGylated ceramide (PEG-cer), or a PEG dialkoxypropylcarbamate such as ω-methoxy(polyethoxy)ethyl-N-(2,3di(tetradecanoxy)propyl)carbamate or 2,3-di(tetradecanoxy)propyl-N-(ω-methoxy (polyethoxy)ethyl)carbamate. In various embodiments, the molar ratio of the cationic lipid to the PEGylated lipid ranges from about 100:1 to about 25:1.

In preferred embodiments of the second aspect, the at least one RNA is complexed with one or more lipids thereby forming LNPs, wherein the LNP additionally comprises a PEGylated lipid with the formula (IV):

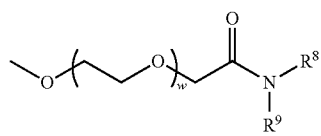

(IV)

or a pharmaceutically acceptable salt, tautomer or stereoisomer thereof, wherein $R^8$ and $R^9$ are each independently a straight or branched, saturated or unsaturated alkyl chain containing from 10 to 30 carbon atoms, wherein the alkyl chain is optionally interrupted by one or more ester bonds; and w has mean value ranging from 30 to 60.

In some of the foregoing embodiments of the PEGylated lipid according to formula (IV), $R^8$ and $R^9$ are not both n-octadecyl when w is 42. In some other embodiments, $R^8$ and $R^9$ are each independently a straight or branched, saturated or unsaturated alkyl chain containing from 10 to 18 carbon atoms. In some embodiments, $R^8$ and $R^9$ are each independently a straight or branched, saturated or unsaturated alkyl chain containing from 12 to 16 carbon atoms. In some embodiments, $R^8$ and $R^9$ are each independently a straight or branched, saturated or unsaturated alkyl chain containing 12 carbon atoms. In some embodiments, $R^8$ and $R^9$ are each independently a straight or branched, saturated or unsaturated alkyl chain containing 14 carbon atoms. In other embodiments, $R^8$ and $R^9$ are each independently a straight or branched, saturated or unsaturated alkyl chain containing 16 carbon atoms. In still more embodiments, $R^8$ and $R^9$ are each independently a straight or branched, saturated or unsaturated alkyl chain containing 18 carbon atoms. In still other embodiments, $R^8$ is a straight or branched, saturated or unsaturated alkyl chain containing 12 carbon atoms and $R^9$ is a straight or branched, saturated or unsaturated alkyl chain containing 14 carbon atoms.

In various embodiments, w spans a range that is selected such that the PEG portion of the PEGylated lipid according to formula (IV) has an average molecular weight of about 400 to about 6000 g/mol. In some embodiments, the average w is about 50.

In preferred embodiments of the second aspect, $R^8$ and $R^9$ of the PEGylated lipid according to formula (IV) are saturated alkyl chains.

In a particularly preferred embodiment of the second aspect, the at least one RNA is complexed with one or more lipids thereby forming LNPs, wherein the LNP additionally comprises a PEGylated lipid, wherein the PEG lipid is of formula (IVa)

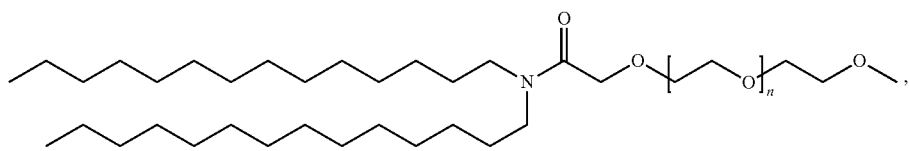
(IVa)

wherein n has a mean value ranging from 30 to 60, such as about 28 to about 32, about 30 to about 34, 32 to about 36, about 34 to about 38, 36 to about 40, about 38 to about 42, 40 to about 44, about 42 to about 46, 44 to about 48, about 46 to about 50, 48 to about 52, about 50 to about 54, 52 to about 56, about 54 to about 58, 56 to about 60, about 58 to about 62. In preferred embodiments, n is about 45, 46, 47, 48, 49, 50, 51, 52, 53, 54. In a most preferred embodiment n has a mean value of 49.

In other embodiments, the PEGylated lipid has one of the following structures:

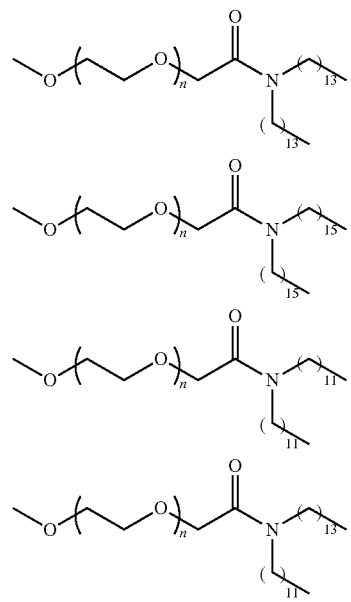

wherein n is an integer selected such that the average molecular weight of the PEGylated lipid is about 2500 g/mol, most preferably n is about 49.

Further examples of PEG-lipids suitable in that context are provided in US2015/0376115A1 and WO2015/199952, each of which is incorporated by reference in its entirety.

In some embodiments, LNPs include less than about 3, 2 or 1 mole percent of PEG or PEG-modified lipid based on the total moles of lipid in the LNP. In further embodiments, LNPs comprise from about 0.1% to about 20% of the PEG-modified lipid on a molar basis, e.g., about 0.5 to about 10%, about 0.5 to about 5%, about 10%, about 5%, about 3.5%, about 3%, about 2.5%, about 2%, about 1.5%, about 1%, about 0.5%, or about 0.3% on a molar basis (based on 100% total moles of lipids in the LNP). In preferred embodiments, LNPs comprise from about 1.0% to about 2.0% of the PEG-modified lipid on a molar basis, e.g., about 1.2 to about 1.9%, about 1.2 to about 1.8%, about 1.3 to about 1.8%, about 1.4 to about 1.8%, about 1.5 to about 1.8%, about 1.6 to about 1.8%, in particular about 1.4%, about 1.5%, about 1.6%, about 1.7%, about 1.8%, about 1.9%, most preferably 1.7% (based on 100% total moles of lipids in the LNP). In various embodiments, the molar ratio of the cationic lipid to the PEGylated lipid ranges from about 100:1 to about 25:1.

The total amount of nucleic acid, particularly the RNA in the lipid nanoparticles varies and may be defined depending on the e.g. RNA to total lipid w/w ratio. In one embodiment of the invention the RNA to total lipid ratio is less than 0.06 w/w, preferably between 0.03 w/w and 0.04 w/w.

Preferably, LNPs in the context of the invention comprise: (a) at least one RNA(encoding an antigenic peptide as defined herein), (b) a cationic lipid, (c) an aggregation reducing agent (such as polyethylene glycol (PEG) lipid or PEG-modified lipid) (d) optionally a non-cationic lipid (such as a neutral lipid), and (e) optionally, a sterol.

In some embodiments, the LNPs comprise a lipid of formula (III), at least one RNA as defined herein, a neutral lipid, a steroid and a PEGylated lipid. In preferred embodiments, the lipid of formula (III) is lipid compound III-3, the neutral lipid is DSPC, the steroid is cholesterol, and the PEGylated lipid is the compound of formula (IVa).

In a preferred embodiment of the second aspect, the LNP consists essentially of (i) at least one cationic lipid; (ii) a neutral lipid; (ii) a sterol, e.g., cholesterol; and (iv) a PEG-lipid, e.g. PEG-DMG or PEG-cDMA, in a molar ratio of about 20-60% cationic lipid:5-25% neutral lipid:25-55% sterol 0.5-15% PEG-lipid.

In particularly preferred embodiments of the second aspect, the at least one RNA is complexed with one or more lipids thereby forming LNPs, wherein the LNP essentially consists of (i) at least one cationic lipid as defined herein, preferably a lipid of formula (III), more preferably lipid III-3;

(ii) a neutral lipid as defined herein, preferably 1,2-distearoyl-sn-glycero-3-phosphocholine (DSPC);

(iii) a steroid or steroid analogue as defined herein, preferably cholesterol; and (iv) a PEG-lipid as defined herein, e.g. PEG-DMG or PEG-cDMA, preferably a PEGylated lipid of formula (IVa), wherein (i) to (iv) are in a molar ratio of about 20-60% cationic lipid:5-25% neutral lipid:25-55% sterol; 0.5-15% PEG-lipid.

In one preferred embodiment, the LNP comprises: a cationic lipid with formula (III) and/or PEG lipid with formula (IV), optionally a neutral lipid, preferably 1,2-distearoyl-sn-glycero-3-phosphocholine (DSPC) and optionally a steroid, preferably cholesterol, wherein the molar ratio of the cationic lipid to DSPC is optionally in the range from about 2:1 to 8:1, wherein the molar ratio of the cationic lipid to cholesterol is optionally in the range from about 2:1 to 1:1.

In a particular preferred embodiment, the composition of the second aspect comprising at least one RNA of the first aspect comprises LNPs, which have a molar ratio of approximately 50:10:38.5:1.5, preferably 47.5:10:40.8:1.7 or more preferably 47.4:10:40.9:1.7 (i.e. proportion (mol %) of cationic lipid (preferably lipid III-3), DSPC, cholesterol and PEG-lipid ((preferably PEG-lipid of formula (IVa) with n=49); solubilized in ethanol).

The total amount of RNA in the LNPs may vary and is defined depending on the e.g. RNA to total lipid w/w ratio. In one embodiment of the invention the RNA to total lipid ratio is less than 0.06 w/w, preferably between 0.03 w/w and 0.04 w/w.

In various embodiments, the LNP as defined herein have a mean diameter of from about 50 nm to about 200 nm, from about 60 nm to about 200 nm, from about 70 nm to about 200 nm, from about 80 nm to about 200 nm, from about 90 nm to about 200 nm, from about 90 nm to about 190 nm, from about 90 nm to about 180 nm, from about 90 nm to about 170 nm, from about 90 nm to about 160 nm, from about 90 nm to about 150 nm, from about 90 nm to about 140 nm, from about 90 nm to about 130 nm, from about 90 nm to about 120 nm, from about 90 nm to about 100 nm, from about 70 nm to about 90 nm, from about 80 nm to about 90 nm, from about 70 nm to about 80 nm, or about 30 nm, 35 nm, 40 nm, 45 nm, 50 nm, 55 nm, 60 nm, 65 nm, 70 nm, 75 nm, 80 nm, 85 nm, 90 nm, 95 nm, 100 nm, 105 nm, 110 nm, 115 nm, 120 nm, 125 nm, 130 nm, 135 nm, 140 nm, 145 nm, 150 nm, 160 nm, 170 nm, 180 nm, 190 nm, or 200 nm and are substantially non-toxic. As used herein, the mean diameter may be represented by the z-average as determined by dynamic light scattering as commonly known in the art.

In another preferred embodiment of the invention the lipid nanoparticles have a hydrodynamic diameter in the range from about 50 nm to about 300 nm, or from about 60 nm to about 250 nm, from about 60 nm to about 150 nm, or from about 60 nm to about 120 nm, respectively.

In embodiments where more than one or a plurality, e.g. 2, 3, 4, 5, 6, 7, 8, 9, 10, 11, 12, 13, 14, 15 of the RNAs of the first aspect are comprised in the composition, said more than one or said plurality e.g. 2, 3, 4, 5, 6, 7, 8, 9, 10, 11, 12, 13, 14, 15 of the RNAs may be complexed within one or more lipids thereby forming LNPs comprising more than one or a plurality, e.g. 2, 3, 4, 5, 6, 7, 8, 9, 10, 11, 12, 13, 14, 15 of different RNAs.

According to another embodiment, the composition, the pharmaceutical composition, the immunogenic composition as defined herein may comprise at least one adjuvant. Suitably, the adjuvant is preferably added to enhance the immunostimulatory properties of the composition, the pharmaceutical composition, the immunogenic composition.

The term "adjuvant" as used herein will be recognized and understood by the person of ordinary skill in the art, and is for example intended to refer to a pharmacological and/or immunological agent that may modify, e.g. enhance, the effect of other agents (herein: the effect of the artificial nucleic acid of the invention) or that may be suitable to support administration and delivery of the composition. The term "adjuvant" refers to a broad spectrum of substances. Typically, these substances are able to increase the immunogenicity of antigens. For example, adjuvants may be recognized by the innate immune systems and, e.g., may elicit an innate immune response (that is, a non-specific immune response). "Adjuvants" typically do not elicit an adaptive immune response. In the context of the invention, adjuvants may enhance the effect of the antigenic peptide or protein provided by the artificial nucleic acid as defined herein or the polyprotein as defined herein.

In that context, the at least one adjuvant may be selected from any adjuvant known to a skilled person and suitable for the present case, i.e. supporting the induction of an immune response in a subject, e.g. in a human subject.

Accordingly, the composition, the pharmaceutical composition, the immunogenic composition as defined herein may comprise at least one adjuvant, wherein the at least one adjuvant may be selected from the group consisting of: cationic or polycationic compounds, comprising cationic or polycationic peptides or proteins, including protamine, nucleoline, spermin or spermidine, poly-L-lysine (PLL), poly-arginine, basic polypeptides, cell penetrating peptides (CPPs), including HIV-binding peptides, Tat, HIV-1 Tat (HIV), Tat-derived peptides, Penetratin, VP22 derived or analog peptides, HSV VP22 (Herpes simplex), MAP, KALA or protein transduction domains (PTDs, PpT620, proline-rich peptides, arginine-rich peptides, lysine-rich peptides, MPG-peptide(s), Pep-1, L-oligomers, Calcitonin peptide(s), Antennapedia-derived peptides (particularly from Drosophila antennapedia), pAntp, pIsl, FGF, Lactoferrin, Transportan, Buforin-2, Bac715-24, SynB, SynB(1), pVEC, hCT-derived peptides, SAP, protamine, spermine, spermidine, or histones, cationic polysaccharides, including chitosan, polybrene, cationic polymers, including poyethyleneimine (PEI), cationic lipids, including DOTMA: [1-(2,3-sioleyloxy)propyl)]-N,N,N-trimethylammonium chloride, DMRIE, di-C14-amidine, DOTIM, SAINT, DC-Chol, BGTC, CTAP, DOPC, DODAP, DOPE: Dioleyl phosphatidylethanolamine, DOSPA, DODAB, DOIC, DMEPC, DOGS: Dioctadecylamidoglicylspermin, DIMRI: Dimyristo-oxypropyl dimethyl hydroxyethyl ammonium bromide, DOTAP: dioleoyloxy-3-(trimethylammonio)propane, DC-6-14: O,O-ditetradecanoyl-N-(α-trimethylammonioacetyl)diethanolamine chloride, CLIP1: rac-[(2,3-dioctadecyloxypropyl)(2-hydroxyethyl)]-dimethylammoniumchloride, CLIP6: rac-[(2,3-dihexadecyloxypropyl-oxymethyloxy)ethyl]-trimethylammonium, CLIP9: rac-[2(2,3-dihexadecyloxypropyl-oxysuccinyloxy)ethyl]-trimethylammonium, oligofectamine, or cationic or polycationic polymers, including modified polyaminoacids, including 3-aminoacid-polymers or reversed polyamides, modified polyethylenes, including PVP (poly(N-ethyl-4-vinylpyridinium bromide)), modified acrylates, including pDMAEMA (poly(dimethylaminoethyl methylacrylate)), modified Amidoamines including pAMAM (poly(amidoamine)), modified polybetaaminoester (PBAE), including diamine end modified 1,4 butanediol diacrylate-co-5-amino-1-pentanol polymers, dendrimers, including polypropylamine dendrimers or pAMAM based dendrimers, polyimine(s), including PEI: poly(ethyleneimine), poly(propyleneimine), polyallylamine, sugar backbone based polymers, including cyclodextrin based polymers, dextran based polymers, Chitosan, etc., silan backbone based polymers, such as PMOXA-PDMS copolymers, etc., block polymers consisting of a combination of one or more cationic blocks selected from a cationic polymer as mentioned before, and of one or more hydrophilic- or hydrophobic blocks (e.g polyethylenegycole); or cationic or polycationic proteins or peptides, selected from the following proteins or peptides having the following total formula (III): (Arg);(Lys)m;(His)n;(Orn)o;(Xaa)x, wherein l+m+n+o+x=8-15, and l, m, n or o independently of each other may be any number selected from 0, 1, 2, 3, 4, 5, 6, 7, 8, 9, 10, 11, 12, 13, 14 or 15, provided that the overall content of Arg, Lys, His and Orn represents at least 50% of all amino acids of the oligopeptide; and Xaa may be any amino acid selected from native (=naturally occurring) or non-native amino acids except from Arg, Lys, His or Orn; and x may be any number selected from 0, 1, 2, 3 or 4, provided, that the overall content of Xaa does not exceed 50% of all amino acids of the oligopeptide; or adjuvants selected from the group consisting of: TDM, MDP, muramyl dipeptide, pluronics, alum solution, aluminium hydroxide, ADJUMER™ (polyphosphazene); aluminium phosphate gel; glucans from algae; algammulin; aluminium hydroxide gel (alum); highly protein-adsorbing aluminium hydroxide gel; low viscosity aluminium hydroxide gel; AF or SPT (emulsion of squalane (5%), Tween 80 (0.2%), Pluronic L121 (1.25%), phosphate-buffered saline, pH 7.4); AVRIDINE™ (propanediamine); BAY R1005™ ((N-(2-deoxy-2-L-leucylamino-b-D-glucopyranosyl)-N-octadecyl-dodecanoyl-amide hydroacetate); CALCITRIOL™ (1-alpha,25-dihydroxy-vitamin D3); calcium phosphate gel; CAP™ (calcium phosphate nanoparticles); cholera holotoxin, cholera-toxin-A1-protein-A-D-fragment fusion protein, sub-unit B of the cholera toxin; CRL 1005 (block copolymer P1205); cytokine-containing liposomes; DDA (dimethyldoctadecylammonium bromide); DHEA (dehydroepiandrosterone); DMPC (dimyristoylphosphatidylcholine); DMPG (dimyristoylphosphatidylglycerol); DOC/alum complex (deoxycholic acid sodium salt); Freund's complete adjuvant; Freund's incomplete adjuvant; gamma inulin; Gerbu adjuvant (mixture of: i) N-acetylglucosaminyl-(P1-4)-N-acetylmuramyl-L-alanyl-D-glutamine (GMDP), ii) dimethyldioctadecylammonium chloride (DDA), iii) zinc-L-proline salt complex (ZnPro-8); GM-CSF); GMDP (N-acetylglucosaminyl-(b1-4)-N-acetylmuramyl-L-alanyl-D-isoglutamine); imiquimod (1-(2-methypropyl)-1H-imidazo[4,5-c]quinoline-4-amine); ImmTher™ (N-acetylglucosaminyl-N-acetylmuramyl-L-Aa-D-isoGlu-L-Ala-glycerol dipalmitate); DRVs (immunoliposomes prepared from dehydration-rehydration vesicles); interferon-gamma; interleukin-1beta; interleukin-2; intereukin-7; interleukin-12; ISCOMS™; ISCOPREP 7.0.3.™; liposomes; LOXORIBINE™ (7-allyl-8-oxoguanosine); LT oral adjuvant (E. coli labile enterotoxin-protoxin); microspheres and microparticles of any composition; MF59™; (squalene-water emulsion); MONTANIDE ISA 51™ (purified incomplete Freund's adjuvant); MONTANIDE ISA 720™ (metabolisable oil adjuvant); MPL™ (3-Q-desacyl-4'-monophosphoryl lipid A); MTP-PE and MTP-PE liposomes ((N-acetyl-L-alanyl-D-isoglutaminyl-L-alanine-2-(1,2-dipalmitoyl-sn-glycero-3-(hydroxyphosphoryloxy))-ethylamide, monosodium salt); MURAMETIDE™ (Nac-Mur-L-Ala-D-Gln-OCH3); MURAPALMITINE™ and D-MURAPALMITINE™ (Nac-Mur-L-Thr-D-isoGln-sn-glyceroldipalmitoyl); NAGO (neuraminidase-galactose oxidase); nanospheres or nanoparticles of any composition; NISVs (non-ionic surfactant vesicles); PLEURAN™ (β-glucan); PLGA, PGA and PLA (homo- and co-polymers of lactic acid and glycolic acid; microspheres/nanospheres); PLURONIC L121™; PMMA (polymethyl methacrylate); PODDS™ (proteinoid microspheres); polyethylene carbamate derivatives; poly-rA: poly-rU (polyadenylic acid-polyuridylic acid complex); polysorbate 80 (Tween 80); protein cochleates (Avanti Polar Lipids, Inc., Alabaster, Ala.); STIMULON™ (QS-21); Quil-A (Quil-A saponin); S-28463 (4-amino-otec-dimethyl-2-ethoxymethyl-1H-imidazo[4,5c]quinoline-1-ethanol); SAF-1™ ("Syntex adjuvant formulation"); Sendai proteoliposomes and Sendai-containing lipid matrices; Span-85 (sorbitan trioleate); Specol (emulsion of Marcol 52, Span 85 and Tween 85); squalene or Robane® (2,6,10,15,19,23-hexamethytetracosan and 2,6,10,15,19,23-hexamethyl-2,6,10,14,18,22-tetracosahexane); stearyltyrosine (octadecyltyrosine hydrochloride); Theramide (N-acetylglucosaminyl-N-acetylmuramyl-L-Ala-D-isoGlu-L-Ala-dipalmitoxypropylamide); Theronyl-MDP (Termurtide™ or [thr 1]-MDP; N-acetylmuramyl-L-threonyl-D-isoglutamine); Ty particles (Ty-VLPs or virus-like particles); Walter-Reed liposomes (liposomes containing lipid A adsorbed on aluminium hydroxide), and lipopeptides, including Pam3Cys, in particular aluminium salts, such as Adju-phos, Alhydrogel, Rehydragel; emulsions, including CFA, SAF, IFA, MF59, Provax, TiterMax, Montanide, Vaxfectin; copolymers, including Optivax (CRL1005), L121, Poloaxmer4010), etc.; liposomes, including Stealth, cochleates, including BIORAL; plant derived adjuvants, including QS21, Quil A, Iscomatrix, ISCOM; adjuvants suitable for costimulation including Tomatine, biopolymers, including PLG, PMM, Inulin; microbe derived adjuvants, including Romurtide, DETOX, MPL, CWS, Mannose, CpG nucleic acid sequences, CpG7909, ligands of human TLR 1-10, ligands of murine TLR 1-13, ISS-1018, IC31, Imidazoquinolines, Ampligen, Ribi29, IMOxine, IRIVs, VIPs, cholera toxin, heat-labile toxin, Pam3Cys, Flagellin, GPI anchor, LNFPII/Lewis X, antimicrobial peptides, UC-V150, RSV fusion protein, cdiGMP; and adjuvants suitable as antagonists including CGRP neuropeptide.

In embodiments, the composition, the pharmaceutical composition, the immunogenic composition as defined herein may comprise at least one adjuvant, wherein the at least one adjuvant may be an nucleic acid adjuvant having the formula GIXmGn or nucleic acid adjuvant having the formula CIXmCn as disclosed in WO2008014979 and WO2009095226, the disclosure relating thereto incorporated herein by reference, particularly preferred immunostimulatory nucleic acid sequences may be selected from nucleic acid sequences being identical, or at least 80%, 85%, 90%, 95%, 96%, 97%, 98%, 99% identical to any one of SEQ ID NOs: 25-33, or a fragment or variant of any of these sequences.

Further adjuvants that may be suitably used in that context are provided in WO2016/203025. With respect to suitable adjuvants that may be comprised in order to enhance the immunostimulatory properties of the composition according to the invention, the disclosure of WO2016203025 is included herewith by reference.

The inventive composition may contain, besides the components specified herein (e.g. at least one artificial nucleic acid, optionally at least one adjuvant) at least one further component which may be selected from the group comprising: further antigens (e.g. in the form of a peptide or protein) or further antigen-encoding nucleic acids; a further immunotherapeutic agent; one or more auxiliary substances; or any further compound, which is known to be immune stimulating due to its binding affinity (as ligands) to human Toll-like receptors; and/or an adjuvant nucleic acid, preferably an immunostimulatory RNA (isRNA).

The composition of the present invention can additionally contain at least one or more auxiliary substances in order to increase its immunogenicity or immunostimulatory capacity, if desired. A synergistic action of the nucleic acid or preferably the mRNA as defined herein and of an auxiliary substance, which may be optionally contained in the inventive composition, is preferably achieved thereby. Depending on the various types of auxiliary substances, various mechanisms can come into consideration in this respect. For example, compounds that permit the maturation of dendritic cells (DCs), for example lipopolysaccharides, TNF-alpha or CD40 ligand form a first class of suitable auxiliary substances. In general, it is possible to use as auxiliary substance any agent that influences the immune system in the manner of a "danger signal" (LPS, GP96, etc.) or cytokines, such as GM-CFS, which allow an immune response to be enhanced and/or influenced in a targeted manner. Particularly preferred auxiliary substances are cytokines, such as monokines, lymphokines, interleukins or chemokines, that further promote the innate immune response, such as IL-1, IL-2, IL-3, IL-4, IL-5, IL-6, IL-7, IL-8, IL-9, IL-10, IL-12, IL-13, IL-14, IL-15, IL-16, IL-17, IL-18, IL-19, IL-20, IL-21, IL-22, IL-23, IL-24, IL-25, IL-26, IL-27, IL-28, IL-29, IL-30, IL-31, IL-32, IL-33, IFN-alpha, IFN-beta, IFN-gamma, GM-CSF, G-CSF, M-CSF, LT-beta or TNF-alpha, growth factors, such as hGH.

The inventive composition can also additionally contain any further compound, which is known to be immune-stimulating due to its binding affinity (as ligands) to human Toll-like receptors TLR1, TLR2, TLR3, TLR4, TLR5, TLR6, TLR7, TLR8, TLR9, TLR10, or due to its binding affinity (as ligands) to murine Toll-like receptors TLR1, TLR2, TLR3, TLR4, TLR5, TLR6, TLR7, TLR8, TLR9, TLR10, TLR11, TLR12 or TLR13.

Another class of compounds, which may be added to an inventive composition in this context, may be CpG nucleic acids, in particular CpG-RNA or CpG-DNA. A CpG-RNA or CpG-DNA can be a single-stranded CpG-DNA (ss CpG-DNA), a double-stranded CpG-DNA (dsDNA), a single-stranded CpG-RNA (ss CpG-RNA) or a double-stranded CpG-RNA (ds CpG-RNA). The CpG nucleic acid is preferably in the form of CpG-RNA, more preferably in the form of single-stranded CpG-RNA (ss CpG-RNA). The CpG nucleic acid preferably contains at least one or more (mitogenic) cytosine/guanine dinucleotide sequence(s) (CpG motif(s)). According to a first preferred alternative, at least one CpG motif contained in these sequences, that is to say the C (cytosine) and the G (guanine) of the CpG motif, is unmethylated. All further cytosines or guanines optionally contained in these sequences can be either methylated or unmethylated. According to a further preferred alternative, however, the C (cytosine) and the G (guanine) of the CpG motif can also be present in methylated form.

Vaccine:

In a further aspect, the present invention provides a vaccine, wherein the vaccine comprises the artificial nucleic acid as defined herein, particularly the RNA as defined herein, the polypeptide as defined herein, or the composition (preferably pharmaceutical composition, immunogenic composition) as defined herein.

Suitably, the vaccine comprising the artificial nucleic acid as defined herein, particularly the RNA as defined herein, the polypeptide as defined herein, or the composition (preferably pharmaceutical composition, immunogenic composition) as defined herein, elicits an adaptive immune response.

The term "vaccine" will be recognized and understood by the person of ordinary skill in the art, and is for example intended to be a prophylactic or therapeutic material providing at least one epitope or antigen, preferably an immunogen. The antigen or immunogen may be derived from any material that is suitable for vaccination. For example, the antigen or immunogen may be derived from a pathogen, such as virus particles etc. The antigen or immunogen stimulates the adaptive immune system of a subject (e.g. mammalian subject, human subject) to provide an adaptive immune response. In the context of the present invention, the antigen is preferably provided via an artificial nucleic acid encoding at least one antigenic amino acid sequence derived from a virus of the order Bunyavirales as defined herein.

The vaccine according to the invention is preferably a pharmaceutical composition or an immunogenic composition as defined herein. Any embodiments relating to the composition, the pharmaceutical composition or the immunogenic composition as specified herein may also be read one each and every embodiment relating to the vaccine of the invention. Accordingly, the vaccine according to the invention is based on the same components as composition, the pharmaceutical composition or the immunogenic composition described herein. Insofar, it may be referred to the respective description as provided herein.

In embodiments, where the vaccine comprises more than one artificial nucleic acid, particularly more than one RNA sequences (such as a plurality of RNA sequences according to the invention, wherein each preferably encodes a distinct antigenic peptide or protein), the vaccine may be provided in physically separate form and may be administered by separate administration steps. Accordingly, in embodiments, wherein the vaccine comprises more than one artificial nucleic acid or RNA sequences/species, these RNA species may be provided such that, for example, two, three, four, five or six separate compositions, which may contain at least one RNA species/sequence each (e.g. three distinct RNA species/sequences), each encoding distinct antigenic peptides or proteins, are provided, which may or may not be combined. Also, the inventive vaccine may be a combination of at least two distinct compositions, each composition comprising at least one artificial nucleic acid, preferably RNA encoding at least one of the antigenic peptides or proteins defined herein. Alternatively, the vaccine may be provided as a combination of at least one artificial nucleic acid, preferably RNA, preferably at least two, three, four, five, six or more RNAs, each encoding one of the antigenic peptides or proteins defined herein. The vaccine may be combined to provide one single composition prior to its use or it may be used such that more than one administration is required to administer the distinct artificial nucleic acid sequences/species encoding any of the antigenic peptides or proteins as defined herein. If the vaccine contains at least one artificial nucleic acid, typically at least two artificial nucleic acids, encoding the antigen combinations defined herein, it may e.g. be administered by one single administration (combining all artificial nucleic acid species/sequences), by at least two separate administrations. Accordingly, any combination of mono-, bi- or multicistronic artificial nucleic acid, particularly mRNAs encoding the at least one antigenic peptide or protein or any combination of antigens as defined herein (and optionally further antigens), provided as separate entities (containing one mRNA species) or as combined entity (containing more than one mRNA species), is understood as a vaccine according to the present invention.

The vaccine or composition typically comprises a safe and effective amount of the artificial nucleic acid, particularly RNA as defined herein, encoding an antigenic peptide or protein as defined herein or a fragment or variant thereof or a combination of antigens, preferably as defined herein. As used herein, "safe and effective amount" means an amount of the artificial nucleic acid that is sufficient to significantly induce a positive modification of a disease or disorder related to an infection with a virus as defined herein. At the same time, however, a "safe and effective amount" is small enough to avoid serious side-effects. The determination of these limits typically lies within the scope of sensible medical judgment. In relation to the vaccine or composition of the present invention, the expression "safe and effective amount" preferably means an amount of the artificial nucleic acid, preferably the RNA (and thus of the encoded virus antigen) that is suitable for stimulating the adaptive immune system in such a manner that no excessive or damaging immune reactions are achieved but, preferably, also no such immune reactions below a measurable level. A "safe and effective amount" of the artificial nucleic acid, particularly the RNA of the composition or vaccine as defined above will furthermore vary in connection with the particular condition to be treated and also with the age and physical condition of the patient to be treated, the severity of the condition, the duration of the treatment, the nature of the accompanying therapy, of the particular pharmaceutically acceptable carrier used, and similar factors, within the knowledge and experience of the accompanying medical doctor.

The vaccine or composition according to the invention can be used according to the invention for human medical purposes and also for veterinary medical purposes (mammals, vertebrates, avian species), as a pharmaceutical composition, immunogenic composition or as a vaccine.

In a preferred embodiment, the nucleic acid, particularly the RNA of the composition, pharmaceutical composition, immunogenic composition, vaccine according to the invention is provided in lyophilized form (as defined herein using lyophilisation methods as described in WO2016/165831, WO2011/069586, WO2016/184575 or WO2016/184576). Preferably, the lyophilized mRNA is reconstituted in a suitable buffer, advantageously based on an aqueous carrier, prior to administration, e.g. Ringer-Lactate solution, which is preferred. Ringer solution, a phosphate buffer solution. In a preferred embodiment, the composition, pharmaceutical composition, immunogenic composition, the vaccine or the kit of parts according to the invention contains at least one, two, three, four, five, six or more artificial nucleic acid (species), particularly, mRNAs, preferably mRNAs which are provided separately in lyophilized form (optionally together with at least one further additive) and which are preferably reconstituted separately in a suitable buffer (such as Ringer-Lactate solution) prior to their use so as to allow individual administration of each of the (monocistronic) mRNAs.

The vaccine or composition according to the invention may typically contain a pharmaceutically acceptable carrier as defined herein and optionally at least one adjuvant as defined herein.

Accordingly, the pharmaceutically acceptable carrier as used herein preferably includes the liquid or non-liquid basis of the inventive vaccine. If the inventive vaccine is provided in liquid form, the carrier will be water, typically pyrogen-free water isotonic saline or buffered (aqueous) solutions, e.g. phosphate, citrate etc. buffered solutions. Preferably, Ringer-Lactate solution is used as a liquid basis for the vaccine or the composition according to the invention as described in WO2006/122828, the disclosure relating to suitable buffered solutions incorporated herewith by reference.

In embodiments, one or more compatible solid or liquid fillers or diluents or encapsulating compounds may be used, which are suitable for administration to a human subject. The term "compatible" as used herein means that the constituents of the inventive vaccine are capable of being mixed with the artificial nucleic acid, particularly the mRNA according to the invention as defined herein, in such a manner that no interaction occurs, which would substantially reduce the pharmaceutical effectiveness of the inventive vaccine or composition under typical use conditions. Pharmaceutically acceptable carriers, fillers and diluents must, of course, have sufficiently high purity and sufficiently low toxicity to make them suitable for administration to a human subject to be treated. Some examples of compounds which can be used as pharmaceutically acceptable carriers, fillers or constituents thereof are sugars, such as, for example, lactose, glucose, trehalose and sucrose; starches, such as, for example, corn starch or potato starch; dextrose; cellulose and its derivatives, such as, for example, sodium carboxymethylcellulose, ethylcellulose, cellulose acetate; powdered tragacanth; malt; gelatin; tallow; solid glidants, such as, for example, stearic acid, magnesium stearate; calcium sulfate; vegetable oils, such as, for example, groundnut oil, cottonseed oil, sesame oil, olive oil, corn oil and oil from theobroma; polyols, such as, for example, polypropylene glycol, glycerol, sorbitol, mannitol and polyethylene glycol; alginic acid.

The choice of a pharmaceutically acceptable carrier is determined, in principle, by the manner, in which the pharmaceutical composition or vaccine according to the invention is administered. The composition or vaccine can be administered, for example, systemically or locally. Routes for systemic administration in general include, for example, transdermal, oral, parenteral routes, including subcutaneous, intravenous, intramuscular, intraarterial, intradermal and intraperitoneal injections and/or intranasal administration routes. Routes for local administration in general include, for example, topical administration routes but also intradermal, transdermal, subcutaneous, or intramuscular injections or intralesional, intracranial, intrapulmonal, intracardial, intraarticular and sublingual injections. More preferably, composition or vaccines according to the present invention may be administered by an intradermal, subcutaneous, or intramuscular route, preferably by injection, which may be needle-free and/or needle injection. Compositions/vaccines are therefore preferably formulated in liquid or solid form. The suitable amount of the vaccine or composition according to the invention to be administered can be determined by routine experiments, e.g. by using animal models. Such models include, without implying any limitation, rabbit, sheep, mouse, rat, dog and non-human primate models. Preferred unit dose forms for injection include sterile solutions of water, physiological saline or mixtures thereof. The pH of such solutions should be adjusted to about 7.4. Suitable carriers for injection include hydrogels, devices for controlled or delayed release, polylactic acid and collagen matrices. Suitable pharmaceutically acceptable carriers for topical application include those which are suitable for use in lotions, creams, gels and the like. If the inventive composition or vaccine is to be administered perorally, tablets, capsules and the like are the preferred unit dose form. The pharmaceutically acceptable carriers for the preparation of unit dose forms which can be used for oral administration are well known in the prior art. The choice thereof will depend on secondary considerations such as taste, costs and storability, which are not critical for the purposes of the present invention, and can be made without difficulty by a person skilled in the art.

The inventive vaccine or composition can additionally contain one or more auxiliary substances as defined above in order to further increase the immunogenicity. A synergistic action of the nucleic acid contained in the inventive composition and of an auxiliary substance, which may be optionally be co-formulated (or separately formulated) with the inventive vaccine or composition as described above, is preferably achieved thereby. Preferably, such immunogenicity increasing agents or compounds are provided separately (not co-formulated with the inventive vaccine or composition) and administered individually.

Further additives which may be included in the inventive vaccine or composition are emulsifiers, such as, for example, Tween; wetting agents, such as, for example, sodium lauryl sulfate; colouring agents; taste-imparting agents, pharmaceutical carriers; tablet-forming agents; stabilizers; antioxidants; preservatives.

Kit or Kit of Parts, Application, Medical Uses, Method of Treatment:

In a further aspect, the present invention provides a kit or kit of parts, wherein the kit or kit of parts may comprise the artificial nucleic acid as defined herein, particularly the artificial RNA as defined herein, the polypeptide as defined herein, the composition as defined herein, or the vaccine as defined herein, and optionally comprise a liquid vehicle for solubilising, and optionally technical instructions providing information on administration and dosage of the components.

The technical instructions may contain information about administration and dosage and patient groups. Such kits, preferably kits of parts, may be applied e.g. for any of the applications or uses mentioned herein, preferably for the use of the artificial nucleic acid according as described herein, the composition comprising at least one artificial nucleic acid according to the invention, the polypeptides as described herein, the composition comprising at least one polypeptide or the vaccine for the treatment or prophylaxis of an infection or diseases caused by at least one virus of the order Bunyavirales as defined herein or disorders related thereto. Preferably, the artificial nucleic acid as described herein, the composition comprising at least one artificial nucleic acid according to the invention, or the vaccine is provided in a separate part of the kit, wherein the artificial nucleic acid as described herein, the composition comprising at least one artificial nucleic acid according to the invention, or the vaccine are preferably lyophilised. The kit may further contain as a part a vehicle (e.g. buffer solution) for solubilising the artificial nucleic acid according as described herein, the composition comprising at least one artificial nucleic acid according to the invention, or the vaccine.

In preferred embodiments, the kit or kit of parts as defined herein comprises Ringer lactate solution.

Any of the above kits may be used in a treatment or prophylaxis as defined herein. More preferably, any of the above kits may be used as a vaccine, preferably a vaccine against infections caused by at least one virus of the order Bunyavirales as defined herein.

A further aspect relates to the first medical use of the artificial nucleic acid as defined herein, particularly the RNA as defined herein, the polypeptide as defined herein, the composition as defined herein, the vaccine as defined herein, or the kit or kit of parts as defined herein. Accordingly, the artificial nucleic acid as defined herein, particularly the RNA as defined herein, the polypeptide as defined herein, the composition as defined herein, the vaccine as defined herein, or the kit or kit of parts as defined herein may be used as a medicament.

The present invention furthermore provides several applications and uses of the artificial nucleic acid, particularly the RNA according to the invention, the inventive composition comprising at least one artificial nucleic acid according to the invention, the inventive polypeptides as described herein, the inventive composition comprising at least one inventive polypeptide or the inventive vaccine or of kits comprising same. In particular, the inventive (pharmaceutical) composition(s) or the inventive vaccine may be used for human and also for veterinary medical purposes, preferably for human medical purposes, as a pharmaceutical composition in general or as a vaccine.

Further, the invention provides the use of an artificial nucleic acid, particularly the RNA as defined herein, the polypeptide as defined herein, the composition as defined herein for the preparation of a medicament, particularly a vaccine.

A further aspect relates to the second medical use of the artificial nucleic acid as defined herein, particularly the RNA as defined herein, the polypeptide as defined herein, the composition as defined herein, the vaccine as defined herein, or the kit or kit of parts as defined herein. Accordingly, the artificial nucleic acid as defined herein, the polypeptide as defined herein, the composition as defined herein, the vaccine as defined herein, or the kit or kit of parts as defined herein may be used in the treatment or prophylaxis of an infection with a virus of the order Bunyavirales or a disorder related to an infection with a virus of the order Bunyavirales.

Suitably, the artificial nucleic acid as defined herein, the polypeptide as defined herein, the composition as defined herein, the vaccine as defined herein, or the kit or kit of parts as defined herein may be used in the treatment or prophylaxis of an infection with a virus of the order Bunyavirales or a disorder related to an infection with a virus of the order Bunyavirales, wherein the virus of the order Bunyavirales is selected from Orthohantavirus, Orthonairovirus, Orthobunyavirus, or Phlebovirus, preferrably from the pathogens Andes hantavirus (ANDV), Black Creek Canal hantavirus (BCCV), Dobrava-Belgrade hantavirus (DOBV), Hantaan virus (HTNV), Laguna Negra hantavirus (LANV), Longquan hantavirus (LQUV), Puumala hantavirus (PUUV), Sangassou hantavirus (SANGV), Seoul hantavirus (SEOV), Sin Nombre hantavirus (SNV), Thailand hantavirus (THAIV), Tula hantavirus (TULV), New York hantavirus (NYV), Crimean-Congo hemorrhagic fever virus (CCHFV), Dugbe virus (DUGV), Nairobi sheep disease virus (NSDV), Bunyamwera virus (BUNV), Ngari virus (NRIV), Bwamba bunyavirus (BWAV), California encephalitis virus (CEV), Jamestown Canyon virus (JCV), Keystone virus (KEYV), La Crosse virus (LACV), Oropouche virus (OROV), Heartland virus (HRTV), Punta Toro virus (PTV), Rift Valley fever virus (RVFV), Sandfly fever Naples virus (SFNV), Toscana virus (TOSV), Severe fever with thrombocytopenia syndrome virus (SFTSV).

In particularly preferred embodiments, the artificial nucleic acid, particularly the RNA as defined herein, the polypeptide as defined herein, the composition as defined herein, the vaccine as defined herein, or the kit or kit of parts as defined herein may be used in the treatment or prophylaxis of an infection with a virus of the order Bunyavirales or a disorder related to an infection with a virus of the order Bunyavirales, wherein the virus of the order Bunyavirales is selected from Rift Valley fever virus (RVFV), Severe fever with thrombocytopenia syndrome virus (SFTSV), or Crimean-Congo hemorrhagic fever virus (CCHFV).

Particularly, the artificial nucleic acid as defined herein, particularly the RNA as defined herein, the polypeptide as defined herein, the composition as defined herein, the vaccine as defined herein, or the kit or kit of parts as defined herein may be used in a method of prophylactic (pre-exposure prophylaxis or post-exposure prophylaxis) and/or therapeutic treatment of infections caused by at least one virus of the order Bunyavirales, particularly CCHFV, RVFV, SFTSV according to the invention.

As used herein, "a disorder related to a virus of the order Bunyavirales" or "a disease related to a CCHFV, RVFV, or SFTSV" may preferably comprise a complication of an infection caused by a virus of the order Bunyavirales or, specifically, an infection caused by CCHFV, RVFV, or SFTSV.

Complications and disease related disorders associated with infection caused by a virus of the order Bunyavirales, specifically, an infections caused by CCHFV, RVFV, or SFTSV, include fever and headache, followed by drowsiness, disorientation and mental confusion, respiratory illness and encephalitis (inflammation of the brain).

In a preferred embodiment, the inventive composition or vaccine is thus used for treatment or prophylaxis, preferably prophylaxis, of complications associated with a specifically, CCHFV, RVFV, or SFTSV infection.

The composition or the vaccine as defined herein, in particular the composition comprising at least one artificial nucleic acid according to the invention may be administered systemically or locally. Routes for systemic administration in general include, for example, transdermal, oral, parenteral routes, including subcutaneous, intravenous, intramuscular, intra-arterial, intradermal and intraperitoneal injections and/or intranasal administration routes. Routes for local administration in general include, for example, topical administration routes but also intradermal, transdermal, subcutaneous, or intramuscular injections or intralesional, intracranial, intrapulmonal, intracardial, and sublingual injections. More preferably, vaccines may be administered by an intradermal, subcutaneous, or intramuscular route. Inventive vaccines are therefore preferably formulated in liquid (or sometimes in solid) form. In embodiments, the inventive vaccine may be administered by conventional needle injection or needle-free jet injection.

The term "jet injection", as used herein, refers to a needle-free injection method, wherein a fluid containing at least one inventive artificial nucleic acid (e.g. RNA, DNA, mRNA) and, optionally, further suitable excipients is forced through an orifice, thus generating an ultra-fine liquid stream of high pressure that is capable of penetrating mammalian skin and, depending on the injection settings, subcutaneous tissue or muscle tissue. In principle, the liquid stream forms a hole in the skin, through which the liquid stream is pushed into the target tissue. Preferably, jet injection is used for intradermal, subcutaneous or intramuscular injection of the artificial nucleic acid of the invention, e.g. the mRNA of the invention.

In a preferred embodiment, a single dose of the inventive artificial nucleic acid, composition or vaccine comprises a specific amount of the artificial nucleic acid according to the invention.

In embodiments, the artificial nucleic acid, particularly the RNA as comprised in a composition or vaccine as defined herein is provided in an amount of about 100 ng to about 500 µg, particularly in an amount of about 1 µg to about 200 µg, preferably in an amount of about 2 µg to about 100 µg, specifically, in an amount of about 2 µg, 5 µg, 10 µg, 15 µg, 20 µg, 25 µg, 30 µg, 35 µg, 40 µg, 45 µg, 50 µg, 60 µg, 70 µg, 80 µg, 90 µg or 100 µg. Depending from application route (intradermal, intramuscular), application device (jet injection, needle injection, microneedle patch) and/or complexation (protamine complexation or LNP encapsulation) the suitable amount has to be adapted accordingly and will be chosen and defined by the skilled person.

The immunization protocol for the treatment or prophylaxis of an infection as defined herein, i.e. the immunization of a subject against a virus of the order Bunyavirales as defined herein, particularly CCHFV, RVFV, or SFTSV as defined herein, typically comprises a series of single doses or dosages of the inventive composition or the inventive vaccine. A single dosage, as used herein, refers to the initial/first dose, a second dose or any further doses, respectively, which are preferably administered in order to "boost" the immune reaction.

Suitably, the treatment or prophylaxis as defined above comprises the administration of a further active pharmaceutical ingredient. More preferably, in the case of the inventive vaccine or composition, which is based on the inventive artificial nucleic acid, a polypeptide may be co-administered as a further active pharmaceutical ingredient. For example, at least one Bunyavirales protein or peptide as described herein, or a fragment or variant thereof, may be co-administered in order to induce or enhance an immune response. Likewise, in the case of the inventive vaccine or composition, which is based on the inventive polypeptide as described herein, an artificial nucleic acid as described herein may be co-administered as a further active pharmaceutical ingredient. For example, an artificial nucleic acid as described herein encoding at least one polypeptide as described herein may be co-administered in order to induce or enhance an immune response. Further, two distinct immunogenic compositions may be administered at different time points, preferably in a prime-boost scenario, more preferably using a composition comprising at least one polypeptide as prime vaccination and the composition comprising at least one artificial nucleic acid, preferably RNA as boost vaccination. In that context the disclosure of WO2016/184822 is herewith incorporated by reference.

Suitably, the treatment or prophylaxis as defined above comprises the administration of a further active pharmaceutical ingredient, wherein the further active pharmaceutical ingredient may be an immunotherapeutic agent that can be selected from immunoglobulins, preferably IgGs, monoclonal or polyclonal antibodies, polyclonal serum or sera, etc., most preferably immunoglobulins directed against a Bunyavirales protein or peptide as defined herein. Preferably, such a further immunotherapeutic agent may be provided as a peptide/protein or may be encoded by a nucleic acid, preferably by a DNA or an RNA, more preferably an mRNA. Such an immunotherapeutic agent allows providing passive vaccination additional to active vaccination triggered by the inventive artificial nucleic acid or by the inventive polypeptide.

In a further aspect the invention provides a method of treating or preventing a disorder as defined herein, wherein the method comprises applying or administering to a subject in need thereof the artificial nucleic acid, particularly the RNA as defined herein, the polypeptide as defined herein, the composition as defined herein, or the vaccine as defined herein, or the kit or kit of parts as defined in herein. Preferably, applying or administering is performed by injection, preferably by needle-less injection, more preferably by jet injection as defined herein.

In preferred embodiments, the disorder is an infection with a virus of the order Bunyavirales, preferably Crimean-Congo haemorrhagic fever virus (CCHFV), Rift Valley fever virus (RVFV), or Severe fever with thrombocytopenia syndrome virus (SFTSV), or a disorder related to such an infection.

In particular, such a method may preferably comprise the steps of:
a) providing the artificial nucleic acid according to the invention, the inventive composition comprising at least one artificial nucleic acid according to the invention, the inventive polypeptides as described herein, the inventive composition comprising at least one inventive polypeptide, the inventive vaccine or the inventive kit or kit of parts;
b) applying or administering the artificial nucleic acid according to the invention, the inventive composition comprising at least one artificial nucleic acid according to the invention, the inventive polypeptides as described herein, the inventive composition comprising at least one inventive polypeptide, the inventive vaccine or the inventive kit or kit of parts to a tissue or an organism;
c) optionally, administering immunoglobulin (IgGs) against a virus of the order Bunyavirales According to a further aspect, the present invention also provides a method for expression of at least one polypeptide comprising at least one peptide or protein derived from a virus of the order Bunyavirales, or a fragment or variant thereof, wherein the method preferably comprises the following steps:
a) providing the inventive artificial nucleic acid comprising at least one coding sequence encoding at least one polypeptide as defined herein, or a fragment or variant thereof, preferably as defined herein, or a composition comprising said artificial nucleic acid; and
b) applying or administering the inventive artificial nucleic acid or the inventive composition comprising said artificial nucleic acid to an expression system, e.g. to a cell-free expression system, a cell (e.g. an expression host cell or a somatic cell), a tissue or an organism.

The method may be applied for laboratory, for research, for diagnostic, for commercial production of peptides or proteins and/or for therapeutic purposes. In this context, typically after preparing the inventive artificial nucleic acid as defined herein or of the inventive composition or vaccine as defined herein, it is typically applied or administered to a cell-free expression system, a cell (e.g. an expression host cell or a somatic cell), a tissue or an organism, e.g. in naked or complexed form or as a (pharmaceutical) composition or vaccine as described herein, preferably via transfection or by using any of the administration modes as described herein. The method may be carried out in vitro, in vivo or ex vivo. The method may furthermore be carried out in the context of the treatment of a specific disease, particularly in the treatment of infectious diseases, preferably Bunyavirales infection, particularly CCHFV, RVFV, or SFTSV infection or a related disorder as defined herein.

Likewise, according to another aspect, the present invention also provides the use of the inventive artificial nucleic acid as defined herein or of the inventive composition or vaccine as defined herein, preferably for diagnostic or therapeutic purposes, for expression of an encoded Bunyavirales antigenic peptide or protein. e.g. by applying or administering the inventive artificial nucleic acid as defined herein or of the inventive composition or vaccine as defined herein, e.g. to a cell-free expression system, a cell (e.g. an expression host cell or a somatic cell), a tissue or an organism. The use may be applied for a (diagnostic) laboratory, for research, for diagnostics, for commercial production of peptides or proteins and/or for therapeutic purposes. In this context, typically after preparing the inventive artificial nucleic acid as defined herein or of the inventive composition or vaccine as defined herein, it is typically applied or administered to a cell-free expression system, a cell (e.g. an expression host cell or a somatic cell), a tissue or an organism, preferably in naked form or complexed form, or as a (pharmaceutical) composition or vaccine as described herein, preferably via transfection or by using any of the administration modes as described herein. The use may be carried out in vitro, in vivo or ex vivo. The use may furthermore be carried out in the context of the treatment of a specific disease, particularly in the treatment of Bunyavirales virus infection, particularly CCHFV, RVFV, or SFTSV infection or a related disorder.

In a particularly preferred embodiment, the invention provides the artificial nucleic acid, the inventive composition or the inventive vaccine for use as defined herein, preferably for use as a medicament, for use in treatment or prophylaxis, preferably treatment or prophylaxis of a Bunyavirales infection, particularly CCHFV, RVFV, or SFTSV infection or a related disorder, or for use as a vaccine.

BRIEF DESCRIPTION OF THE DRAWINGS

FIG. 1 shows that mRNA encoding Crimean-Congo haemorrhagic fever virus (CCHFV) antigenic proteins is expressed in cells after transfection (FACS analysis). Further details are provided in Example 2a.

FIG. 3 shows that mRNA encoding Crimean-Congo haemorrhagic fever virus (CCHFV) antigenic proteins is expressed in cells after transfection (Western blot). Further details are provided in Example 3a.

Figure 4:
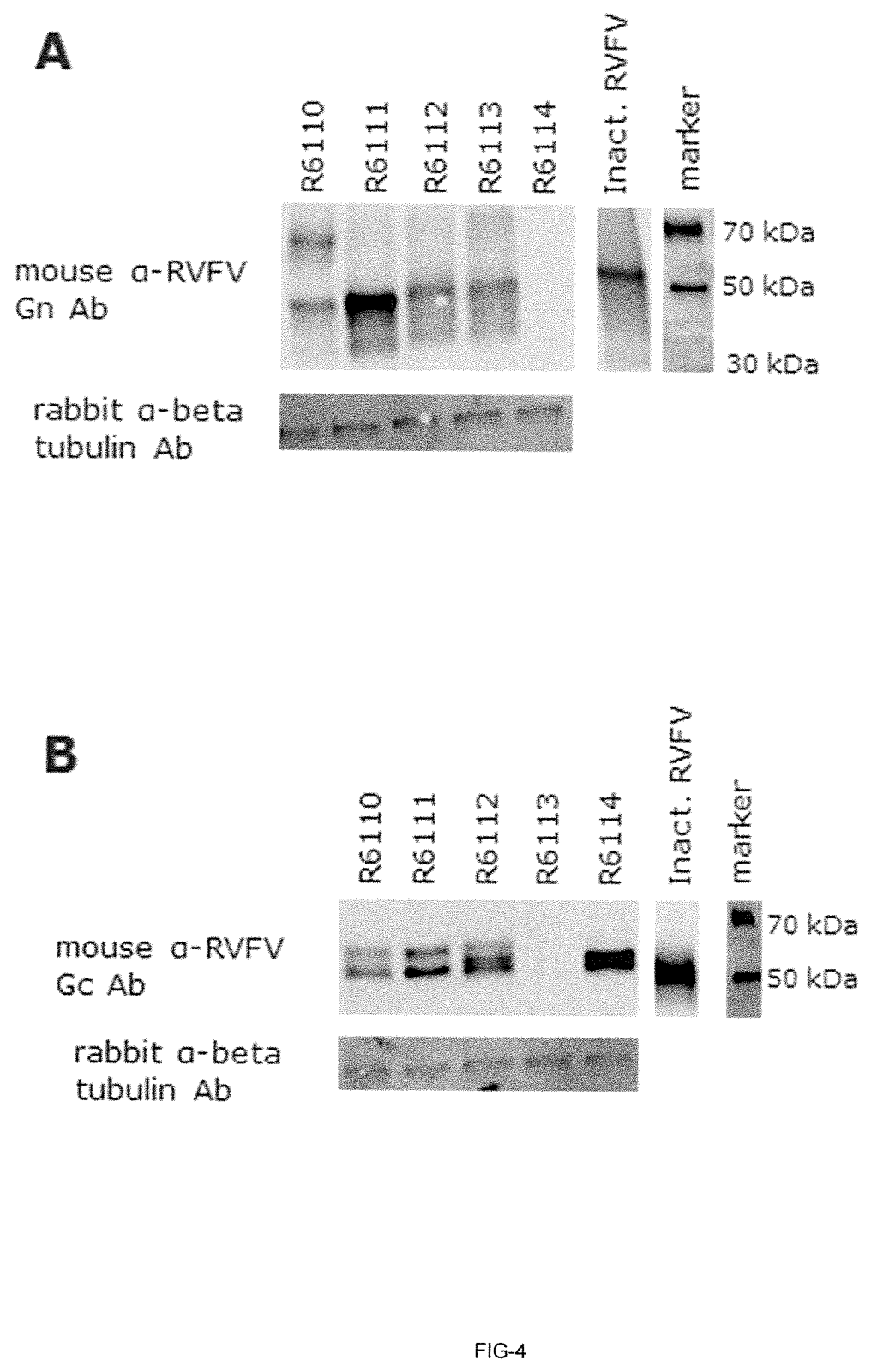

FIG. 4 shows that mRNA encoding Rift Valley Fever virus (RVFV) antigenic proteins is expressed in cells after transfection (Western blot). Further details are provided in Example 3b.

EXAMPLES

Figure 1:
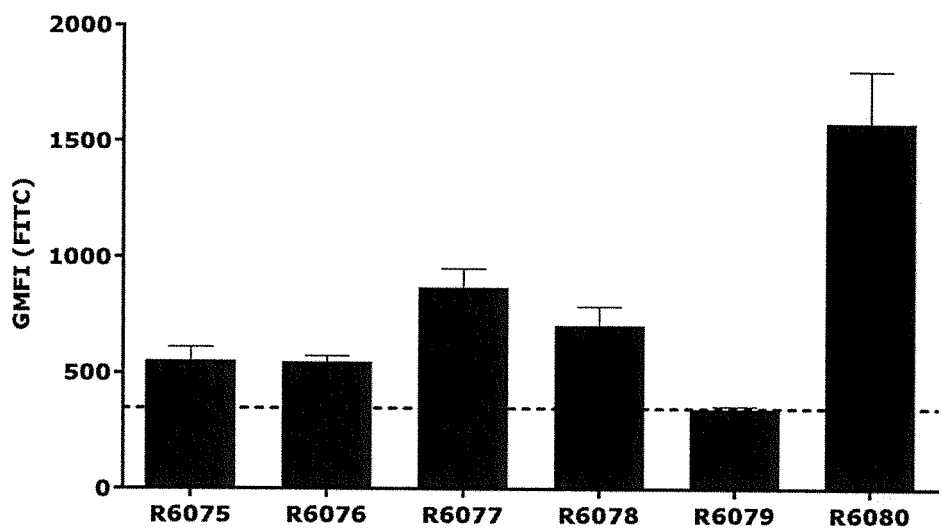

The Examples shown in the following are merely illustrative and shall describe the present invention in a further way. These Examples shall not be construed to limit the present invention thereto.

Example 1: Preparation of mRNA Constructs for In Vitro and In Vivo Experiments 1.1. Preparation of DNA and mRNA Constructs For the present examples, DNA sequences encoding Rift Valley Fever virus (RVFV) and Crimean-Congo haemorrhagic fever virus (CCHFV) antigenic proteins are prepared and used for subsequent RNA in vitro transcription reactions. The generated RNAs constructs are provided in Table 10 (SEQ ID NOs: 17050, 17052, 17054-17059, 17390-17397) with the encoded proteins indicated.

DNA sequences are prepared by modifying the wild type encoding DNA sequences by introducing a G/C optimized sequence for stabilization, using an in silico algorithms that increase the G/C content of the respective coding sequence (according to WO2002/098443). Sequences are introduced into a pUC19 derived vector to comprise stabilizing sequences derived from 32L4 5'-UTR ribosomal 5'-TOP UTR and 3'-UTR derived from albumin 7, a stretch of 30 cytosines, a histone-stem-loop structure, and a stretch of 64 adenosines. The obtained plasmid DNA constructs are transformed and propagated in bacteria using common protocols known in the art. Eventually, the plasmid DNA constructs are purified and used for subsequent RNA in vitro transcription.

Alternatively, DNA plasmids prepared according to paragraph 1 are used as DNA template for PCR-based amplification. The generated PCR products are purified and used for subsequent RNA in vitro transcription (see section 1.3.).

1.2. RNA In Vitro Transcription

The DNA plasmids prepared according to paragraph 1.1 are enzymatically linearized using EcoRI and transcribed in vitro using DNA dependent T7 RNA polymerase in the presence of a nucleotide mixture and cap analog (m7GpppG or 3'-O-Me-m7G(5')ppp(5')G)) under suitable buffer conditions. The obtained mRNAs are purified using PureMessenger® (CureVac AG, Tübingen, Germany; WO2008/077592) and used for in vitro and in vivo experiments. RNA for clinical development (see Example 6) is produced under current good manufacturing practice according to WO2016/180430, implementing various quality control steps on DNA and RNA level.

Alternatively, linearized DNA is used for DNA dependent RNA in vitro transcription using an RNA polymerase in the presence of a modified nucleotide mixture (ATP, GTP, CTP, N(1)-methylpseudouridine (m1Ψ) or 5-methoxyuridine) and cap analog (m7GpppG) under suitable buffer conditions. The obtained m1Ψ-modified or 5-methoxyuridine modified RNA is purified e.g. as explained above and used for further experiments.

Some RNA constructs are in vitro transcribed in the absence of a cap analog. The cap-structure (cap0 or cap1) is added enzymatically using capping enzymes as commonly known in the art. In short, in vitro transcribed RNA is capped using a capping kit to obtain cap0-RNA. Cap0-RNA may be additionally modified using Cap specific 2-O-methyltransferase to obtain cap1-RNA. Cap0-RNA or Cap1-RNA is purified e.g. as explained above and used for further experiments.

1.3. RNA In Vitro Transcription from PCR Amplified DNA Templates:

Purified PCR amplified DNA templates prepared according to paragraph 1.1 are transcribed in vitro using DNA dependent T7 RNA polymerase in the presence of a nucleotide mixture (ATP/GTP/CTP/UTP) and cap analog (m7GpppG or 3'-O-Me-m7G(5')ppp(5)G)) under suitable buffer conditions. Alternatively, PCR amplified DNA is transcribed in vitro using DNA dependent T7 RNA polymerase in the presence of a modified nucleotide mixture (ATP, GTP, CTP, N(1)-methylpseudouridine (m14) or 5-methoxyuridine) and cap analog (m7GpppG or 3'-O-Me-m7G(5)ppp(5)G)) under suitable buffer conditions. Some RNA constructs are in vitro transcribed in the absence of a cap analog and the cap-structure (cap0 or cap1) is added enzymatically using capping enzymes as commonly known in the art. The obtained RNA is purified e.g. as explained above and used for further experiments.

TABLE 10 mRNA constructs used in the present examples

| RNA ID | Virus | Construct description | SEQ ID NO RNA | SEQ ID NO Protein |
|---|---|---|---|---|
| R6082 | CCHFV IbAr10200 | N | 17050 | 16840 |
| R6075 | CCHFV Turkey-Kelkit06 | GP | 17054 | 16844 |
| R6076 | CCHFV IbAr10200 | GP | 17052 | 16842 |
| R6077 | CCHFV IbAr10200 | SP-GP__Gn-NSm-Gc | 17055 | 16845 |
| R6078 | CCHFV IbAr10200 | IgE-leader__Gn-NSm-Gc | 17056 | 16846 |
| R6081 | CCHFV IbAr10200 | IgE-leader__Gn-4aa-Gc | 17057 | 16847 |
| R6079 | CCHFV IbAr10200 | IgE-leader__Gn | 17058 | 16848 |
| R6080 | CCHFV IbAr10200 | IgE-leader__Gc | 17059 | 16849 |
| R6110 | RVFV ZH-548 | GP | 17390 | 17201 |
| R6111 | RVFV ZH-548 | Gn-Gc | 17391 | 17202 |
| R6115 | RVFV ZH-548 | Gne__SP-Gn__Gc | 17392 | 17203 |
| R6164 | RVFV ZH-548 | IgE-leader__Gn(delSP)-Gc variant1 | 17393 | 17204 |
| R6112 | RVFV ZH-548 | IgE-leader__Gn(delSP)-Gc variant2 | 17394 | 17205 |
| R6165 | RVFV ZH-548 | IgE-leader__Gn(delSP) variant1 | 17395 | 17206 |
| R6113 | RVFV ZH-548 | IgE-leader__Gn(delSP) variant2 | 17396 | 17207 |
| R6114 | RVFV ZH-548 | IgE-leader__Gc | 17397 | 17208 |

Example 2: Analysis of Protein Expression in HeLa Cells and Analysis by FACS To determine in vitro protein expression of the mRNA constructs (see Example 1), HeLa cells are transiently transfected with mRNA encoding antigens and stained using suitable antibodies against RVFV or CCHV proteins (Aldeveron; customized; raised in rabbits; or reagents obtained from BEI Resources), counterstained with a FITC-coupled secondary antibody (F2765 from Invitrogen or F5262 from Sigma).

HeLa cells are seeded in a 6-well plate at a density of 400000 cells/well in cell culture medium (RPMI, 10% FCS, 1% L-Glutamine, 1% Pen/Strep), 24 h prior to transfection. HeLa cells are transfected with 1 μg and 2 μg unformulated mRNA using Lipofectamine 2000 (Invitrogen). The mRNA constructs according to Example 1 are used in the experiment, including a negative control encoding a water only control. 24 hours post transfection, HeLa cells are stained with suitable antibodies and anti-rabbit or mouse FITC labelled secondary antibody (1:500) and subsequently analyzed by flow cytometry (FACS) on a BD FACS Canto II using the FACS Diva software. Quantitative analysis of the fluorescent FITC signal is performed using the FlowJo software package (Tree Star, Inc.).

Example 2a: Analysis of Expression of CCHFV Proteins in HeLa Cells and Analysis by FACS The results of the present Example shows that mRNA encoding CCHFV constructs are expressed in HeLa cells after transfection.

To determine in vitro protein expression of the mRNA constructs (see Table 11 and Example 1). HeLa cells are transiently transfected with 2 μg of the respective mRNA using Lipofectamine 2000. Upon incubation for 18-24 h the cells were harvested and expression of the encoded protein was detected using flow cytometric analysis. Flow cytometric analysis was performed using monoclonal mouse α-CCHFV Gc-specific antibody (done 11E7, BEI Resources) followed by anti-mouse FITC conjugated antibody. Data was acquired using BD FACS Canto II and analyzed via FlowJo. Depicted is the geometric mean of the FITC signal from two independent replicates.

The outline of the experiment is shown in Table 11. The result of the experiment is shown in FIG. 1.

TABLE 11

Expression analysis experiment (Example 2a):

| RNA ID | encoded antigen | SEQ ID NO RNA | SEQ ID NO Protein |
|---|---|---|---|
| R6075 | CCHFV GP (Turkey-Kelkit06) | 17054 | 16844 |
| R6076 | CCHFV GP (IbAr10200) | 17052 | 16842 |
| R6077 | CCHFV SP-Gn-Nsm-Gc (IbAr10200) | 17055 | 16845 |
| R6078 | IgE SP-CCHFV Gn-Nsm-Gc (IbAr10200) | 17056 | 16846 |
| R6079 | IgE SP-CCHFV Gn (IbAr10200) | 17058 | 16848 |
| R6080 | IgE SP-CCHFV Gc (IbAr10200) | 17059 | 16849 |

Results:

As shown in FIG. 1, the mRNA encoding different CCHFV constructs is expressed in HeLa cells as the FITC signal was increased compared to the control construct (R6079 IgE SP-CCHFV Gn (IbAr10200), missing the Gc-part). The results exemplify that the inventive mRNA encoding the GP protein is translated in cells and that alternative mRNA constructs according to the invention may also be translated in cells, which is a prerequisite for an mRNA-based vaccine.

Example 2b: Analysis of Expression of RVFV Proteins in HeLa Cells and Analysis by FACS The results of the present Example shows that mRNA encoding RVFV constructs are expressed in HeLa cells after transfection.

Figure 2A:
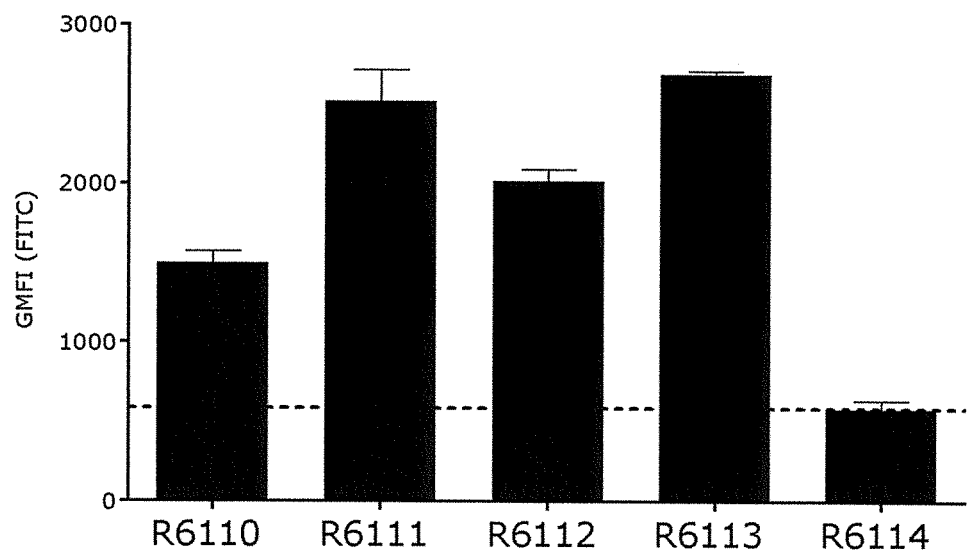
FIG. 2 shows that mRNA encoding Rift Valley Fever virus (RVFV) antigenic proteins is expressed in cells after transfection (FACS analysis). Further details are provided in Example 2b.
Figure 2B:
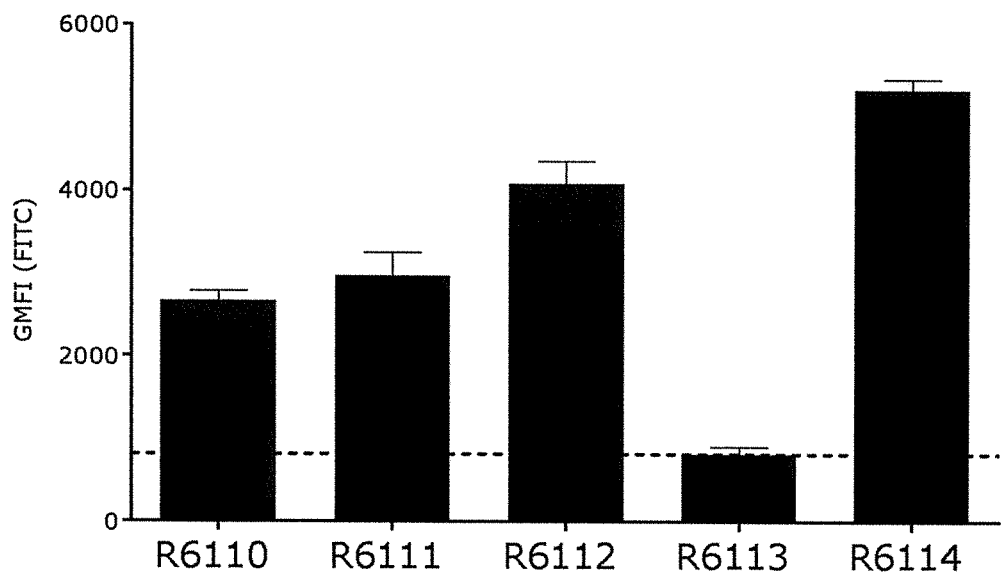

To determine in vitro protein expression of the mRNA constructs (see Table 12 and Example 1), HeLa cells are transiently transfected with 2 μg of the respective mRNA using Lipofectamine 2000. Upon incubation for 18-24 h the cells were harvested and expression of the encoded protein was detected using flow cytometric analysis. Flow cytometric analysis was performed using mouse α-RVFV Gn-specific antibody (clone 4D4, BEI Resources, FIG. 2B or monoclonal mouse α-RVFV Gc-specific antibody (clone 9C10, BEI Resources. FIG. 2B) followed by anti-mouse FITC conjugated antibody. Data was acquired using BD FACS Canto II and analyzed via FlowJo. Depicted is the geometric mean of the FITC signal from two independent replicates. The outline of the experiment is shown in Table 12. The results of the experiment are shown in FIGS. 2A and 2B.

TABLE 12

Expression analysis experiment (Example 2b):

| RNA ID | encoded antigen | SEQ ID NO RNA | SEQ ID NO Protein |
|---|---|---|---|
| R6110 | RVFV SP Nsm-Gn-Gc | 17390 | 17201 |
| R6111 | RVFV SP Gn-Gc | 17391 | 17202 |
| R6112 | IgE-leader Gn-Gc | 17394 | 17205 |
| R6113 | IgE-leader Gn | 17396 | 17207 |
| R6114 | IgE-leader Gc | 17397 | 17208 |

Results:

As shown in FIG. 2A, the mRNA encoding different RVFV constructs comprising Gn is expressed in HeLa cells as the FITC signal was increased compared to the control construct (R6114 IgE-leader Gc, missing the Gn-part).

As shown in FIG. 2B, the mRNA encoding different RVFV constructs comprising Gc is expressed in HeLa cells as the FITC signal was increased compared to the control construct (R6113 IgE-leader Gn, missing the Gc-part).

The results exemplify that the inventive mRNA encoding antigenic proteins of RVFV is translated in cells and that alternative mRNA constructs according to the invention may also be translated in cells, which is a prerequisite for an mRNA-based vaccine.

Example 3: Expression and Secretion of Virus Proteins Using Western Blot

For the analysis of protein secretion, HeLa cells are transfected with 1 μg and 2 μg unfomulated mRNA (including a negative control encoding an irrelevant protein) using Lipofectamine as the transfection agent. Supernatants, harvested 24 hours post transfection, are filtered through a 0.2 μm filter. Clarified supernatants are applied on top of 1 ml 20% sucrose cushion (in PBS) and centrifuged at 14000rcf (relative centrifugal force) for 2 hours at 4° C. Protein content is analyzed by Western Blot using anti-virus Glycoprotein antibodies or serum as primary antibody in combination with secondary anti mouse or rabbit antibody coupled to IRDye 800CW (Licor Biosciences). The presence of αβ-tubulin is also analyzed as control for cellular contamination (αβ-tubulin; Cell Signaling Technology; 1:1000 diluted) in combination with secondary anti mouse or rabbit antibody coupled to IRDye 680RD (Licor Biosciences).

For the analysis of proteins in cell lysates, HeLa cells are transfected with 1 µg and 2 µg unformulated mRNAs (generated according to Example 1) including water for injection as a negative control using Lipofectamine as the transfection agent 24 hours post transfection, HeLa cells are detached by trypsin-free/EDTA buffer, harvested, and cell lysates are prepared. Cell lysates are subjected to SDS-PAGE followed by western blot detection. Western Blot analysis is performed using anti-virus Glycoprotein antibodies or serum as primary antibody in combination with secondary anti mouse or rabbit antibody coupled to IRDye 800CW (Licor Biosciences).

Example 3a: Expression and Secretion of CCHFV Proteins Using Western Blot

For the analysis of protein expression, HeLa cells were transfected with 2 µg of the respective mRNA using Lipofectamine 2000. Upon incubation for 18-24 h the cells were harvested and expression of the encoded protein was detected using western blot. Therefore cell lysates were prepared and subjected to SDS-PAGE/western blot analysis using (A) a custom made rabbit α-CCHFV Gn-specific antiserum (Aldevron) and (B) monoclonal mouse α-CCHFV Gc-specific antibody (clone 11E7, BEI Resources). Inactivated CCHFV (BEI Resources) was used as control. The presence of αβ-tubulin is also analyzed as control for cellular contamination (αβ-tubulin; Cell Signaling Technology; 1:1000 diluted) in combination with secondary anti mouse or rabbit antibody coupled to IRDye 680RD (Licor Biosciences). The outline of the experiment is shown in Table 11. The result of the experiment is shown in FIGS. 3A and 3B.

Results:

As shown in FIGS. 3A and 3B, the mRNA encoding CCHFV glycoprotein is expressed in HeLa cells as the immunostaining for cell lysates of mRNA transfected cells was increased compared to the control groups (R6080 for A, missing the Gn-part and R6089 for B, missing the Gc-part). The results exemplify that the inventive mRNA encoding CCHFV glycoprotein GP is translated in cells and that alternative mRNA constructs according to the invention may also be translated in cells, which is a prerequisite for an mRNA-based vaccine.

Example 3b: Expression and Secretion of RVFV Proteins Using Western Blot

For the analysis of protein expression, HeLa cells were transfected with 2 µg of the respective mRNA using Lipofectamine 2000. Upon incubation for 18-24 h the cells were harvested and expression of the encoded protein was detected using western blot. For western blot analysis cell lysates were prepared and subjected to SDS-PAGE/western blot analysis using (A) monoclonal mouse α-RVFV Gn-specific antibody (clone 4D4, BEI Resources) and (B) monoclonal mouse α-RVFV Gc-specific antibody (clone 9C10, BEI Resources). Inactivated RVFV (BEI Resources) was used as control. The presence of a4-tubulin is also analyzed as control for cellular contamination (αβ-tubulin; Cell Signaling Technology; 1:1000 diluted) in combination with secondary anti mouse or rabbit antibody coupled to IRDye 680RD (Licor Biosciences). The outline of the experiment is shown in Table 12. The results of the experiment are shown in FIGS. 4A and 4B.

Results:

As shown in FIGS. 4A and 4B, the mRNA encoding RVFV glycoprotein is expressed in HeLa cells as the immunostaining for cell lysates of mRNA transfected cells was significantly increased compared to the control groups (R6114 for A, missing the Gn-part and R6113 for B, missing the Gc-part). The results exemplify that the inventive mRNA encoding RVFV proteins is translated in cells and that alternative mRNA constructs according to the invention may also be translated in cells, which is a prerequisite for an mRNA-based vaccine.

Example 4: Preparation of Vaccine Compositions

For in vivo vaccination experiments, different mRNA compositions are prepared using constructs obtained in Example 1. One composition comprises protamine-complexed mRNA, one composition comprises mRNA that is formulated without protamine (naked), and one composition comprises mRNA that is encapsulated in lipid nanoparticles (LNPs).

3.1. Preparation of Protamine Complexed mRNA ("Vaccine Composition 1":

Respective mRNA constructs are complexed with protamine prior to use in in vivo vaccination experiments. The mRNA complexation consists of a mixture of 50% free mRNA and 50% mRNA complexed with protamine at a weight ratio of 2:1. First, mRNA is complexed with protamine by addition of protamine-Ringer's lactate solution to mRNA. After incubation for 10 minutes, when the complexes are stably generated, free mRNA is added, and the final concentration of the vaccine is adjusted with Ringer's lactate solution.

3.2. Preparation of LNP Encapsulated mRNA ("Vaccine Composition 2":

A lipid nanoparticle (LNP)-encapsulated mRNA is prepared using an ionizable amino lipid (cationic lipid), phospholipid, cholesterol and a PEGylated lipid. LNPs are prepared as follows. Cationic lipid, DSPC, cholesterol and PEG-lipid are solubilized in ethanol. Briefly, mRNA mixture is diluted to a total concentration of 0.05 mg/mL in 50 mM citrate buffer, pH4. Syringe pumps are used to mix the ethanolic lipid solution with the mRNA mixture at a ratio of about 1:6 to 1:2 (vol/vol). The ethanol is then removed and the external buffer replaced with PBS by dialysis. Finally, the lipid nanoparticles are filtered through a 0.2 µm pore sterile filter. Lipid nanoparticle particle diameter size is determined by quasi-elastic light scattering using a Malvern Zetasizer Nano (Malvern, UK).

Other lipid nanoparticles (LNP), cationic lipids, and polymer conjugated lipids (PEG-lipid) are prepared and tested essentially according to the general procedures described in WO2015/199952, WO2017/004143 and WO2017/075531, the full disclosures of which are incorporated herein by reference. LNP formulated RNA is prepared using an ionizable amino lipid (cationic lipid), phospholipid, cholesterol and a PEGylated lipid. Briefly, cationic lipid compound of formula III-3, DSPC, cholesterol, and PEG-lipid of formula IVa are solubilized in ethanol at a molar ratio (%) of approximately 50:10:38.5:1.5 or 47.4:10:40.9:1.7. LNPs comprising cationic lipid compound of formula III-3 and PEG-lipid compound of formula IVa are prepared at a ratio of RNA to total lipid of 0.03-0.04 w/w. The RNA is diluted to 0.05 mg/mL to 0.2 mg/mL in 10 mM to 50 mM citrate buffer, pH4. Syringe pumps are used to mix the ethanolic lipid solution with the RNA aqueous solution at a ratio of about 1:5 to 1:3 (vol/vol) with total flow rates above 15 ml/min. The ethanol is then removed and the external buffer replaced with a PBS buffer comprising Sucrose by dialysis. Finally, the lipid nanoparticles were filtered through a 0.2 um pore sterile filter and the LNP-formulated RNA composition is adjusted to about 1 mg/ml total RNA. Lipid nanoparticle particle diameter size is 60-90 nm as determined by quasi-elastic light scattering using a Malvern Zetasizer Nano (Malvern, UK). For other cationic lipid compounds mentioned in the present specification, the formulation process is essentially similar. The obtained LNP-formulated RNA composition (1 mg/ml total RNA) is diluted to the desired target concentration using Saline before in vivo application (see Example 5).

Example 5: Vaccination of Mice and Evaluation of Virus Specific Immune Response 5.1. Immunization:

Female BALB/c mice are injected intradermally (i.d.) or intramuscularly (i.m.) with respective mRNA vaccine compositions (prepared according to Example 3) with doses, application routes and vaccination schedules as indicated in Table 11. As a negative control, one group of mice is treated with buffer (Ringer lactate solution). As further controls, groups are treated with respective protein antigens. All animals are vaccinated on day 1, 21 and 42. Blood samples are collected on day 21, 35, and 56 for the determination of binding and neutralizing antibody titers (see below).

TABLE 11

Immunization regimen (Example 5)

| No. of mice | Vaccine composition | Route | Vaccination (day) |
|---|---|---|---|
| 8 | CCFV Glycoprotein | i.d. | 0/21/42 |
| 8 | 80 μg CCFV mRNA; Composition 1 | i.d. 2 × 50 μl | 0/21/42 |
| 8 | 5 μg CCFV mRNA; Composition 2 | i.m. | 0/21/42 |
| 8 | 1 μg CCFV mRNA; Composition 2 | i.m. | 0/21/42 |
| 8 | RVFV Glycoprotein | i.d. | 0/21/42 |
| 8 | 80 μg RVFV mRNA; Composition 1 | i.d. 2 × 50 μl | 0/21/42 |
| 8 | 5 μg RVFV mRNA; Composition 2 | i.m. | 0/21/42 |
| 8 | 1 μg RVFV mRNA; Composition 2 | i.m. | 0/21/42 |
| 8 | 100% RiLa buffer Control | i.d. 2 × 50 μl | 0/21/42 |

5.2. Determination of Anti CCFV Protein Antibodies and Anti RVFV Protein Antibodies by ELISA:

ELISA is performed using inactivated CCFV virus or inactivated RVFV virus preparation for coating. Coated plates are incubated using respective serum dilutions, and binding of specific antibodies to the respective antigens are detected using biotinylated isotype specific anti-mouse antibodies followed by streptavidin-HRP (horse radish peroxidase) with Amplex as substrate. Endpoint titers of antibodies directed against the antigens are measured by ELISA on day 35 and 56 post vaccinations.

5.3. Intracellular Cytokine Staining:

Splenocytes from vaccinated mice are isolated according to a standard protocol known in the art. Briefly, isolated spleens are grinded through a cell strainer and washed in PBS/1% FBS followed by red blood cell lysis. After an extensive washing step with PBS/1% FBS splenocytes are seeded into 96-well plates ($2\times10^6$ cells per well). The cells are stimulated with a mixture of eight CCFV G protein specific peptides (5 μg/ml of each peptide) or RVFV G protein specific peptides (5 μg/ml of each peptide) in the presence of 2.5 μg/ml of an anti-CD28 antibody (BD Biosciences) and a protein transport inhibitor for 6 hours at 37° C. After stimulation, cells are washed and stained for intracellular cytokines using the Cytofix/Cytoperm reagent (BD Biosciences) according to the manufacturer's instructions. The following antibodies are used for staining: Thy1.2-FITC (1:100), CD8-PE-Cy7 (1:200), TNF-PE (1:100), IFNγ-APC (1:100) (eBioscience), CD4-BD Horizon V450 (1:200) (BD Biosciences) and incubated with Fcγ-block diluted 1:100. Aqua Dye is used to distinguish live/dead cells (Invitrogen). Cells are acquired using a BD FACS Canto 1 flow cytometer (Beckton Dickinson). Flow cytometry data is analyzed using FlowJo software (Tree Star, Inc.).

5.4. Plaque Reduction Neutralization Test (PRNT50):

Sera are analyzed by a plaque reduction neutralization test (PRNT50), performed as commonly known in the art. Briefly, obtained serum samples of vaccinated mice are incubated with CCFV or RVFV virus. That mixture is used to infect cultured cells, and the reduction in the number of plaques is determined.

Example 6: Clinical Development of a CCFV and RVFV mRNA Vaccine Composition

To demonstrate safety and efficiency of the CCFV and RVFV mRNA vaccine composition, a clinical trial (phase I) is initiated. For clinical development, RNA is used that has been produced under GMP conditions (e.g. using a procedure as described in WO2016/180430).

In the clinical trial, a cohort of healthy human volunteers is intradermally or intramuscularly injected for at least two times with respective vaccine compositions.

In order to assess the safety profile of the vaccine compositions according to the invention, subjects are monitored after administration (vital signals, vaccination site tolerability assessments, hematologic analysis).

The efficacy of the immunization is analyzed by determination of virus neutralizing titers (VNT) in sera from vaccinated subjects. Blood samples are collected on day 0 as baseline and after completed vaccination. Sera are analyzed for virus neutralizing antibodies.

SEQUENCE LISTING (17541 sequences)

SEQ ID NO: 1 - DNA, 42 bp, Artificial Sequence
  5'-UTR of human ribosomal protein Large 32 lacking the 5'-terminal oligopyrimidine tract
ggcgctgcctacggaggtggcagccatctccttctcggcatc

SEQ ID NO: 2 - RNA, 42 nt, Artificial Sequence
  5'-UTR of human ribosomal protein Large 32 lacking the 5'-terminal oligopyrimidine tract mRNA
ggcgcugccuacggagguggcagccaucuccuucucggcauc

SEQ ID NO: 3 - DNA, 110 bp, Artificial Sequence
  3'-UTR of Homo sapiens hemoglobin, alpha 1 (HBA1)
gctggagcctcggtggccatgcttcttgccccttgggcctccccccagcccctcctccccttcctgcacccgtacccccgtggtctttgaataaagtctgagtgggcggc

SEQ ID NO: 4 - RNA, 110 nt, Artificial Sequence
  3'-UTR of Homo sapiens hemoglobin, alpha 1 (HBA1) mRNA
gcuggagccucgguggccaugcuucuugccccuugggccuccccccagccccuccuccccuuccugcacccguacccccguggucuuugaauaaagucugagugggcggc

SEQ ID NO: 5 - DNA, 108 bp, Artificial Sequence
  3'-UTR of Homo sapiens hemoglobin, alpha 2 (HBA2)
gctggagcctcggtagccgttcctcctgcccgctgggcctcccaacgggccctcctcccctccttgcaccggcccttcctggtctttgaataaagtctgagtgggcag

SEQ ID NO: 6 - RNA, 108 nt, Artificial Sequence
  3'-UTR of Homo sapiens hemoglobin, alpha 2 (HBA2) mRNA
gcuggagccucgguagccguuccuccugcccgcugggccucccaacgggcccuccuccccuccuugcaccggcccuuccuggucuuugaauaaagucugagugggcag

SEQ ID NO: 7 - DNA, 132 bp, Artificial Sequence
  3'-UTR of Homo sapiens hemoglobin, beta (HBB)
gctcgctttcttgctgtccaatttctattaaaggttcctttgttccctaagtccaactactaaactgggggatattatgaagggccttgagcatctggattctgcctaataaaaaacatttattttcattgc

SEQ ID NO: 8 - RNA, 132 nt, Artificial Sequence
  3'-UTR of Homo sapiens hemoglobin, beta (HBB) mRNA
gcucgcuuucuugcuguccaauuucuauuaaagguuccuuuguucccuaaguccaacuacuaaacugggggauauuaugaagggccuugagcaucuggauucugccuaauaaaaaacauuuauuuucauugc

SEQ ID NO: 9 - DNA, 44 bp, Artificial Sequence
  Center, alpha-complex-binding portion of the 3'-UTR of an alpha-globin gene (muag)
gcccgatgggcctcccaacgggccctcctcccctccttgcaccg

SEQ ID NO: 10 - RNA, 44 nt, Artificial Sequence
  Center, alpha-complex-binding portion of the 3'-UTR of an alpha-globin gene (muag) mRNA
gcccgaugggccucccaacgggcccuccuccccuccuugcaccg

SEQ ID NO: 11 - DNA, 186 bp, Artificial Sequence
  3'-UTR of human albumin
catcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatct

SEQ ID NO: 12 - RNA, 186 nt, Artificial Sequence
  3'-UTR of human albumin mRNA
caucacauuuaaaagcaucucagccuaccaugagaauaagagaaagaaaaugaagaucaaaagcuuauucaucuguuuuucuuuuucguugguguaaagccaacacccugucuaaaaaacauaaauuucuuuaaucauuuugccucuuuucucugugcuucaauuaauaaaaaauggaaagaaucu

SEQ ID NO: 13 - DNA, 186 bp, Artificial Sequence
  3'-UTR albumin7
catcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacct

SEQ ID NO: 14 - RNA, 186 nt, Artificial Sequence
  3'-UTR albumin7 mRNA
caucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccu

SEQ ID NO: 15 - DNA, 187 bp, Artificial Sequence
  3'-UTR ALB7
gcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacct

SEQ ID NO: 16 - RNA, 187 nt, Artificial Sequence
  3'-UTR ALB7 mRNA
gcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccu

SEQ ID NO: 17 - DNA, 24 bp, Artificial Sequence
  histone stem-loop sequence
caaaggctcttttcagagccacca

SEQ ID NO: 18 - RNA, 24 nt, Artificial Sequence
  histone stem-loop sequence mRNA
caaaggcucuuuucagagccacca

SEQ ID NO: 19 - DNA, 13 bp, Artificial Sequence
  Kozak
gccgccaccatgg

SEQ ID NO: 20 - RNA, 13 nt, Artificial Sequence
  Kozak mRNA
gccgccaccaugg

SEQ ID NO: 21 - protein, 14 aa, Artificial Sequence
  carrier peptide 1
CRRRRRRRRRRRRC

SEQ ID NO: 22 - protein, 13 aa, Artificial Sequence
  carrier peptide 2
CRRRRRRRRRRRR

SEQ ID NO: 23 - protein, 14 aa, Artificial Sequence
  carrier peptide 3
WRRRRRRRRRRRRC

SEQ ID NO: 24 - protein, 18 aa, Artificial Sequence
  carrier peptide 4
CHHHHHHRRRRHHHHHHC

SEQ ID NO: 25 - RNA, 1083 nt, Artificial Sequence
  isRNA (cargo) 1 mRNA product
gggagaaagcucaagcuuauccaaguaggcuggucaccuguacaacguagccgguauuuuuuuuuuuuuuuuuuuuuugaccgucucaagguccaaguuagucugccuauaaaggugcggauccacagcugaugaaagacuugugcgguacgguuaaucuccccuuuuuuuuuuuuuuuuuuuuuaguaaaugcgucuacugaauccagcgaugaugcuggcccagaucuucgaccacaagugcauauaguagucaucgagggucgccuuuuuuuuuuuuuuuuuuuuuuuggcccaguucugagacuucgcuagagacuacaguuacagcugcaguaguaaccacugcggcuauugcaggaaaucccguucagguuuuuuuuuuuuuuuuuuuuuccgcucacuaugauuaagaaccagguggagugucacugcucucgaggucucacgagagcgcucgauacaguccuuggaagaaucuuuuuuuuuuuuuuuuuuuuuugugcgacgaucacagagaacuucuauucaugcaggucugcucuagaacgaacugaccugacgccugaacuuaugagcgugcguauuuuuuuuuuuuuuuuuuuuuuuccucccaacaaaugucgaucaauagcugggcuguuggagacgcgucagcaaaugccguggcuccauaggacguguagacuucuauuuuuuuuuuuuuuuuuuuuucccgggaccacaaauaauauucuugcuugguugggcgcaagggccccguaucaggucauaaacggguacauguugcacaggcuccuuuuuuuuuuuuuuuuuuuuuuucgcugaguuauuccggucucaaaagacggcagacgucagucgacaacacggucuaaagcagugcuacaaucugccguguucguguuuuuuuuuuuuuuuuuuuugugaaccuacacggcgugcacuguaguucgcaauucauaggguaccggcucagaguuaugccuugguugaaaacugcccagcauacuuuuuuuuuuuuuuuuuuuucauauucccaugcuaagcaagggaugccgcgagucauguuaagcuugaauu

SEQ ID NO: 26 - RNA, 546 nt, Artificial Sequence
  isRNA (cargo) 2 mRNA product
gggagaaagcucaagcuuauccaaguaggcuggucaccuguacaacguagccgguauuuuuuuuuuuuuuuuuuuuuugaccgucucaagguccaaguuagucugccuauaaaggugcggauccacagcugaugaaagacuugugcgguacgguuaaucuccccuuuuuuuuuuuuuuuuuuuuuaguaaaugcgucuacugaauccagcgaugaugcuggcccagaucuucgaccacaagugcauauaguagucaucgagggucgccuuuuuuuuuuuuuuuuuuuuuuuggcccaguucugagacuucgcuagagacuacaguuacagcugcaguaguaaccacugcggcuauugcaggaaaucccguucagguuuuuuuuuuuuuuuuuuuuuccgcucacuaugauuaagaaccagguggagugucacugcucucgaggucucacgagagcgcucgauacaguccuuggaagaaucuuuuuuuuuuuuuuuuuuuuuugugcgacgaucacagagaacuucuauucaugcaggucugcucua

SEQ ID NO: 27 - RNA, 547 nt, Artificial Sequence
  R2025/R2391 isRNA (cargo) 3 mRNA product
gggagaaagcucaagcuuauccaaguaggcuggucaccuguacaacguagccgguauuuuuuuuuuuuuuuuuuuuuugaccgucucaagguccaaguuagucugccuauaaaggugcggauccacagcugaugaaagacuugugcgguacgguuaaucuccccuuuuuuuuuuuuuuuuuuuuuaguaaaugcgucuacugaauccagcgaugaugcuggcccagaucuucgaccacaagugcauauaguagucaucgagggucgccuuuuuuuuuuuuuuuuuuuuuuuggcccaguucugagacuucgcuagagacuacaguuacagcugcaguaguaaccacugcggcuauugcaggaaaucccguucagguuuuuuuuuuuuuuuuuuuuuccgcucacuaugauuaagaaccagguggagugucacugcucucgaggucucacgagagcgcucgauacaguccuuggaagaaucuuuuuuuuuuuuuuuuuuuuuugugcgacgaucacagagaacuucuauucaugcaggucugcucuag

SEQ ID NO: 28 - RNA, 547 nt, Artificial Sequence
  R3630/R3631 isRNA (cargo) 4 mRNA product
gggagaaagcucaagcuuauccaaguaggcuggucaccuguacaacguagccgguauuuuuuuuuuuuuuuuuuuuuugaccgucucaagguccaaguuagucugccuauaaaggugcggauccacagcugaugaaagacuugugcgguacgguuaaucuccccuuuuuuuuuuuuuuuuuuuuuaguaaaugcgucuacugaauccagcgaugaugcuggcccagaucuucgaccacaagugcauauaguagucaucgagggucgccuuuuuuuuuuuuuuuuuuuuuuuggcccaguucugagacuucgcuagagacuacaguuacagcugcaguaguaaccacugcggcuauugcaggaaaucccguucagguuuuuuuuuuuuuuuuuuuuuccgcucacuaugauuaagaaccagguggagugucacugcucucgaggucucacgagagcgcucgauacagugcuuggaagaaucuuuuuuuuuuuuuuuuuuuuuugugcgacgaucacagagaacuucuauucaugcaggucugcucuag

SEQ ID NO: 29 - RNA, 547 nt, Artificial Sequence
  isRNA (cargo) 5 mRNA product
gggagaaagcucaagcuuauccaaguaggcuggucaccuguacaacguagccgguauuuuuuuuuuuuuuuuuuuuuugaccgucucaagguccaaguuagucugccuauaaaggugcggauccacagcugaugaaagacuugugcgguacgguuaaucuccccuuuuuuuuuuuuuuuuuuuuuaguaaaugcgucuacugaauccagcgaugaugcuggcccagaucaucgaccacaagugcauauaguagucaucgagggucgccuuuuuuuuuuuuuuuuuuuuuuuggcccaguucugagacuucgcuagagacuacaguuacagcugcaguaguaaccacugcggcuauugcaggaaaucccguucagguuuuuuuuuuuuuuuuuuuuuccgcucacuaugauuaagaaccagguggagugucacugcucucgaggucucacgagagcgcucgauacagugcuuggaagaaucuuuuuuuuuuuuuuuuuuuuuugugcgacgaucacagagaacuucuauucaugcaggucugcucuag

SEQ ID NO: 30 - RNA, 547 nt, Artificial Sequence
  isRNA (cargo) 6 mRNA product
gggagaaagcucaagcuuauccaaguaggcuggucaccuguacaacguagccgguauuuuuuuuuuuuuuuuuuuuuugaccgucucaagguccaaguuagucugccuauaaaggugcggauccacagcugaugaaagacuugugcgguacgguuaaucuccccuuuuuuuuuuuuuuuuuuuuuaguaaaugcgucuacugaauccagcgaugaugcuggcccagaucuucgaccacaagugcauaugguagucaucgagggucgccuuuuuuuuuuuuuuuuuuuuuuuggcccaguucugagacuucgcuagagacuacaguuacagcugcaguaguaaccacugcggcuauugcaggaaaucccguucagguuuuuuuuuuuuuuuuuuuuuccgcucacuaugauuaagaaccagguggagugucacugcucucgaggucucacgagagcgcucgauacagugcuuggaagaaucuuuuuuuuuuuuuuuuuuuuuugugcgacgaucacagagaacuucuauucaugcaggucugcucuag

SEQ ID NO: 31 - RNA, 547 nt, Artificial Sequence
  isRNA (cargo) 7 mRNA product
gggagaaagcucaagcuuauccaaguaggcuggucaccuguacaacguagccgguauuuuuuuuuuuuuuuuuuuuuugaccgucucaagguccaaguuagucugccuauaaaggugcggauccacagcugaugaaagacuugugcgguacgguuaaucuccccuuuuuuuuuuuuuuuuuuuuuaguaaaugcgucuacugaauccagcgaugaugcuggcccagaucuucgaccacaaaugcauauaguagucaucgagggucgccuuuuuuuuuuuuuuuuuuuuuuuggcccaguucugagacuucgcuagagacuacaguuacagcugcaguaguaaccacugcggcuauugcaggaaaucccguucagguuuuuuuuuuuuuuuuuuuuuccgcucacuaugauuaagaaccagguggagugucacugcucucgaggucucacgagagcgcucgauacagugcuuggaagaaucuuuuuuuuuuuuuuuuuuuuuugugcgacgaucacagagaacuucuauucaugcaggucugcucuag

SEQ ID NO: 32 - RNA, 547 nt, Artificial Sequence
  isRNA (cargo) 8 mRNA product
gggagaaagcucaagcuuauccaaguaggcuggucaccuguacaacguagccgguauuuuuuuuuuuuuuuuuuuuuugaccgucucaagguccaaguuagucugccuauaaaggugcggauccacagcugaugaaagacuugugcgguacgguuaaucuccccuuuuuuuuuuuuuuuuuuuuuaguaaaugcgucuacugaauccagcgaugaugcuggcccagaucuucgaccacaagugcauauaguagucaucgagggucgacuuuuuuuuuuuuuuuuuuuuuuuggcccaguucugagacuucgcuagagacuacaguuacagcugcaguaguaaccacugcggcuauugcaggaaaucccguucagguuuuuuuuuuuuuuuuuuuuuccgcucacuaugauuaagaaccagguggagugucacugcucucgaggucucacgagagcgcucgauacagugcuuggaagaaucuuuuuuuuuuuuuuuuuuuuuugugcgacgaucacagagaacuucuauucaugcaggucugcucuag

SEQ ID NO: 33 - RNA, 547 nt, Artificial Sequence
  isRNA (cargo) 9 mRNA product
gggagaaagcucaagcuuauccaaguaggcuggucaccuguacaacguagccgguauuuuuuuuuuuuuuuuuuuuuugaccgucucaagguccaaguuagucugccuauaaaggugcggauccacagcugaugaaagacuugugcgguacgguuaaucuccccuuuuuuuuuuuuuuuuuuuuuaguaaaugcgucuacugaauccagcgaugaugcuggcccagaucuucgaccacaagugcauauaguagucaucgagggucgccuuuuuuuuuuuuuuuuuuuuuuuggcccaguucugagacgucgcuagagacuacaguuacagcugcaguaguaaccacugcggcuauugcaggaaaucccguucagguuuuuuuuuuuuuuuuuuuuuccgcucacuaugauuaagaaccagguggagugucacugcucucgaggucucacgagagcgcucgauacagugcuuggaagaaucuuuuuuuuuuuuuuuuuuuuuugugcgacgaucacagagaacuucuauucaugcaggucugcucuag

SEQ ID NO: 34 - RNA, 1870 nt, Artificial Sequence
  R1265/R2569 mRNA product opt Design1 from luciferase
gggagaaagcuugaggauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccguguaagacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 35 - RNA, 2035 nt, Artificial Sequence
  R2244/R2667 mRNA product opt Design2 from luciferase
ggggcgcugccuacggagguggcagccaucuccuucucggcaucaagcuugaggauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccguguaagacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 36 - RNA, 1918 nt, Artificial Sequence
  R1548 mRNA product opt Design1 from Influenza A H1N1 hemagglutinin
gggagaaagcuuaccaugaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 37 - RNA, 2083 nt, Artificial Sequence
  R2564 mRNA product opt Design2 from Influenza A H1N1 hemagglutinin
ggggcgcugccuacggagguggcagccaucuccuucucggcaucaagcuuaccaugaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 38 - protein, 18 aa, Artificial Sequence
  derived and/or modified protein sequence (wt) from Homo sapiens__AAB59424.1__signal peptide_IgE
MDWTWILFLVAAATRVHS

SEQ ID NO: 39 - protein, 27 aa, Artificial Sequence
  derived and/or modified protein sequence (wt) from CCHVF(IbAr10200)__AAA86616.2__signal peptide_SP-GP
MHISLMYAILCLQLCGLGETHGSHNET

SEQ ID NO: 40 - protein, 24 aa, Artificial Sequence
  derived and/or modified protein sequence (wt) from Homo sapiens__AAA59606.1__signal peptide_HLA-A2-SP
MAVMAPRTLVLLLSGALALTQTWA

SEQ ID NO: 41 - protein, 25 aa, Artificial Sequence
  derived and/or modified protein sequence (wt) from Homo sapiens__AAA59606.1__signal peptide_HLA-A2-SP
MAVMAPRTLVLLLSGALALTQTWAG

SEQ ID NO: 42 - protein, 23 aa, Artificial Sequence
  derived and/or modified protein sequence (wt) from Homo sapiens__AAA61213.1__signal peptide_HsPLAT
MDAMKRGLCCVLLLCGAVFVSPS

SEQ ID NO: 43 - protein, 21 aa, Artificial Sequence
  derived and/or modified protein sequence (wt) from Homo sapiens__AAA61213.1__signal peptide_HsPLAT
MDAMKRGLCCVLLLCGAVFVS

SEQ ID NO: 44 - protein, 22 aa, Artificial Sequence
  derived and/or modified protein sequence (wt) from Homo sapiens__AAA61213.1__signal peptide_HsPLAT
MDAMKRGLCCVLLLCGAVFVSP

SEQ ID NO: 45 - protein, 27 aa, Artificial Sequence
  derived and/or modified protein sequence (wt) from Homo sapiens__NP_000790.2__signal peptide_HsEPO
MGVHECPAWLWLLLSLLSLPLGLPVLG

SEQ ID NO: 46 - protein, 18 aa, Artificial Sequence
  derived and/or modified protein sequence (wt) from Homo sapiens__NP_000468.1__signal peptide_HsALB
MKWVTFISLLFLFSSAYS

SEQ ID NO: 47 - protein, 24 aa, Artificial Sequence
  derived and/or modified protein sequence (wt) from Homo sapiens__NP_055022.2__signal peptide_HsCD5
MPMGSLQPLATLYLLGMLVASCLG

SEQ ID NO: 48 - protein, 20 aa, Artificial Sequence
  derived and/or modified protein sequence (wt) from Homo sapiens__NP_000577.2__signal peptide_HsIL2
MYRMQLLSCIALSLALVTNS

SEQ ID NO: 49 - protein, 18 aa, Artificial Sequence
  derived and/or modified protein sequence (wt) from Homo sapiens__NP_001020371.3 __signal peptide_HsCTRB2
MAFLWLLSCWALLGTTFG

SEQ ID NO: 50 - protein, 19 aa, Artificial Sequence
  derived and/or modified protein sequence (wt) from Homo sapiens__BAC87457.1__signal peptide_immunoglobulin (IgG heavy chain)
MEFGLSWVFLVALFRGVQC

SEQ ID NO: 51 - protein, 19 aa, Artificial Sequence
  derived and/or modified protein sequence (wt) from Homo sapiens__AAA52897.1__signal peptide_human immunoglobulin heavy chain
MDWTWRVFCLLAVTPGAHP

SEQ ID NO: 52 - protein, 19 aa, Artificial Sequence
  derived and/or modified protein sequence (wt) from Homo sapiens__AAA59018.1__signal peptide_human immunoglobulin light chain
MAWSPLFLTLITHCAGSWA

SEQ ID NO: 53 - protein, 17 aa, Artificial Sequence
  derived and/or modified protein sequence (wt) from Gaussia princeps__AAG54095.1__signal peptide_GpLuc
MGVKVLFALICIAVAEA

SEQ ID NO: 54 - protein, 21 aa, Artificial Sequence
  derived and/or modified protein sequence (wt) from Mus musculus__BAR42292.1__signal peptide_MmIgkappa
METDTLLLWVLLLWVPGSTGD

SEQ ID NO: 55 - protein, 26 aa, Artificial Sequence
  derived and/or modified protein sequence (wt) from Nepenthes rafflesiana__ABF74624.1__signal peptide_NrChit1
MKTHYSSAILPILTLFVFLSINPSHG

SEQ ID NO: 56 - protein, 21 aa, Artificial Sequence
  derived and/or modified protein sequence (wt) from Conus leopardus__AAS93426.1__signal peptide_ClLp1.1
MGMRMMFIMFMLVVLATTVVS

SEQ ID NO: 57 - protein, 24 aa, Artificial Sequence
  derived and/or modified protein sequence (wt) from Nepenthes gracilis__AB114914.1__signal peptide_NgNep1
MASSLYSFLLALSIVYIFVAPTHS

SEQ ID NO: 58 - protein, 19 aa, Artificial Sequence
  derived and/or modified protein sequence (wt) from Homo sapiens__NP_001691.1__signal peptide_HsAzu1
MTRLTVLALLAGLLASSRA

SEQ ID NO: 59 - protein, 16 aa, Artificial Sequence
  derived and/or modified protein sequence (wt) from Homo sapiens__AAA51948.1__signal peptide_HsCD33
MPLLLLLPLLWAGALA

SEQ ID NO: 60 - protein, 19 aa, Artificial Sequence
  derived and/or modified protein sequence (wt) from Vibrio cholerae__BAA06291.1__signal peptide_VcCtxB
MIKLKFGVFFTVLLSSAYA

SEQ ID NO: 61 - protein, 20 aa, Artificial Sequence
  derived and/or modified protein sequence (wt) from Homo sapiens__NP_001890.1__signal peptide_HsCST4
MARPLCTLLLLMATLAGALA

SEQ ID NO: 62 - protein, 24 aa, Artificial Sequence
  derived and/or modified protein sequence (wt) from Homo sapiens__AAA59172.1__signal peptide_HsIns-iso1
MALWMRLLPLLALLALWGPDPAAA

SEQ ID NO: 63 - protein, 17 aa, Artificial Sequence
  derived and/or modified protein sequence (wt) from Homo sapiens__CAA68724.1__signal peptide_HsSPARC
MRAWIFFLLCLAGRALA

SEQ ID NO: 64 - protein, 17 aa, Artificial Sequence
  derived and/or modified protein sequence (wt) from Inluenza A__ACQ45338.1__signal peptide_H1N1(Netherlands2009)-HA
MKAILVVLLYTFATANA

SEQ ID NO: 65 - protein, 25 aa, Artificial Sequence
  derived and/or modified protein sequence (wt) from Homo sapiens__CAA23783.1__signal peptide_MHCII
MAISGVPVLGFFIIAVLMSAQESWA

SEQ ID NO: 66 - RNA, 54 nt, Artificial Sequence
  derived and/or modified CDS sequence (wt) from Homo sapiens__AAB59424.1__signal peptide_IgE
auggacuggaccuggauccuguuccucguggccgccgcgacccgcguccacagc

SEQ ID NO: 67 - RNA, 81 nt, Artificial Sequence
  derived and/or modified CDS sequence (wt) from CCHVF(IbAr10200)__AAA86616.2__signal peptide_SP-GP
augcauauaucauuaauguaugcaauccuuugccuacagcuguguggucugggagagacucauggaucacacaaugaaacu

SEQ ID NO: 68 - RNA, 72 nt, Artificial Sequence
  derived and/or modified CDS sequence (wt) from Homo sapiens__AAA59606.1__signal peptide_HLA-A2-SP
auggccgucauggcgccccgaacccucguccugcuacucucgggggcucuggcccugacccagaccugggcg

SEQ ID NO: 69 - RNA, 75 nt, Artificial Sequence
  derived and/or modified CDS sequence (wt) from Homo sapiens__AAA59606.1__signal peptide_HLA-A2-SP
auggccgucauggcgccccgaacccucguccugcuacucucgggggcucuggcccugacccagaccugggcgggc

SEQ ID NO: 70 - RNA, 69 nt, Artificial Sequence
  derived and/or modified CDS sequence (wt) from Homo sapiens__AAA61213.1__signal peptide_HsPLAT
auggaugcaaugaagagagggcucugcugugugcugcugcuguguggagcagucuucguuucgcccagc

SEQ ID NO: 71 - RNA, 63 nt, Artificial Sequence
  derived and/or modified CDS sequence (wt) from Homo sapiens__AAA61213.1__signal peptide_HsPLAT
auggaugcaaugaagagagggcucugcugugugcugcugcuguguggagcagucuucguuucg

SEQ ID NO: 72 - RNA, 66 nt, Artificial Sequence
  derived and/or modified CDS sequence (wt) from Homo sapiens__AAA61213.1__signal peptide_HsPLAT
auggaugcaaugaagagagggcucugcugugugcugcugcuguguggagcagucuucguuucgccc

SEQ ID NO: 73 - RNA, 81 nt, Artificial Sequence
  derived and/or modified CDS sequence (wt) from Homo sapiens__NP_000790.2__signal peptide_HsEPO
augggggugcacgaauguccugccuggcuguggcuucuccugucccugcugucgcucccucugggccucccaguccugggc

SEQ ID NO: 74 - RNA, 54 nt, Artificial Sequence
  derived and/or modified CDS sequence (wt) from Homo sapiens__NP_000468.1__signal peptide_HsALB
augaaguggguaaccuuuauuucccuucuuuuucucuuuagcucggcuuauucc

SEQ ID NO: 75 - RNA, 72 nt, Artificial Sequence
  derived and/or modified CDS sequence (wt) from Homo sapiens__NP_055022.2__signal peptide_HsCD5
augcccauggggucucugcaaccgcuggccaccuuguaccugcuggggaugcuggucgcuuccugccucgga

SEQ ID NO: 76 - RNA, 60 nt, Artificial Sequence
  derived and/or modified CDS sequence (wt) from Homo sapiens__NP_000577.2__signal peptide_HsIL2
auguacaggaugcaacuccugucuugcauugcacuaagucuugcacuugucacaaacagu

SEQ ID NO: 77 - RNA, 54 nt, Artificial Sequence
  derived and/or modified CDS sequence (wt) from Homo sapiens__NP_001020371.3 __signal peptide_HsCTRB2
auggcuuuccucuggcuccucuccugcugggcccuccuggguaccaccuucggc

SEQ ID NO: 78 - RNA, 57 nt, Artificial Sequence
  derived and/or modified CDS sequence (wt) from Homo sapiens__BAC87457.1__signal peptide_immunoglobulin (IgG heavy chain)
auggaguuugggcugagcuggguuuuccucguugcucuuuuuagagguguccagugu

SEQ ID NO: 79 - RNA, 57 nt, Artificial Sequence
  derived and/or modified CDS sequence (wt) from Homo sapiens__AAA52897.1__signal peptide_human immunoglobulin heavy chain
auggacuggaccuggagggucuucuguuugcuggcuguaacuccaggcgcccacccc

SEQ ID NO: 80 - RNA, 57 nt, Artificial Sequence
  derived and/or modified CDS sequence (wt) from Homo sapiens__AAA59018.1__signal peptide_human immunoglobulin light chain
auggccugguccccucucuuccucacccucaucacucacugugcaggguccugggcc

SEQ ID NO: 81 - RNA, 51 nt, Artificial Sequence
  derived and/or modified CDS sequence (wt) from Gaussia princeps__AAG54095.1__signal peptide_GpLuc
augggagugaaaguucuuuuugcccuuauuuguauugcuguggccgaggcc

SEQ ID NO: 82 - RNA, 63 nt, Artificial Sequence
  derived and/or modified CDS sequence (wt) from Mus musculus__BAR42292.1__signal peptide_MmIgkappa
auggagacagacacacuccugcuaugggugcugcugcucuggguuccagguuccacaggugac

SEQ ID NO: 83 - RNA, 78 nt, Artificial Sequence
  derived and/or modified CDS sequence (wt) from Nepenthes rafflesiana__ABF74624.1__signal peptide_NrChit1
augaagacccauuauucaucagcaauucucccgauccucacccucuucgucuuucucucgaucaauccaucccauggc

SEQ ID NO: 84 - RNA, 63 nt, Artificial Sequence
  derived and/or modified CDS sequence (wt) from Conus leopardus__AAS93426.1__signal peptide_ClLp1.1
augggcaugcggaugauguucaucauguuuaugcugguugucuuggcaaccacugucguuucc

SEQ ID NO: 85 - RNA, 72 nt, Artificial Sequence
  derived and/or modified CDS sequence (wt) from Nepenthes gracilis__AB114914.1__signal peptide_NgNep1
auggccucgucgcuguauucuuucuuacucgcauuaucgauaguuuacaucuuuguugccccaacacauucu

SEQ ID NO: 86 - RNA, 57 nt, Artificial Sequence
  derived and/or modified CDS sequence (wt) from Homo sapiens__NP_001691.1__signal peptide_HsAzu1
augacccggcugacaguccuggcccugcuggcuggucugcuggcguccucgagggcc

SEQ ID NO: 87 - RNA, 48 nt, Artificial Sequence
  derived and/or modified CDS sequence (wt) from Homo sapiens__AAA51948.1__signal peptide_HsCD33
augccgcugcugcuacugcugccccugcugugggcaggggcccuggcu

SEQ ID NO: 88 - RNA, 57 nt, Artificial Sequence
  derived and/or modified CDS sequence (wt) from Vibrio cholerae__BAA06291.1__signal peptide_VcCtxB
augauuaaauuaaaauuugguguuuuuuuuacaguuuuacuaucuucagcauaugca

SEQ ID NO: 89 - RNA, 60 nt, Artificial Sequence
  derived and/or modified CDS sequence (wt) from Homo sapiens__NP_001890.1__signal peptide_HsCST4
auggcccggccucuguguacccugcuacuccugauggcuacccuggcuggggcucuggcc

SEQ ID NO: 90 - RNA, 72 nt, Artificial Sequence
  derived and/or modified CDS sequence (wt) from Homo sapiens__AAA59172.1__signal peptide_HsIns-iso1
auggcccuguggaugcgccuccugccccugcuggcgcugcuggcccucuggggaccugacccagccgcagcc

SEQ ID NO: 91 - RNA, 51 nt, Artificial Sequence
  derived and/or modified CDS sequence (wt) from Homo sapiens__CAA68724.1__signal peptide_HsSPARC
augagggccuggaucuucuuucuccuuugccuggccgggagggcucuggca

SEQ ID NO: 92 - RNA, 51 nt, Artificial Sequence
  derived and/or modified CDS sequence (wt) from Inluenza A__ACQ45338.1__signal peptide_H1N1(Netherlands2009)-HA
augaaggcaauacuaguaguucugcuauauacauuugcaaccgcaaaugca

SEQ ID NO: 93 - RNA, 75 nt, Artificial Sequence
  derived and/or modified CDS sequence (wt) from Homo sapiens__CAA23783.1__signal peptide_MHCII
auggccauaaguggagucccugugcuaggauuuuucaucauagcugugcugaugagcgcucaggaaucaugggcu

SEQ ID NO: 94 - RNA, 54 nt, Artificial Sequence; identical to SEQ ID NO: 66
  derived and/or modified CDS sequence (opt1) from Homo sapiens__AAB59424.1__signal peptide_IgE

SEQ ID NO: 95 - RNA, 81 nt, Artificial Sequence
  derived and/or modified CDS sequence (opt1) from CCHVF(IbAr10200)__AAA86616.2__signal peptide_SP-GP
augcacaucagccugauguacgccauccucugccugcagcugugcggccucggggagacccacggcucccacaacgagacc

SEQ ID NO: 96 - RNA, 72 nt, Artificial Sequence
  derived and/or modified CDS sequence (opt1) from Homo sapiens__AAA59606.1__signal peptide_HLA-A2-SP
auggccgugauggccccgcggacccugguccuccugcugagcggcgcgcucgcccugacccagacgugggcc

SEQ ID NO: 97 - RNA, 75 nt, Artificial Sequence
  derived and/or modified CDS sequence (opt1) from Homo sapiens__AAA59606.1__signal peptide_HLA-A2-SP
auggccgugauggccccgcggacccugguccuccugcugagcggcgcgcucgcccugacccagacgugggccggg

SEQ ID NO: 98 - RNA, 69 nt, Artificial Sequence
  derived and/or modified CDS sequence (opt1) from Homo sapiens__AAA61213.1__signal peptide_HsPLAT
auggacgccaugaagcgcggccugugcugcgugcuccugcugugcggggccgucuucgugagccccucc

SEQ ID NO: 99 - RNA, 63 nt, Artificial Sequence
  derived and/or modified CDS sequence (opt1) from Homo sapiens__AAA61213.1__signal peptide_HsPLAT
auggacgccaugaagcgcggccugugcugcgugcuccugcugugcggggccgucuucgugagc

SEQ ID NO: 100 - RNA, 66 nt, Artificial Sequence
  derived and/or modified CDS sequence (opt1) from Homo sapiens__AAA61213.1__signal peptide_HsPLAT
auggacgccaugaagcgcggccugugcugcgugcuccugcugugcggggccgucuucgugagcccc

SEQ ID NO: 101 - RNA, 81 nt, Artificial Sequence
  derived and/or modified CDS sequence (opt1) from Homo sapiens__NP_000790.2__signal peptide_HsEPO
augggcgugcacgagugccccgccuggcuguggcuccugcugagccuccugucccugccgcucgggcugcccguccugggc

SEQ ID NO: 102 - RNA, 54 nt, Artificial Sequence
  derived and/or modified CDS sequence (opt1) from Homo sapiens__NP_000468.1__signal peptide_HsALB
augaagugggugaccuucaucagccugcucuuccuguucuccagcgccuacucc

SEQ ID NO: 103 - RNA, 72 nt, Artificial Sequence
  derived and/or modified CDS sequence (opt1) from Homo sapiens__NP_055022.2__signal peptide_HsCD5
augcccaugggcagccugcagccgcucgccacccuguaccugcucgggaugcugguggccuccugccugggc

SEQ ID NO: 104 - RNA, 60 nt, Artificial Sequence
  derived and/or modified CDS sequence (opt1) from Homo sapiens__NP_000577.2__signal peptide_HsIL2
auguaccggaugcagcugcucagcugcaucgcccugucgcuggcgcucgugaccaacagc

SEQ ID NO: 105 - RNA, 54 nt, Artificial Sequence
  derived and/or modified CDS sequence (opt1) from Homo sapiens__NP_001020371.3 __signal peptide_HsCTRB2
auggccuuccuguggcuccugagcugcugggcccugcucggcaccaccuucggg

SEQ ID NO: 106 - RNA, 57 nt, Artificial Sequence
  derived and/or modified CDS sequence (opt1) from Homo sapiens__BAC87457.1__signal peptide_immunoglobulin (IgG heavy chain)
auggaguucggccugagcuggguguuccucgucgcccuguuccgcggggugcagugc

SEQ ID NO: 107 - RNA, 57 nt, Artificial Sequence
  derived and/or modified CDS sequence (opt1) from Homo sapiens__AAA52897.1__signal peptide_human immunoglobulin heavy chain
auggacuggaccuggcgcguguucugccugcucgccgucacccccggcgcccacccg

SEQ ID NO: 108 - RNA, 57 nt, Artificial Sequence
  derived and/or modified CDS sequence (opt1) from Homo sapiens__AAA59018.1__signal peptide_human immunoglobulin light chain
auggccuggagcccccuguuccucacccugaucacccacugcgccggcuccugggcg

SEQ ID NO: 109 - RNA, 51 nt, Artificial Sequence
  derived and/or modified CDS sequence (opt1) from Gaussia princeps__AAG54095.1__signal peptide_GpLuc
augggcgugaagguccuguucgcccucaucugcaucgccguggcggaggcc

SEQ ID NO: 110 - RNA, 63 nt, Artificial Sequence
  derived and/or modified CDS sequence (opt1) from Mus musculus__BAR42292.1__signal peptide_MmIgkappa
auggagaccgacacccugcuccugugggugcugcuccuguggguccccggcagcacgggggac

SEQ ID NO: 111 - RNA, 78 nt, Artificial Sequence
  derived and/or modified CDS sequence (opt1) from Nepenthes rafflesiana__ABF74624.1__signal peptide_NrChit1
augaagacccacuacagcuccgccauccugcccauccucacccuguucguguuccugagcaucaacccgucccacggc

SEQ ID NO: 112 - RNA, 63 nt, Artificial Sequence
  derived and/or modified CDS sequence (opt1) from Conus leopardus__AAS93426.1__signal peptide_ClLp1.1
augggcaugcgcaugauguucaucauguucaugcuggugguccucgccaccaccguggugagc

SEQ ID NO: 113 - RNA, 72 nt, Artificial Sequence
  derived and/or modified CDS sequence (opt1) from Nepenthes gracilis__AB114914.1__signal peptide_NgNep1
auggccagcucccuguacagcuuccuccuggcccuguccaucguguacaucuucgucgcgcccacccacagc

SEQ ID NO: 114 - RNA, 57 nt, Artificial Sequence
  derived and/or modified CDS sequence (opt1) from Homo sapiens__NP_001691.1__signal peptide_HsAzu1
augacccgccugaccgugcucgcccugcuggccggccuccuggcgagcucccgggcc

SEQ ID NO: 115 - RNA, 48 nt, Artificial Sequence
  derived and/or modified CDS sequence (opt1) from Homo sapiens__AAA51948.1__signal peptide_HsCD33
augccccugcuccugcugcucccgcugcugugggccggcgcccucgcg

SEQ ID NO: 116 - RNA, 57 nt, Artificial Sequence
  derived and/or modified CDS sequence (opt1) from Vibrio cholerae__BAA06291.1__signal peptide_VcCtxB
augaucaagcugaaguucggcguguucuucaccguccuccugagcuccgccuacgcc

SEQ ID NO: 117 - RNA, 60 nt, Artificial Sequence
  derived and/or modified CDS sequence (opt1) from Homo sapiens__NP_001890.1__signal peptide_HsCST4
auggcccgcccccugugcacccuccugcugcucauggccacccuggcgggcgcccuggcc

SEQ ID NO: 118 - RNA, 72 nt, Artificial Sequence
  derived and/or modified CDS sequence (opt1) from Homo sapiens__AAA59172.1__signal peptide_HsIns-iso1
auggcccuguggaugcgccuccugccccugcucgcccugcuggcgcucuggggcccggaccccgccgccgcc

SEQ ID NO: 119 - RNA, 51 nt, Artificial Sequence
  derived and/or modified CDS sequence (opt1) from Homo sapiens__CAA68724.1__signal peptide_HsSPARC
augcgcgccuggaucuucuuccugcucugccuggccggccgggcccuggcc

SEQ ID NO: 120 - RNA, 51 nt, Artificial Sequence
  derived and/or modified CDS sequence (opt1) from Inluenza A__ACQ45338.1__signal peptide_H1N1(Netherlands2009)-HA
augaaggccauccuggugguccuccuguacaccuucgccaccgcgaacgcc

SEQ ID NO: 121 - RNA, 75 nt, Artificial Sequence
  derived and/or modified CDS sequence (opt1) from Homo sapiens__CAA23783.1__signal peptide_MHCII
auggccaucagcggcgugcccguccugggguucuucaucaucgccgugcucauguccgcgcaggagagcugggcc

SEQ ID NO: 122 - RNA, 54 nt, Artificial Sequence
  derived and/or modified CDS sequence (opt3) from Homo sapiens__AAB59424.1__signal peptide_IgE
auggacuggaccuggauccuguuccucguggccgcugcaacaagaguccacagc

SEQ ID NO: 123 - RNA, 81 nt, Artificial Sequence
  derived and/or modified CDS sequence (opt3) from CCHVF(IbAr10200)__AAA86616.2__signal peptide_SP-GP
augcacaucagccugauguacgccauucucugccuucagcuguguggcuugggggagacccauggaucccacaacgaaaca

SEQ ID NO: 124 - RNA, 72 nt, Artificial Sequence
  derived and/or modified CDS sequence (opt3) from Homo sapiens__AAA59606.1__signal peptide_HLA-A2-SP
auggccgugauggcucccagaacccugguccuccuucugagcggcgcauuggccuuaacacagacuugggcg

SEQ ID NO: 125 - RNA, 75 nt, Artificial Sequence
  derived and/or modified CDS sequence (opt3) from Homo sapiens__AAA59606.1__signal peptide_HLA-A2-SP
auggccgugauggcucccagaacccugguccuccuucugagcggcgcauuggccuuaacacagacuugggcgggg

SEQ ID NO: 126 - RNA, 69 nt, Artificial Sequence
  derived and/or modified CDS sequence (opt3) from Homo sapiens__AAA61213.1__signal peptide_HsPLAT
auggacgccaugaagagaggccugugcugugugcuccuucugugcggggcugucuucguuagccccucc

SEQ ID NO: 127 - RNA, 63 nt, Artificial Sequence
  derived and/or modified CDS sequence (opt3) from Homo sapiens__AAA61213.1__signal peptide_HsPLAT
auggacgccaugaagagaggccugugcugugugcuccuucugugcggggcugucuucguuagc

SEQ ID NO: 128 - RNA, 66 nt, Artificial Sequence
  derived and/or modified CDS sequence (opt3) from Homo sapiens__AAA61213.1__signal peptide_HsPLAT
auggacgccaugaagagaggccugugcugugugcuccuucugugcggggcugucuucguuagcccc

SEQ ID NO: 129 - RNA, 81 nt, Artificial Sequence
  derived and/or modified CDS sequence (opt3) from Homo sapiens__NP_000790.2__signal peptide_HsEPO
augggcgugcacgagugccccgccuggcuguggcuccuucugagcuuguuaucccugccucuagggcucccaguccuggga

SEQ ID NO: 130 - RNA, 54 nt, Artificial Sequence
  derived and/or modified CDS sequence (opt3) from Homo sapiens__NP_000468.1__signal peptide_HsALB
augaagugggugaccuucaucagccugcucuuucuuuucuccucugccuacuca

SEQ ID NO: 131 - RNA, 72 nt, Artificial Sequence
  derived and/or modified CDS sequence (opt3) from Homo sapiens__NP_055022.2__signal peptide_HsCD5
augcccaugggcagccugcagccucucgccacccuuuaccuguuggggauguuaguggcuuccugccuggga

SEQ ID NO: 132 - RNA, 60 nt, Artificial Sequence
  derived and/or modified CDS sequence (opt3) from Homo sapiens__NP_000577.2__signal peptide_HsIL2
auguacagaaugcagcugcucagcugcaucgcccuuucccuggcuuuggugaccaacucu

SEQ ID NO: 133 - RNA, 54 nt, Artificial Sequence
  derived and/or modified CDS sequence (opt3) from Homo sapiens__NP_001020371.3 __signal peptide_HsCTRB2
auggccuuccuguggcuccuuagcugcugggcucuguugggcaccacauuuggg

SEQ ID NO: 134 - RNA, 57 nt, Artificial Sequence
  derived and/or modified CDS sequence (opt3) from Homo sapiens__BAC87457.1__signal peptide_immunoglobulin (IgG heavy chain)
auggaguucggccugagcuggguguuucucgucgcccuuuucagagggguucagugc

SEQ ID NO: 135 - RNA, 57 nt, Artificial Sequence
  derived and/or modified CDS sequence (opt3) from Homo sapiens__AAA52897.1__signal peptide_human immunoglobulin heavy chain
auggacuggaccuggagaguguucugccugcucgccgucacacccggcgcucacccu

SEQ ID NO: 136 - RNA, 57 nt, Artificial Sequence
  derived and/or modified CDS sequence (opt3) from Homo sapiens__AAA59018.1__signal peptide_human immunoglobulin light chain
auggccuggagcccccuguuccucacccuuaucacacacugcgcuggcuccugggca

SEQ ID NO: 137 - RNA, 51 nt, Artificial Sequence
  derived and/or modified CDS sequence (opt3) from Gaussia princeps__AAG54095.1__signal peptide_GpLuc
augggcgugaagguccuguucgcccucaucugcauugcuguugcagaggcc

SEQ ID NO: 138 - RNA, 63 nt, Artificial Sequence
  derived and/or modified CDS sequence (opt3) from Mus musculus__BAR42292.1__signal peptide_MmIgkappa
auggagaccgacacacugcuccuuugggugcuguuguuauggguccccggcagcacuggggau

SEQ ID NO: 139 - RNA, 78 nt, Artificial Sequence
  derived and/or modified CDS sequence (opt3) from Nepenthes rafflesiana__ABF74624.1__signal peptide_NrChit1
augaagacccacuacagcuccgccauccugcccauucucacacuuuucguguuucugucuauaaacccuucacauggc

SEQ ID NO: 140 - RNA, 63 nt, Artificial Sequence
  derived and/or modified CDS sequence (opt3) from Conus leopardus__AAS93426.1__signal peptide_ClLp1.1
augggcaugagaaugauguucaucauguuuaugcuggugguccucgccaccacaguugugagc

SEQ ID NO: 141 - RNA, 72 nt, Artificial Sequence
  derived and/or modified CDS sequence (opt3) from Nepenthes gracilis__AB114914.1__signal peptide_NgNep1
auggccagcucccuguacucuuuccuccuugcucugucaaucguguauauuuuugucgcacccacccacagu

SEQ ID NO: 142 - RNA, 57 nt, Artificial Sequence
  derived and/or modified CDS sequence (opt3) from Homo sapiens__NP_001691.1__signal peptide_HsAzu1
augaccagacugacagugcucgcccuucuggcuggcuuguuagcaagcuccagggcc

SEQ ID NO: 143 - RNA, 48 nt, Artificial Sequence
  derived and/or modified CDS sequence (opt3) from Homo sapiens__AAA51948.1__signal peptide_HsCD33
augccccugcuccuucuguugccuuuacugugggccggcgcucuagca

SEQ ID NO: 144 - RNA, 57 nt, Artificial Sequence
  derived and/or modified CDS sequence (opt3) from Vibrio cholerae__BAA06291.1__signal peptide_VcCtxB
augaucaagcugaaauucggcguguuuuucaccguccuccuuagcuccgccuacgcu

SEQ ID NO: 145 - RNA, 60 nt, Artificial Sequence
  derived and/or modified CDS sequence (opt3) from Homo sapiens__NP_001890.1__signal peptide_HsCST4
auggccagaccccugugcacccuccuucuguugauggcuacauuagcaggcgcccuggcg

SEQ ID NO: 146 - RNA, 72 nt, Artificial Sequence
  derived and/or modified CDS sequence (opt3) from Homo sapiens__AAA59172.1__signal peptide_HsIns-iso1
auggcccuguggaugagacuccuuccccuguuggcuuuacuggcacuauggggcccugacccagccgcggcu

SEQ ID NO: 147 - RNA, 51 nt, Artificial Sequence
  derived and/or modified CDS sequence (opt3) from Homo sapiens__CAA68724.1__signal peptide_HsSPARC
augagagccuggaucuucuuucugcucugccuugcuggcagggcacuggcc

SEQ ID NO: 148 - RNA, 51 nt, Artificial Sequence
  derived and/or modified CDS sequence (opt3) from Inluenza A__ACQ45338.1__signal peptide_H1N1(Netherlands2009)-HA
augaaggccauccuggugguccuccuuuacaccuucgcuacagcaaacgcc

SEQ ID NO: 149 - RNA, 75 nt, Artificial Sequence
  derived and/or modified CDS sequence (opt3) from Homo sapiens__CAA23783.1__signal peptide_MHCII
auggccaucagcggcgugcccguccugggguucuuuauuauagcuguucucauguccgcacaggagucuugggcc

SEQ ID NO: 150 - RNA, 54 nt, Artificial Sequence
  derived and/or modified CDS sequence (opt4) from Homo sapiens__AAB59424.1__signal peptide_IgE
auggacuggaccuggauccuguuccugguggccgccgccaccagagugcacagc

SEQ ID NO: 151 - RNA, 81 nt, Artificial Sequence
  derived and/or modified CDS sequence (opt4) from CCHVF(IbAr10200)__AAA86616.2__signal peptide_SP-GP
augcacaucagccugauguacgccauccugugccugcagcugugcggccugggcgagacccacggcagccacaacgagacc

SEQ ID NO: 152 - RNA, 72 nt, Artificial Sequence
  derived and/or modified CDS sequence (opt4) from Homo sapiens__AAA59606.1__signal peptide_HLA-A2-SP
auggccgugauggcccccagaacccuggugcugcugcugagcggcgcccuggcccugacccagaccugggcc

SEQ ID NO: 153 - RNA, 75 nt, Artificial Sequence
  derived and/or modified CDS sequence (opt4) from Homo sapiens__AAA59606.1__signal peptide_HLA-A2-SP
auggccgugauggcccccagaacccuggugcugcugcugagcggcgcccuggcccugacccagaccugggccggc

SEQ ID NO: 154 - RNA, 69 nt, Artificial Sequence
  derived and/or modified CDS sequence (opt4) from Homo sapiens__AAA61213.1__signal peptide_HsPLAT
auggacgccaugaagagaggccugugcugcgugcugcugcugugcggcgccguguucgugagccccagc

SEQ ID NO: 155 - RNA, 63 nt, Artificial Sequence
  derived and/or modified CDS sequence (opt4) from Homo sapiens__AAA61213.1__signal peptide_HsPLAT
auggacgccaugaagagaggccugugcugcgugcugcugcugugcggcgccguguucgugagc

SEQ ID NO: 156 - RNA, 66 nt, Artificial Sequence
  derived and/or modified CDS sequence (opt4) from Homo sapiens__AAA61213.1__signal peptide_HsPLAT
auggacgccaugaagagaggccugugcugcgugcugcugcugugcggcgccguguucgugagcccc

SEQ ID NO: 157 - RNA, 81 nt, Artificial Sequence
  derived and/or modified CDS sequence (opt4) from Homo sapiens__NP_000790.2__signal peptide_HsEPO
augggcgugcacgagugccccgccuggcuguggcugcugcugagccugcugagccugccccugggccugcccgugcugggc

SEQ ID NO: 158 - RNA, 54 nt, Artificial Sequence
  derived and/or modified CDS sequence (opt4) from Homo sapiens__NP_000468.1__signal peptide_HsALB
augaagugggugaccuucaucagccugcuguuccuguucagcagcgccuacagc

SEQ ID NO: 159 - RNA, 72 nt, Artificial Sequence
  derived and/or modified CDS sequence (opt4) from Homo sapiens__NP_055022.2__signal peptide_HsCD5
augcccaugggcagccugcagccccuggccacccuguaccugcugggcaugcugguggccagcugccugggc

SEQ ID NO: 160 - RNA, 60 nt, Artificial Sequence
  derived and/or modified CDS sequence (opt4) from Homo sapiens__NP_000577.2__signal peptide_HsIL2
auguacagaaugcagcugcugagcugcaucgcccugagccuggcccuggugaccaacagc

SEQ ID NO: 161 - RNA, 54 nt, Artificial Sequence
  derived and/or modified CDS sequence (opt4) from Homo sapiens__NP_001020371.3 __signal peptide_HsCTRB2
auggccuuccuguggcugcugagcugcugggcccugcugggcaccaccuucggc

SEQ ID NO: 162 - RNA, 57 nt, Artificial Sequence
  derived and/or modified CDS sequence (opt4) from Homo sapiens__BAC87457.1__signal peptide_immunoglobulin (IgG heavy chain)
auggaguucggccugagcuggguguuccugguggcccuguucagaggcgugcagugc

SEQ ID NO: 163 - RNA, 57 nt, Artificial Sequence
  derived and/or modified CDS sequence (opt4) from Homo sapiens__AAA52897.1__signal peptide_human immunoglobulin heavy chain
auggacuggaccuggagaguguucugccugcuggccgugacccccggcgcccacccc

SEQ ID NO: 164 - RNA, 57 nt, Artificial Sequence
  derived and/or modified CDS sequence (opt4) from Homo sapiens__AAA59018.1__signal peptide_human immunoglobulin light chain
auggccuggagcccccuguuccugacccugaucacccacugcgccggcagcugggcc

SEQ ID NO: 165 - RNA, 51 nt, Artificial Sequence
  derived and/or modified CDS sequence (opt4) from Gaussia princeps__AAG54095.1__signal peptide_GpLuc
augggcgugaaggugcuguucgcccugaucugcaucgccguggccgaggcc

SEQ ID NO: 166 - RNA, 63 nt, Artificial Sequence
  derived and/or modified CDS sequence (opt4) from Mus musculus__BAR42292.1__signal peptide_MmIgkappa
auggagaccgacacccugcugcugugggugcugcugcugugggugcccggcagcaccggcgac

SEQ ID NO: 167 - RNA, 78 nt, Artificial Sequence
  derived and/or modified CDS sequence (opt4) from Nepenthes rafflesiana__ABF74624.1__signal peptide_NrChit1
augaagacccacuacagcagcgccauccugcccauccugacccuguucguguuccugagcaucaaccccagccacggc

SEQ ID NO: 168 - RNA, 63 nt, Artificial Sequence
  derived and/or modified CDS sequence (opt4) from Conus leopardus__AAS93426.1__signal peptide_ClLp1.1
augggcaugagaaugauguucaucauguucaugcugguggugcuggccaccaccguggugagc

SEQ ID NO: 169 - RNA, 72 nt, Artificial Sequence
  derived and/or modified CDS sequence (opt4) from Nepenthes gracilis__AB114914.1__signal peptide_NgNep1
auggccagcagccuguacagcuuccugcuggcccugagcaucguguacaucuucguggcccccacccacagc

SEQ ID NO: 170 - RNA, 57 nt, Artificial Sequence
  derived and/or modified CDS sequence (opt4) from Homo sapiens__NP_001691.1__signal peptide_HsAzu1
augaccagacugaccgugcuggcccugcuggccggccugcuggccagcagcagagcc

SEQ ID NO: 171 - RNA, 48 nt, Artificial Sequence
  derived and/or modified CDS sequence (opt4) from Homo sapiens__AAA51948.1__signal peptide_HsCD33
augccccugcugcugcugcugccccugcugugggccggcgcccuggcc

SEQ ID NO: 172 - RNA, 57 nt, Artificial Sequence
  derived and/or modified CDS sequence (opt4) from Vibrio cholerae__BAA06291.1__signal peptide_VcCtxB
augaucaagcugaaguucggcguguucuucaccgugcugcugagcagcgccuacgcc

SEQ ID NO: 173 - RNA, 60 nt, Artificial Sequence
  derived and/or modified CDS sequence (opt4) from Homo sapiens__NP_001890.1__signal peptide_HsCST4
auggccagaccccugugcacccugcugcugcugauggccacccuggccggcgcccuggcc

SEQ ID NO: 174 - RNA, 72 nt, Artificial Sequence
  derived and/or modified CDS sequence (opt4) from Homo sapiens__AAA59172.1__signal peptide_HsIns-iso1
auggcccuguggaugagacugcugccccugcuggcccugcuggcccuguggggccccgaccccgccgccgcc

SEQ ID NO: 175 - RNA, 51 nt, Artificial Sequence
  derived and/or modified CDS sequence (opt4) from Homo sapiens__CAA68724.1__signal peptide_HsSPARC
augagagccuggaucuucuuccugcugugccuggccggcagagcccuggcc

SEQ ID NO: 176 - RNA, 51 nt, Artificial Sequence
  derived and/or modified CDS sequence (opt4) from Inluenza A__ACQ45338.1__signal peptide_H1N1(Netherlands2009)-HA
augaaggccauccugguggugcugcuguacaccuucgccaccgccaacgcc

SEQ ID NO: 177 - RNA, 75 nt, Artificial Sequence
  derived and/or modified CDS sequence (opt4) from Homo sapiens__CAA23783.1__signal peptide_MHCII
auggccaucagcggcgugcccgugcugggcuucuucaucaucgccgugcugaugagcgcccaggagagcugggcc

SEQ ID NO: 178 - RNA, 54 nt, Artificial Sequence
  derived and/or modified CDS sequence (opt5) from Homo sapiens__AAB59424.1__signal peptide_IgE
auggacuggaccuggauccuguuccucguggccgcugccacaagaguccacagc

SEQ ID NO: 179 - RNA, 81 nt, Artificial Sequence
  derived and/or modified CDS sequence (opt5) from CCHVF(IbAr10200)__AAA86616.2__signal peptide_SP-GP
augcacaucagccugauguacgccauucucugccugcagcuuuguggccugggggagacccauggaucccacaacgaaaca

SEQ ID NO: 180 - RNA, 72 nt, Artificial Sequence
  derived and/or modified CDS sequence (opt5) from Homo sapiens__AAA59606.1__signal peptide_HLA-A2-SP
auggccgugauggcucccagaacccugguccuccugcuuagcggcgcccuggcgcucacacagacgugggcu

SEQ ID NO: 181 - RNA, 75 nt, Artificial Sequence
  derived and/or modified CDS sequence (opt5) from Homo sapiens__AAA59606.1__signal peptide_HLA-A2-SP
auggccgugauggcucccagaacccugguccuccugcuuagcggcgcccuggcgcucacacagacgugggcuggg

SEQ ID NO: 182 - RNA, 69 nt, Artificial Sequence
  derived and/or modified CDS sequence (opt5) from Homo sapiens__AAA61213.1__signal peptide_HsPLAT
auggacgccaugaagagaggccugugcugugugcuccugcuuugcggggcugucuucguuagccccucc

SEQ ID NO: 183 - RNA, 63 nt, Artificial Sequence
  derived and/or modified CDS sequence (opt5) from Homo sapiens__AAA61213.1__signal peptide_HsPLAT
auggacgccaugaagagaggccugugcugugugcuccugcuuugcggggcugucuucguuagc

SEQ ID NO: 184 - RNA, 66 nt, Artificial Sequence
  derived and/or modified CDS sequence (opt5) from Homo sapiens__AAA61213.1__signal peptide_HsPLAT
auggacgccaugaagagaggccugugcugugugcuccugcuuugcggggcugucuucguuagcccc

SEQ ID NO: 185 - RNA, 81 nt, Artificial Sequence
  derived and/or modified CDS sequence (opt5) from Homo sapiens__NP_000790.2__signal peptide_HsEPO
augggcgugcacgagugccccgccuggcuguggcuccugcuuagccugcucucccugccucuugggcugccgguccucgga

SEQ ID NO: 186 - RNA, 54 nt, Artificial Sequence
  derived and/or modified CDS sequence (opt5) from Homo sapiens__NP_000468.1__signal peptide_HsALB
augaagugggugaccuucaucagccugcucuuucuguucuccucugccuacagc

SEQ ID NO: 187 - RNA, 72 nt, Artificial Sequence
  derived and/or modified CDS sequence (opt5) from Homo sapiens__NP_055022.2__signal peptide_HsCD5
augcccaugggcagccugcagccucucgccacccuguaccuucuggggaugcucguggcuuccugccuggga

SEQ ID NO: 188 - RNA, 60 nt, Artificial Sequence
  derived and/or modified CDS sequence (opt5) from Homo sapiens__NP_000577.2__signal peptide_HsIL2
auguacagaaugcagcugcucagcugcaucgcccugucccuugcucuggugaccaacucu

SEQ ID NO: 189 - RNA, 54 nt, Artificial Sequence
  derived and/or modified CDS sequence (opt5) from Homo sapiens__NP_001020371.3 __signal peptide_HsCTRB2
auggcuuuccuguggcuccugagcugcugggcccuucugggcaccacauuuggg

SEQ ID NO: 190 - RNA, 57 nt, Artificial Sequence
  derived and/or modified CDS sequence (opt5) from Homo sapiens__BAC87457.1__signal peptide_immunoglobulin (IgG heavy chain)
auggaguucggccugagcuggguguuucucgucgcccuguucagagggguucagugc

SEQ ID NO: 191 - RNA, 57 nt, Artificial Sequence; identical to SEQ ID NO: 135
  derived and/or modified CDS sequence (opt5) from Homo sapiens__AAA52897.1__signal peptide_human immunoglobulin heavy chain

SEQ ID NO: 192 - RNA, 57 nt, Artificial Sequence
  derived and/or modified CDS sequence (opt5) from Homo sapiens__AAA59018.1__signal peptide_human immunoglobulin light chain
auggccuggagcccccuguuccucacccugaucacacacugcgcuggcuccugggcc

SEQ ID NO: 193 - RNA, 51 nt, Artificial Sequence
  derived and/or modified CDS sequence (opt5) from Gaussia princeps__AAG54095.1__signal peptide_GpLuc
augggcgugaagguccuguucgcccucaucugcauugcuguugccgaggcg

SEQ ID NO: 194 - RNA, 63 nt, Artificial Sequence
  derived and/or modified CDS sequence (opt5) from Mus musculus__BAR42292.1__signal peptide_MmIgkappa
auggagaccgacacacugcuccugugggugcuucugcucuggguccccggcagcacgggggau

SEQ ID NO: 195 - RNA, 78 nt, Artificial Sequence
  derived and/or modified CDS sequence (opt5) from Nepenthes rafflesiana__ABF74624.1__signal peptide_NrChit1
augaagacccacuacagcuccgccauccugcccauucucacacuguucguguuucuuucuaucaacccuagccauggc

SEQ ID NO: 196 - RNA, 63 nt, Artificial Sequence; identical to SEQ ID NO: 140
  derived and/or modified CDS sequence (opt5) from Conus leopardus__AAS93426.1__signal peptide_ClLp1.1

SEQ ID NO: 197 - RNA, 72 nt, Artificial Sequence
  derived and/or modified CDS sequence (opt5) from Nepenthes gracilis__AB114914.1__signal peptide_NgNep1
auggccagcucccuguacucuuuccuccuggcucuuagcaucguguauauuuuugucgcccccacccacucc

SEQ ID NO: 198 - RNA, 57 nt, Artificial Sequence
  derived and/or modified CDS sequence (opt5) from Homo sapiens__NP_001691.1__signal peptide_HsAzu1
augaccagacugacagugcucgcccugcuugcuggccugcucgccagcucccgggcg

SEQ ID NO: 199 - RNA, 48 nt, Artificial Sequence
  derived and/or modified CDS sequence (opt5) from Homo sapiens__AAA51948.1__signal peptide_HsCD33
augccccugcuccugcuucugccucuccugugggccggcgcucuugcc

SEQ ID NO: 200 - RNA, 57 nt, Artificial Sequence
  derived and/or modified CDS sequence (opt5) from Vibrio cholerae__BAA06291.1__signal peptide_VcCtxB
augaucaagcugaaauucggcguguuuuucaccguccuccugagcuccgccuacgcu

SEQ ID NO: 201 - RNA, 60 nt, Artificial Sequence
  derived and/or modified CDS sequence (opt5) from Homo sapiens__NP_001890.1__signal peptide_HsCST4
auggccagaccccugugcacccuccugcuucugauggcuacacucgccggcgcgcuggcu

SEQ ID NO: 202 - RNA, 72 nt, Artificial Sequence
  derived and/or modified CDS sequence (opt5) from Homo sapiens__AAA59172.1__signal peptide_HsIns-iso1
auggcccuguggaugagacuccugccccuucuggcucuccuggcccuuuggggcccugacccggcggcugcc

SEQ ID NO: 203 - RNA, 51 nt, Artificial Sequence
  derived and/or modified CDS sequence (opt5) from Homo sapiens__CAA68724.1__signal peptide_HsSPARC
augagagccuggaucuucuuucugcucugccuggcuggccgggcccuugcg

SEQ ID NO: 204 - RNA, 51 nt, Artificial Sequence
  derived and/or modified CDS sequence (opt5) from Inluenza A__ACQ45338.1__signal peptide_H1N1(Netherlands2009)-HA
augaaggccauccuggugguccuccuguacaccuucgcuacagccaacgcg

SEQ ID NO: 205 - RNA, 75 nt, Artificial Sequence
  derived and/or modified CDS sequence (opt5) from Homo sapiens__CAA23783.1__signal peptide_MHCII
auggccaucagcggcgugcccguccugggguucuuuauuaucgcuguucucauguccgcccaggagucuugggcg

SEQ ID NO: 206 - RNA, 54 nt, Artificial Sequence
  derived and/or modified CDS sequence (opt11) from Homo sapiens__AAB59424.1__signal peptide_IgE
auggauuggacguggauacucuuucucguggccgcggccacgcgcgugcacucg

SEQ ID NO: 207 - RNA, 81 nt, Artificial Sequence
  derived and/or modified CDS sequence (opt11) from CCHVF(IbAr10200)__AAA86616.2__signal peptide_SP-GP
augcacaucucccucauguacgccauccucugccuccaacucugcggccucggcgaaacccacggcucccacaacgaaacc

SEQ ID NO: 208 - RNA, 72 nt, Artificial Sequence
  derived and/or modified CDS sequence (opt11) from Homo sapiens__AAA59606.1__signal peptide_HLA-A2-SP
auggccgucauggccccccgcacccucguccuccuccucuccggcgcccucgcccucacccaaaccugggcc

SEQ ID NO: 209 - RNA, 75 nt, Artificial Sequence
  derived and/or modified CDS sequence (opt11) from Homo sapiens__AAA59606.1__signal peptide_HLA-A2-SP
auggcggucauggccccgcgcacgcucgugcucuugcucucgggcgcgcucgcgcucacgcaaacgugggcgggc

SEQ ID NO: 210 - RNA, 69 nt, Artificial Sequence
  derived and/or modified CDS sequence (opt11) from Homo sapiens__AAA61213.1__signal peptide_HsPLAT
auggacgccaugaaacgcggccucugcugcguccuccuccucugcggcgccgucuucgucucccccucc

SEQ ID NO: 211 - RNA, 63 nt, Artificial Sequence
  derived and/or modified CDS sequence (opt11) from Homo sapiens__AAA61213.1__signal peptide_HsPLAT
auggacgcgaugaagcgcgggcucuguugcgugcucuugcucuguggcgcggucuuugucucg

SEQ ID NO: 212 - RNA, 66 nt, Artificial Sequence
  derived and/or modified CDS sequence (opt11) from Homo sapiens__AAA61213.1__signal peptide_HsPLAT
auggaugcgaugaagaggggguuguguuguguguuguuguuguguggggcgguguuugugaguccg

SEQ ID NO: 213 - RNA, 81 nt, Artificial Sequence
  derived and/or modified CDS sequence (opt11) from Homo sapiens__NP_000790.2__signal peptide_HsEPO
augggcgugcacgagugcccggccuggcucuggcucuugcucucgcucuugagcuugcccuugggcuugcccgugcucggg

SEQ ID NO: 214 - RNA, 54 nt, Artificial Sequence
  derived and/or modified CDS sequence (opt11) from Homo sapiens__NP_000468.1__signal peptide_HsALB
augaaaugggucaccuucaucucccuccucuuccucuucuccuccgccuacucc

SEQ ID NO: 215 - RNA, 72 nt, Artificial Sequence
  derived and/or modified CDS sequence (opt11) from Homo sapiens__NP_055022.2__signal peptide_HsCD5
augcccaugggcucccuccaaccccucgccacccucuaccuccucggcaugcucgucgccuccugccucggc

SEQ ID NO: 216 - RNA, 60 nt, Artificial Sequence
  derived and/or modified CDS sequence (opt11) from Homo sapiens__NP_000577.2__signal peptide_HsIL2
auguaccgcaugcaacuccucuccugcaucgcccucucccucgcccucgucaccaacucc

SEQ ID NO: 217 - RNA, 54 nt, Artificial Sequence
  derived and/or modified CDS sequence (opt11) from Homo sapiens__NP_001020371.3 __signal peptide_HsCTRB2
auggccuuccucuggcuccucuccugcugggcccuccucggcaccaccuucggc

SEQ ID NO: 218 - RNA, 57 nt, Artificial Sequence
  derived and/or modified CDS sequence (opt11) from Homo sapiens__BAC87457.1__signal peptide_immunoglobulin (IgG heavy chain)
auggaguucgggcucucguggguguucuuggucgcgcucuuucgcgggguccagugc

SEQ ID NO: 219 - RNA, 57 nt, Artificial Sequence
  derived and/or modified CDS sequence (opt11) from Homo sapiens__AAA52897.1__signal peptide_human immunoglobulin heavy chain
auggacuggaccuggcgcguguucugucucuuggccgugaccccgggcgcgcacccg

SEQ ID NO: 220 - RNA, 57 nt, Artificial Sequence
  derived and/or modified CDS sequence (opt11) from Homo sapiens__AAA59018.1__signal peptide_human immunoglobulin light chain
auggccugguccccacucuuccucacacucaucacccacugcgccggcuccugggcc

SEQ ID NO: 221 - RNA, 51 nt, Artificial Sequence
  derived and/or modified CDS sequence (opt11) from Gaussia princeps__AAG54095.1__signal peptide_GpLuc
augggcgugaaagugcucuuugccuugaucuguaucgcggucgcggaagcg

SEQ ID NO: 222 - RNA, 63 nt, Artificial Sequence
  derived and/or modified CDS sequence (opt11) from Mus musculus__BAR42292.1__signal peptide_MmIgkappa
auggaaaccgacacacuccuacucuggguccuccuccucuggguccccggcuccaccggcgac

SEQ ID NO: 223 - RNA, 78 nt, Artificial Sequence
  derived and/or modified CDS sequence (opt11) from Nepenthes rafflesiana__ABF74624.1__signal peptide_NrChit1
augaaaacccacuacuccuccgccauccuccccauccucacccucuucgucuuccucuccaucaaccccucccacggc

SEQ ID NO: 224 - RNA, 63 nt, Artificial Sequence
  derived and/or modified CDS sequence (opt11) from Conus leopardus__AAS93426.1__signal peptide_ClLp1.1
augggcaugcgcaugauguuuaucauguucaugcucguggucuuggccacgaccguggucucg

SEQ ID NO: 225 - RNA, 72 nt, Artificial Sequence
  derived and/or modified CDS sequence (opt11) from Nepenthes gracilis__AB114914.1__signal peptide_NgNep1
auggccuccucccucuacuccuuccuccucgcccucuccaucgucuacaucuucgucgcccccacccacucc

SEQ ID NO: 226 - RNA, 57 nt, Artificial Sequence
  derived and/or modified CDS sequence (opt11) from Homo sapiens__NP_001691.1__signal peptide_HsAzu1
augacccgccucacaguccucgcccuacucgccggccuccucgccuccucccgcgcc

SEQ ID NO: 227 - RNA, 48 nt, Artificial Sequence
  derived and/or modified CDS sequence (opt11) from Homo sapiens__AAA51948.1__signal peptide_HsCD33
augccccuccuccuccuccucccccuccucugggccggcgcccucgcc

SEQ ID NO: 228 - RNA, 57 nt, Artificial Sequence
  derived and/or modified CDS sequence (opt11) from Vibrio cholerae__BAA06291.1__signal peptide_VcCtxB
augaucaaacucaaauucggcgucuucuucaccguccuccucuccuccgccuacgcc

SEQ ID NO: 229 - RNA, 60 nt, Artificial Sequence
  derived and/or modified CDS sequence (opt11) from Homo sapiens__NP_001890.1__signal peptide_HsCST4
auggcccgcccacucugcacccuacuccuccucauggccacccucgccggcgcccucgcc

SEQ ID NO: 230 - RNA, 72 nt, Artificial Sequence
  derived and/or modified CDS sequence (opt11) from Homo sapiens__AAA59172.1__signal peptide_HsIns-iso1
auggcccucuggaugcgccuacucccccuccucgcccuacucgcccucuggggccccgaccccgccgccgcc

SEQ ID NO: 231 - RNA, 51 nt, Artificial Sequence
  derived and/or modified CDS sequence (opt11) from Homo sapiens__CAA68724.1__signal peptide_HsSPARC
augcgcgcguggauauucuuucucuugugcuuggccgggcgcgcgcucgcg

SEQ ID NO: 232 - RNA, 51 nt, Artificial Sequence
  derived and/or modified CDS sequence (opt11) from Inluenza A__ACQ45338.1__signal peptide_H1N1(Netherlands2009)-HA
augaaagcgaucuuggucgugcucuuguacacguucgcgaccgcgaacgcg

SEQ ID NO: 233 - RNA, 75 nt, Artificial Sequence
  derived and/or modified CDS sequence (opt11) from Homo sapiens__CAA23783.1__signal peptide_MHCII
auggcgaucucgggcgugcccgugcucggguucuuuaucauagccgugcucaugagcgcgcaagagagcugggcc

SEQ ID NO: 234 - protein, 428 aa, Artificial Sequence
  derived and/or modified protein sequence (wt) from ANDV(Chile-9717869)__AF291702.1__N
MSTLQELQENITAHEQQLVTARQKLKDAEKAVEVDPDDVNKSTLQSRRAAVSTLETKLGELKRQLADLVAAQKLATKPVDPTGLEPDDHLKEKSSLRYGNVLDVNSIDLEEPSGQTADWKAIGAYILGFAIPIILKALYMLSTRGRQTVKDNKGTRIRFKDDSSFEEVNGIRKPKHLYVSMPTAQSTMKAEEITPGRFRTIACGLFPAQVKARNIISPVMGVIGFGFFVKDWMDRIEEFLAAECPFLPKPKVASEAFMSTNKMYFLNRQRQVNESKVQDIIDLIDHAETESATLFTEIATPHSVWVFACAPDRCPPTALYVAGVPELGAFFSILQDMRNTIMASKSVGTAEEKLKKKSAFYQSYLRRTQSMGIQLDQKIIILYMLSWGKEAVNHFHLGDDMDPELRQLAQSLIDTKVKEISNQEPLKL

SEQ ID NO: 235 - protein, 428 aa, Artificial Sequence
  derived and/or modified protein sequence (wt) from ANDV(Nort)__AF325966.1__N
MSTLQELQENITAHEQQLVTARQKLKDAEKTVEVDPDEVNKSTLQSRRAAVSTLETKLGELKRQLADLVAAQKLATKPVDPTGLEPDDHLKEKSSLRYGNVLDVNSIDLEEPSGQTADWKAIGAYILGFAIPIILKALYMLSTRGRQTVKDNKGTRIRFKDDSSFEEVNGIRKPKHLYVSMPTAQSTMKAEEITPGRFRTIACGLFPAQVKARNIISPVMGVIGFSFFVKDWMERIEDFLAAECPFLPKPKALSEAFMATNKAYFLNRQRQVNDSKVQDIVDLIDHAEIESATLFTDIATPHSVWVFACAPDRCPPTALYVAGVPELGAFFAILQDMRNTIMASKSVGTAEEKLKKKSAFYQSYLRRTQYMGIQLDQKIIILYMLSWGKEAVNHFHLGDDMDPELRQLAQSLIDTKVKEISNQEPLKL

SEQ ID NO: 236 - protein, 428 aa, Artificial Sequence
  derived and/or modified protein sequence (wt) from ANDV(CHI-7913)__AY228237.1__N
MSTLQELQENITAHEQQLVTARQKLKDAEKAVEVDPDDVNKSTLQNRRAAVSTLETKLGELKRQLADLVAAQKLATKPVDPTGLEPDDHLKEKSSLRYGNVLDVNSIDLEEPSGQTADWKAIGAYILGFAIPIILKALYMLSTRGRQAVKDNKGTRIRFKDDSSFEEVNGIRKPKHLYVSMPTAQSTMKAEEITPGRFRTIACGLFPAQVKARNIISPVMGVIGFGFFVKDWMDRIEEFLAAECPFLPKPKVASEAFMSTNKMYFLNRQRQVNESKVQDIIDLIDHAETESATLFTEIATPHSVWVFACAPDRCPPTALYVAGVPELGAFFSILQDMRNTIMASKSVGTAEEKLKKKSAFYQSYLRRTQSMGIQLDQKIIILYMLSWGKEAVNHFHLGDDMDPELRQLAQSLIDTKVKEISNQEPLKL

SEQ ID NO: 237 - protein, 428 aa, Artificial Sequence
  derived and/or modified protein sequence (wt) from ANDV(9718133)__AF482712.1__N
MSTLQELQENITAHEQQLVTARQKLKDAEKAVEVDPDDVNKSTLQNRRAAVSTLETKLGELKRQLADLVAAQKLATKPVDPTGLEPDDHLKEKSSLRYGNVLDVNSIDLEEPSGQTADWKAIGAYILGFAIPIILKALYMLSTRGRQTVKDNKGTRIRFKDDSSFEEVNGIRKPKHLYVSMPTAQSTMKAEEITPGRFRTIACGLFPAQVKARNIISPVMGVIGFGFFVKDWMDRIEEFLAAECPFLPKPKVASEAFMSTNKMYFLNRQRQVNESKVQDIIDLIDHAETESATLFTEIATPHSVWVFACAPDRCPPTALYVAGVPELGAFFSILQDMRNTIMASKSVGTAEEKLKKKSAFYQSYLRRTQSMGIQLDQKIIILYMLSWGKEAVNHFHLGDDMDPELRQLAQSLIDTKVKEISNQEPLKL

SEQ ID NO: 238 - protein, 425 aa, Artificial Sequence
  derived and/or modified protein sequence (wt) from Araraquara virus(9480)__KP202360.1__N
MSNLQELQENITAHEQQLVTARQKLKDAEKAVDVDPDEVNKSTLQGRRAAVSTLETKLGELKRQLADLVAAQRLASKPVDPTGIEPDDHLKEKSSLRYGNVLDVNSIDLEEPSGQTADWKAIGAYILGFAIPIILKALYMLSTRGRQTVKDNKGTRIRFKDDSSFEEVNGIRKPKHLYISMPTAQSTMKAEEITPGRFRTIACGLFPAQVKARNIISPVMGVIGFAFFVKDWMERIEDFLASECPFLPKPKNPSEAFMATNKAYFLNRQKQVDESQVPDIVDLIDHAEAESATLFKEIASPHSVWVFACAPDRCPPTALYVAGMPELGAFFAILQDMRNTIMASKSVGTAEEKLKKKSAFYQSYLRRTQSMGIQLDQKIIILYMLSWGKEAVNHFHLGDDMDPELRQLAQSLIDTKVKESQTKSL

SEQ ID NO: 239 - protein, 428 aa, Artificial Sequence
  derived and/or modified protein sequence (wt) from Araraquara-like virus(P5/Cajuru)__EF571895.1__N
MSNLQELQENITAHEQQLVTARQKLKDAEKAVDVDPDEVNKSTLQGRRAAVSTLETKLGELKRQLADLVAAQRLASKPVDPTGIEPDDHLKEKSSLRYGNVLDVNPIDLEEPSGQTADWKAIGAYILGFAIPIILKALYMLSTRGRQTVKDNKGTRIRFKDDSSFEEVNGIRKPKHLYISMPTAQSTMKAEEITPGRFRTIACGLFPAQVKARNIISPVMGVIGFGFFVKDWMERIEDFLASECPFLPKPKNPSEAFMATNKAYFLNRQKQVDESQVPDIVDLIDHAEAESATLFKEIASPHSVWVFACAPDRCPPTALYVAGLPELGAFFAILQDMRNTIMASKSVGTAEEKLKKKSAFYQSYLRRTQSMGIQLDQKIIILYMLSWGKEAVNHFHLGDDMDPELRQLAQSLIDTKVKEISNQGPLKL

SEQ ID NO: 240 - protein, 428 aa, Artificial Sequence
  derived and/or modified protein sequence (wt) from BMJV(Oc22531)__AF482713.1__N
MSTLQELQENITAHEQQLVTARQKLKDAEKTVEVDPDEVNKSTLQSRRAAVSTLETKLGELKRQLADLVAAQKLATKPVDPTGLEPDDHLKEKSSLRYGNVLDVNSIDLEEPSGQTADWRSIGAYILGFAIPIILKALYMLSTRGRQTVKDNKGTRIRFKDDSSFEEVNGIRKPKHLYVSMPTAQSTMKAEEITPGRFRTIACGLFPAQVKARNIISPVMGVIGFSFFVKDWMERIEDFLAAECPFLPKPKAPSEAFMATNKAYFLNRQRQVNESKVQDIVDLIDHAETESATLFTDIATPHSVWVFACAPDRCPPTALYVAGVPELGAFFAILQDMRNTIMASKSVGTAEEKLKKKSAFYQSYLRRTQSMGIQLDQKIIILYMLSWGKEAVNHFHLGDDMDPELRQLAQSLIDTKVKEISNQEPLKL

SEQ ID NO: 241 - protein, 428 aa, Artificial Sequence
  derived and/or modified protein sequence (wt) from LECV(22819)__AF482714.1__N
MSTLQELQENITAHEQQLVTARQKLKDAEKTVEVDPDEVNKSTLQSRRAAVSTLETKLGELKRQLADLVAAQKLATKPVDPTGLEPDDHLKEKSSLRYGNVLDVNSIDLEEPSGQTADWRSIGAYILGFAIPIILKALYMLSTRGRQTVKDNKGTRIRFKDDSSFEEVNGIRKPKHLYVSMPTAQSTMKAEEITPGRFRTIACGLFPAQVKARNIISPVMGVIGFSFFVKDWMERIEDFLAAECPFLPKPKAPSEAFMATNKAYFLNRQRQVNESKVQEIVDLIDHAETESATLFTDIATPHSVWVFACAPDRCPPTALYVAGVPELGAFFAILQDMRNTIMASKSVGTAEEKLKKKSAFYQSYLRRTQSMGIQLDQKIIILYMLSWGKEAVNHFHLGDDMDPELRQLAQSLIDTKVKEISNQEPLKL

SEQ ID NO: 242 - protein, 428 aa, Artificial Sequence
  derived and/or modified protein sequence (wt) from MCLV(13796)__AF482716.1__N
MSNLQELQENITAHEQQLVTARQKLKDAEKAVDVDPDEVNKSTLQGRRAAVSTLETKLGELKRQLADLVAAQKLATKPVDPTGIEPDDHLKEKSSLRYGNVLDVNSIDLEEPSGQTADWKAIGAYILGFAIPIILKALYMLSTRGRQTVKDNKGTRIRFKDDSSFEEVNGIRKPKHLYISMPTAQSTMKAEEITPGRFRTIVCGLFPAQVKARNIISPVMGVIGFSFFVKDWMERIEGFLAAECPFLPKPKTAAETFMATNKAYFFNRQRQVDESQVPDIVELIDQAESESATLFTEIASPHSVWVFACAPDRCPPTALYVAGVPELGAFFAILQDMRNTIMASKSVGTAEEKLKKKSAFYQSYLRRTQSMGIQLDQKIIILYMLSWGKEAVNHFHLGDDMDPELRQLAQALIDTKVKEISNQEPLKL

SEQ ID NO: 243 - protein, 428 aa, Artificial Sequence
  derived and/or modified protein sequence (wt) from Neembucu(Neembucu)__DQ345763.1__N
MSTLQELQENITAHEQQLVTARQKLKDAEKTVEVDPDEVNKSTLQSRRAAVSTLETKLGELKRQLADLVAAQKLATRPVDPTGLEPDDHLKEKSSLRYGNVLDVNSIDLEEPSGQTADWRSIGAYILGFAIPIILKALYMLSTRGRQTVKDNKGTRIRFKDDSSFEEVNGIRKPKHLYVSMPTAQSTMKAEEITPGRLRTIACGLFPAQVKARSIISPVMGVIGFSFFVKDWMERIEDFLAAECPFLPKPKAPSEAFMATNKAYFLNRQRQVNESKVQDIVDLIDHAETESATLFTDIATPHSVWVFACAPDRCPPTALYVAGVPELGAFFAILQDMRNTIMASKSVGTAEEKLKKKSAFYQSYLRRTQSMGIQLDQKIIILYMLSWGKEAVNHFHLGDDMDPELRQLAQSLIDTKVKEISNQEPLKL

SEQ ID NO: 244 - protein, 428 aa, Artificial Sequence
  derived and/or modified protein sequence (wt) from ORNV(22996)__AF482715.1__N
MSTLQELQENITAHEQQLVTARQKLKDAEKTVEVDPDEVNKSTLQSRRAAVSTLETKLGELKRQLADLVAAQKLATKPVDPTGLEPDDHLKEKSSLRYGNVLDVNSIDLEEPSGQTADWKAIGAYILGFAIPIILKALYMLSTRGRQTVKDNKGTRIRFKDDSSFEEVNGIRKPKHLYVSMPTAQSTMKAEEITPGRFRTIACGLFPAQVKARNIISPVMGVIGFSFFVKDWMERIEDFLAAECPFLPKPKALSEAFMATNKAYFLNRQRQVNDSKVQDIVDLIDHAEIESATLFTDIATPHSVWVFACAPDRCPPTALYVAGVPELGAFFAILQDMRNTIMASKSVGTAEEKLKKKSAFYQSYLRRTQSMGIQLDQKIIILYMLSWGKEAVNHFHLGDDMDPELRQLAQSLIDTKVKEISNQEPLKL

SEQ ID NO: 245 - protein, 428 aa, Artificial Sequence
  derived and/or modified protein sequence (wt) from PRGV(14403)__AF482717.1__N
MSTLQELQENITAHEQHLVTARQKLKDAEKTVEVDPDEVNKSTLQSRRAAVSTLETKLGELKRQLADLVAAQKLAAKPVDPTGLEPDDHLKEKSSLRYGNVLDVNSIDLEEPSGQTADWKAIGAYILGFAIPIILKALYMLSTRGRQTVKDNKGTRIRFKDDSSFEEVNGIRKPKHLYVSMPTAQSTMKAEEITPGRFRTIACGLFPAQVKARNIISPVMGVIGFSFFVKDWMERIEDFLAAECPFLPKPKTTSEAFMSTNKAYFLNRQRQVDESQVPDIAELIEQAESESATLFTEIASPHSVWVFACAPDRCPPTALYVAGVPELGAFFAILQDMRNTIMASKSVGTAEEKLKKKSAFYQSYLRRTQSMGIQLDQKIIILYMLSWGKEAVNHFHLGDDMDPELRQLAQALIDTKVKEISNQEPLKL

SEQ ID NO: 246 - protein, 428 aa, Artificial Sequence
  derived and/or modified protein sequence (wt) from TUNV(FVB554)__JF750419.1__N
MSNLQELQENITAHEQQLVTARQKLKDAEKAVEMDPDDVNKSTLQSRRAAVSTLETKLGELKRQLADMVAAQKLATKPVDPTGLEPDDHLKEKSSLRYGNVLDVNSIDLEEPSGQTADWKSIGAYILGFAIPIILKALYMLSTRGRQTVKDNKGTRIRFKDDSSFEEVNGIRKPKHLYVSMPTAQSTMKAEEITPGRFRTIACGLFPAQVKARNIISPVMGVIGFSFFVKDWMERIEDFLADECPFLPKPKSPSEAFMATNKAYFLNRQRQVNDSKVQDIVDLIDHAETESATLFTDIATPHSVWVFACAPDRCPPTALYVAGVPELGAFFAILQDMRNTIMASKSVGTAEEKLKKKSAFYQSYLRRTQSMGIQLDQKIIILYMLSWGKEAVNHFHLGDDMDPELRQLAQALIDTKVKEISNQEPLKL

SEQ ID NO: 247 - protein, 428 aa, Artificial Sequence
  derived and/or modified protein sequence (wt) from BCCV(BCCV)__AB689163.1__N
MSNLKEVQDNITTHEQQLVAARQKLKDAERTVGVDPDDVNKSTLQNRRAAVSALEAKIGELKRQLADLVAAQKLATKSVDPTGIEPDDHLKEKSSLRYGNVLDVNSIDLEEPSGQTADWKAIGTYILSFVLPIVLKALYMLSTRGRQTVKENKGTRIRFKDDSSYEDVNGIRKPKHLYVSLPTAQSTMKADEITPGRFRTIVCGLFPAQIKARNIISPVMGVIGFSFFVKDWVDKIEDFLRAECPFLPKPRAQAESFLSTNGAYFMNRQTQVEESKVQDILDLIDTAESGGATLFDNIASPQSAWIFACAPDRCPPTALYVAGVPELGAFFSILQDMRNTIMASKSVGTAEEKLKKKSAFYQSYLRRTQSMGIQLDQKIIILYMINWGKEAVNHFHLGDDMDPELRQLAQALVDTKVKEISNQEPLKI

SEQ ID NO: 248 - protein, 428 aa, Artificial Sequence
  derived and/or modified protein sequence (wt) from BCCV(BCCV)__L39949.1__N
MSNLKEVQDNITTHEQQLVAARQKLKDAERTVEVDPDDVNKSTLQNRRAAVSALEAKIGELKRQLADLVAAQKLATKSVDPTGIEPDDHLKEKSSLRYGNVLDVNSIDLEEPSGQTADWKAIGTYILSFVLPIVLKALYMLSTRGRQTVKENKGTRIRFKDDSSYEDVNGIRKPKHLYVSLPTAQSTMKADEITPGRFRTIVCGLFPAQIKARNIISPVMGVIGFSFFVKDWVDKIEDFLRAECPFLPKPRAQAESFLSTNGAYFMNRQTQVEESKVQDILDLIDTAESGGATLFDNIASPQSAWIFACAPDRCPPTALYVAGVPELGAFFSILQDMRNTIMASKSVGTAEEKLKKKSAFYQSYLRRTQSMGIQLDQKIIILYMINWGKEAVNHFHLGDDMDPELRQLAQALVDTKVKEISNQEPLKI

SEQ ID NO: 249 - protein, 429 aa, Artificial Sequence
  derived and/or modified protein sequence (wt) from DOBV(DOBV/Ano-Poroia/Afl9/1999)__NC_005233.1__N
MATLEELQKEINNHEGQLVIARQKVKDAEKQYEKDPDDLNKRALSDRESIAQSIQGKIDELRRQLADRVAAGKNIGKERDPTGLDPGDHLKEKSMLSYGNVIDLNHLDIDEPTGQTADWLSIVVYLTSFVVPILLKALYMLTTRGRQTTKDNKGMRIRFKDDSSFEDVNGIRKPKHLFLSMPNAQSSMKADEITPGRFRTAICGLYPAQVKARNLISPVMSVIGFLALAKNWTERVEEWLDLPCKLLSEPSPTSLTKGPSTNRDYLNQRQGALAKMETKEAQAVRKHAIDAGCNLIDHIDSPSSIWVFAGAPDRCPPTCLFIAGMAELGAFFAVLQDMRNTIMASKTIGTSEEKLKKKSSFYQSYLRRTQSMGIQLDQRIIVLFMVDWGKEAVDSFHLGDDMDPELRGLAQALIDQKVKEISNQEPLKL

SEQ ID NO: 250 - protein, 429 aa, Artificial Sequence
  derived and/or modified protein sequence (wt) from DOBV(DOB/Saaremaa/160V)__AJ009773.1__N
MATLEELQKEINSHEGQLVIARQKVKDAEKQYEKDPDDLNKRALSDRESIAQSIQGKIDELRRQLADRVAAGKNIGKERDPTGLDPGDHLKEKSMLSYGNVIDLNHLDIDEPTGQTADWLSIVIYLTSFVVPILLKALYMLTTRGRQTTKDNKGMRIRFKDDSSFEDVNGIRKPKHLFLSMPNAQSSMKADEITPGRFRTAVCGLYPAQVKARNLISPVMSVIGFLTLAKNWTERVEEWLDLPCKLLSEPSPTSLTKGPSTNRDYLSQRQGALAKMETKEAQVVRKHAIDAGCNIIDHIDSPSSIWVFAGAPDRCPPTCLFIAGMAELGAFFAVLQDMRNTIMASKTIGTSEEKLRKKSSFYQSYLRRTQSMGIQLDQRIIVLFMIEWGKEAVDSFHLGDDMDPEIRSLAQALIDQKVKEISNQEPLKL

SEQ ID NO: 251 - protein, 429 aa, Artificial Sequence
  derived and/or modified protein sequence (wt) from DOBV(Slovakia/400Af/98)__AY168576.1__N
MATLEELQKEINNHEGQLVIARQKVKDAEKQYEKDPDDLNKRALSDRESIAQSIQGKIDELRRQLADRVAAGKNIGKERDPTGLDPGDHLKEKSMLSYGNVIDLNHLDIDEPTGQTADWLSIVVYLTSFVVPILLKALYMLTTRGRQTTKDNKGMRIRFKDDSSFEDVNGIRKPKHLFLSMPNAQSSMKADEITPGRFRTAICGLYPAQVKARNLISPVMSVIGFLALAKNWTERVEEWLDLPCKLLSEPSPTSLTKGPSTNRDYLNQRQGALAKMETKEAQAVRKHAIDAGCNLIDHIDSPSSIWVFAGAPDRCPPTCLFIAGMAELGAFFAVLQDMRNTIMASKTIGTSEEKLKKKSSFYQSLLRRTQSMGIQLDQRIIVLFMVDWGKEAVDSFHLGDDMDPELRGLAQALIDQKVKEISNQEPLKL

SEQ ID NO: 252 - protein, 429 aa, Artificial Sequence
  derived and/or modified protein sequence (wt) from DOBV(Slovakia-856-Aa)__AJ269549.1__N
MATLEELQKEINSHEGQLVIARQKVKDAEKQYEKDPDDLNKRALSDRESVAQSIQSKIDELRRQLADRVAAGKNIGKERDPTGLDPGDHLKEKSMLSYGNVIDLNHLDIDEPTGQTADWLSIVVYLTSFVVPILLKALYMLTTRGRQTTKDNKGMRIRFKDDSSFEDVNGIRKPKHLFLSMPNAQSSMKADEITPGRFRTAICGLYPAQVKARNLVSPVMSVIGFMALAKNWTERVEEWLDLPCKLLSEPSPTSLTKGPSTNRDYLNQRQGALAKMETKEAQAVRKHAIDAGCNIIDHIDSPSSIWVFAPAPDRCPPTCLFIAGMAELGAFFSVLQDMRNTIMASKTIGTSEEKLRKKSSFYQSYLRRTQSMGIQLDQRIIVLFMVDWGKEAVDSFHLGDDMDPELRGLAQALIDQKVKEISNQEPLKL

SEQ ID NO: 253 - protein, 429 aa, Artificial Sequence
  derived and/or modified protein sequence (wt) from DOBV(Slovakia-862-Aa)__AJ269550.1__N
MATLEELQKEINSHEGQLVIARQKVKDAEKQYEKDPDDLNKRALSDRESVAQSIQSKIDELRRQLADRVAAGKNIGKERDPTGLDPGDHLKEKSMLSYGNVIDLNHLDIDEPTGQTADWLSIVVYLTSFVVPILLKALYMLTTRGRQTTKDNKGMRIRFKDDSSFEDVNGIRKPKHLFLSMPNAQSSMKADEITPGRFRTAICGLYPAQVKARNLVSPVMSVIGFMALAKNWTERVEEWLDLPCKLLSEPSPTSLTKGPSTNRDYLNQRQGALAKMETKEAQAVRKHAIDAGCNIIDHIDSPSSIWVFAGRPDRCPPTCLFIAGMAELGAFFSVLQDMRNTIMASKTIGTSEEKLRKKSSFYQSYLRRTQSMGIQLDQRIIVLFMVDWGKEAVDSFHLGDDMDPELRGLAQALIDQKVKEISNQEPLKL

SEQ ID NO: 254 - protein, 429 aa, Artificial Sequence
  derived and/or modified protein sequence (wt) from DOBV(Esl/29Aa/01)__AY533118.2__N
MATLEELQKEINSHEGQLVIARQKVKDAEKQYEKDPDDLNKRALSDRESVAQSIQSKIDELRRQLADRVAAGKNIGKERDPTGLDPGDHLKEKSMLSYGNVIDLNHLDIDEPTGQTADWLSIVVYLTSFVVPILLKALYMLTTRGRQTTKDNKGMRIRFKDDSSFEDVNGIRKPKHLFLSMPNAQSSMKADEITPGRFRTAICGLYPAQVKARNLVSPVMSVIGFLALAKNWTERVEEWLDLPCKLLSEPSPTSLTKGPSTNRDYLNQRQGALAKMETKEAQAVRKHAIDAGCNIIDHIDSPSSIWVFAGAPDRCPPTCLFIAGMAELGAFFSVLQDMRNTIMASKTIGTSEEKLRKKSSFYQSYLRRTQSMGIQLDQRIIVLFMVDWGKEAVDSFHLGDDMDPELRGLAQALIDQKVKEISNQEPLKL

SEQ ID NO: 255 - protein, 429 aa, Artificial Sequence
  derived and/or modified protein sequence (wt) from DOBV(Kurkino/44Aa/98)__AJ131672.1__N
MATLEELQKEINSHEGQLVIARQKVKDAEKQHEKDPDDLNKRALSDRESVAQSIQSKIDELRRQLADRVAAGKNIGKERDPTGLDPGDHLKEKSMLSYGNVIDLNHLDIDEPTGQTADWLSIVVYLTSFVVPILLKALYMLTTRGRQTTKDNKGMRIRFKDDSSFEDVNGIRKPKHLFLSMPNAQSSMKADEITPGRFRTAICGLYPAQVKARNLVSPVMSVIGFLALAKNWTERVEEWLDLPCKLLSEPSPTSLTKGPSTNRDYLNQRQAALAKMETKEAQAVRKHAIDAGCTIIDYIDSPSSIWVFAGAPDRCPPTCLFIAGMAELGAFFSVLQDMRNTIMASKTVGTSEEKLRKKSSFYQSYLRRTQSMGIQLDQRIIVLFMVDWGKEAVDSFHLGDDMDPELRGLAQALIDQKVKEISNREPLKL

SEQ ID NO: 256 - protein, 429 aa, Artificial Sequence
  derived and/or modified protein sequence (wt) from DOBV(Kurkino/53Aa/98)__AJ131673.1__N
MATLEELQKEINSHEGQLVIARQKVKDAEKQYEKDPDDLNKRALSDRESVAQSIQSKIDELRRQLADRVAAGKNIGKERDPTGLDPGDHLKEKSMLSYGNVIDLNHLDIDEPTGQTADWLSIVVYLTSFVVPILLKALYMLTTRGRQTTKDNKGMRIRFKDDSSFEDVNGIRKPKHLFLSMPNAQSSMKADEITPGRFRTAICGLYPAQVKARNLVSPVMSVIGFLALAKNWTERVEEWLDLPCKLLSEPSPTSLTKGPSTNRDYLNQRQAALAKMETKEAQAVRKHAIDAGCTIIDHIDSPSSIWVFAGAPDRCPPTCLFIAGMAELGAFFSVLQDMRNTIMASKTVGTSEEKLRKKSSFYQSYLRRTQSMGIQLDQRIIVLFMVDWGKEAVDSFHLGDDMDPELRGLAQALIDQKVKEISNREPLKL

SEQ ID NO: 257 - protein, 429 aa, Artificial Sequence
  derived and/or modified protein sequence (wt) from DOBV(Saar/90Aa/97)__AJ009775.1__N
MATLEELQKEINSHEGQLVIARQKVKDAEKQYEKDPDDLNKRALSDRESIAQSIQGKIDELRRQLADRVAAGKNIGRERDPTGLDPGDHLKEKSMLSYGNVIDLNHLDIDEPTGQTADWLSIVIYLTSFVVPILLKALYMLTTRGRQTTKDNKGMRIRFKDDSSFEDVNGIRKPKHLFLSMPNAQSSMKADEITPGRFRTAVCGLYPAQVKARNLISPVMSVIGFLTLAKNWTERVEEWLDLPCKLLSEPSPTSLTKGPSTNRDYLSQRQGALAKMETKEAQAVRKHAIDAGCNIIDHIDSPSSIWVFAGAPDRCPPTCLFIAGMAELGAFFAVLQDMRNTIMASKTIGTSEEKLRKKSSFYQSYLRRTQSMGIQLDQRIIVLFMIEWGKEAVDSFHLGDDMDPEIRSLAQALIDQKVKEISNQEPLKL

SEQ ID NO: 258 - protein, 429 aa, Artificial Sequence
  derived and/or modified protein sequence (wt) from DOBV(SK/Aa)__AY961615.1__N
MATLEELQKEINSHEGQLVIARQKVKDAEKQYEKDPDDLNKRTLSDRESVAQSIQSKIDELRRQLADRVAAGKNIGKERDPTGLDPGDHLKEKSMLSYGNVIDLNHLDIDEPTGQTADWLSIVVYLTSFVVPILLKALYMLTTRGRQTTKDNKGMRIRFKDDSSFEDVNGIRKPKHLFLSMPNAQSSMKADEITPGRFRTAICGLYPAQVKARNLVSPVMSVIGFLALAKNWTERVEEWLDLPCKLLSEPSPTSLTKGPSTNRDYLNQRQGALAKMETKEAQAVRKHAIDAGCNIIDHIDSPSSIWVFAGAPDRCPPTCLFIAGMAELGAFFSVLQDMRNTIMASKTIGTSEEKLRKKSSFYQSYLRRTQSMGIQLDQRIIVLFMVDWGKEAVDSFHLGDDMDPELRGLAQALIDQKVKEISNQEPLKL

SEQ ID NO: 259 - protein, 429 aa, Artificial Sequence
  derived and/or modified protein sequence (wt) from DOBV(A35)__GU904030.1__N
MATLEELQKEINNHEGQLVIARQKVKDAEKQYEKDPDDLNKRALSDRESIAQSIQGKIDELRRQLADRVAAGKNIGKERDPTGLDPGDHLKEKSMLSYGNVIDLNHLDIDEPTGQTADWLSIVIYLTSFVVPILLKALYMLTTRGRQTTKDNKGMRIRFKDDSSFEDVNGIRKPKHLFLSMPNAQSSMKADEITPGRFRTAICGLYPAQVKARNLISPVMSVIGFVALAKNWTERVEEWLDLPCKLLSEPSPTSLTKGPSTNRDYLNQRQGALAKMETKEAQAVRKHAIDAGCNLIDHIDSPSSIWVFAGAPDRCPPTCLFIAGMAELGAFFAVLQDMRNTIMASKTIGTSEEKLKKKSSFYQSYLRRTQSMGIQLDQRIIVLFMVDWGKEAVDSFHLGDDMDPELRGLAQALIDQKVKEISNQEPLKL

SEQ ID NO: 260 - protein, 429 aa, Artificial Sequence
  derived and/or modified protein sequence (wt) from DOBV(3970/87)__L41916.1__N
MATLEELQKEINNHEGQLVIARQKVKDAEKQYEKDPDDLNKRALSDRESIAQSIQGKIDELRRQLADRVAAGKNIGKERDPTGLDPGDHLKEKSMLSYGNVIDLNHLDIDEPTGQTADWLSIVIYLTSFVVPILLKALYMLTTRGRQTTKDNKGMRIRFKDDSSFEDVNGIRKPKHLFLSMPNAQSSMKADEITPGRFRTAICGLYPAQVKARNLISPVMSVIGFVALAKNWTERVEEWLDLPCKLLSEPSPTSLTKGPSTNRDYLNQRQGALAKMETKEAQAVRKHAIDAGCNLIDHIDSPSSIWVFAGAPDRCPPTCLFIAGMAELGAFFACLQDMRNTIMASKTIGTSEEKLKKKSSFYQSYLRRTQSMGIQLDQRIIVLFMVDWGKEAVDSFHLGDDMDPELRGLAQALIDQKVKEISNQEPLKL

SEQ ID NO: 261 - protein, 429 aa, Artificial Sequence
  derived and/or modified protein sequence (wt) from DOBV(Klyuch-2000)__AF442622.1__N
MATLEELQKEINSHEGQLVIARRKVKDAEKQYEKDPDDLNKRALSDRESVAQSIQGKIDELRRQLADRVAAGKNIGKERDPTGLDPGDHLKEKSMLSYGNVIDLNHLDIDEPTGQTADWLSIVVYLTSFVVPILLKALYMLTTRGRQTTKDNKGMRIRFKDDSSFEDVNGIRKPKHLFLSMPNAQSSMKADEITPGRFRTAVCGLYPAQVKARNLVSPVMSVIGFVSLAKNWTERVEEWLDLPCKLLSEPSPTSLTKGPSTNRDYLNQRQGALAKMETKEAQAVRKHAINAGCNLVDHIDSPSSIWVFAGAPDRCPPTCLFVAGMAELGAFFAVLQDMRNTIMASKTIGTSEEKLRKKSSFYQSYLRRTQSMGIQLDQRIIVLFMVDWGKEAVDSFHLGDDMDPELRGLAQALIEQKVKEISNQEPLKL

SEQ ID NO: 262 - protein, 429 aa, Artificial Sequence
  derived and/or modified protein sequence (wt) from DOBV(10636/Ap)__KP878311.1__N
MATLEELQKEINNHEGQLVIARQKVKDAEKQYEKDPDDLNKRALSDRESVAQSIQGKIDELRRQLADRVAAGKNIGKERDPTGLDPGDHLKEKSMLSYGNVIDLNHLDIDEPTGQTADWLSIVVYLTSFVVPILLKALYMLTTRGRQTTKDNKGMRIRFKDDSSFEDVNGIRKPKHLFLSMPNAQSSMKADEITPGRFRTAVCGLYPAQVKARNLVSPVMSVIGFVSLAKNWTERVEEWLDLPCKLLSEPSPTSLTKGPSTNRDYLNQRQGALAKMETKEAQAVRKHAIDAGCNLVDHIDSPSSIWVFAGAPDRCPPTCLFVAGMAELGAFFAVLQDMRNTIMASKTIGTSEEKLRKKSSFYQSYLRRTQSMGIQLDQRIIVLFMVDWGKEAVDSFHLGDDMDPELRSLAQALIDQKVKEISNQEPLKL

SEQ ID NO: 263 - protein, 429 aa, Artificial Sequence
  derived and/or modified protein sequence (wt) from DOBV(10645/Ap)__KP878312.1__N
MATLEELQKEINNHEGQLVIARQKVKDAEKQYEKDPDDLNKRALSDRESVAQSIQGKIDELRRQLADRVAAGKNIGKERDPTGLDPGDHLKEKSMLSYGNVIDLNHLDIDEPTGQTADWLSIVVYLTSFVVPILLKALYMLTTRGRQTTKDNKGMRIRFKDDSSFEDVNGIRKPKHLFLSMPNAQSSMKADEITPGRFRTAVCGLYPAQVKARNLVSPVMSVIGFVSLAKNWTERVEEWLDLPCKLLSEPSPTSLTKGPSTNRDYLNQRQGALAKMETKEAQAVRKHAIDAGCNLVDHIDSPSSIWVFAGAPDRCPPTCLFVAGMAELGAFFAVLQDMRNTIMASKTIGTSEEKLRKKSSFYQSYLRRTQSMGIQLDQRIIVLFMVDWGKEAVDSFHLGDDMDPELRGLAQALIDQKVKEISNQEPLKL

SEQ ID NO: 264 - protein, 429 aa, Artificial Sequence
  derived and/or modified protein sequence (wt) from DOBV(Aa1854/Lipetsk-02)__EU188452.1__N
MATLEELQKEINSHEGQLVIARQKVKDAEKQYEKDPDDLNKRALSDRESVAQSIQSKIDELRRQLADRVAAGKNIGKERDPTGLDPGDHLKEKSMLSYGNVIDLNHLDIDEPTGQTADWLSIVVYLTSFVVPILLKALYMLTTRGRQTTKDNKGMRIRFKDDSSFEDVNGIRKPKHLFLSMPNAQSSMKADEITPGRFRTAICGLYPAQVKARNLVSPVMSVIGFLALAKNWTERVEEWLDLPCKLLSEPSPTSLTKGPSTNRDYLNQRQAALAKMETKEAQAVRKHAIDAGCTIIDHIDSPSSIWVFAGAPDRCPPTCLFIAGMAELGAFFSVLQDMRNTIMASKPVGTSEEKLRKKSSFYQSYLRRTQSMGIQLDQRIIVLFMVDWGKEAVDSFHLGDDMDPELRGLAQALIDQKVKEISNQEPLKL

SEQ ID NO: 265 - protein, 429 aa, Artificial Sequence
  derived and/or modified protein sequence (wt) from DOBV(Ap/Sochi/43)__JF920151.1__N
MATLEELQKEINNHEGQLVIARQKVKDAEKQYEKDPDDLNKRALSDRESVAQSIQGKIDELRRQLADRVAAGKNIGKERDPTGLDPGDHLKEKSMLSYGNVIDLNHLDIDEPTGQTADWLSIVVYLTSFVVPILLKALYMLTTRGRQTTKDNKGMRIRFKDDSSFEDVNGIRKPKHLFLSMPNAQSSMKADEITPGRFRTAVCGLYPAQVKARNLVSPVMSVIGFVSLAKNWTERVEEWLDLPCKLLSEPSPTSLTKGPSTNRDYLNQRQGALAKMETKEAQAVRKHAIDAGCNLVDHIDSPSSIWVFAGAPDRCPPTCLFVAGMAELGAFFAVLQDMRNTIMASKTIGTSEEKLRKKSSFYQSYLRRTHSMGIQLDQRIIVLFMVDWGKEAVDSFHLGDDMDPELRGLAQALIDQKVKEISNQEPLKL

SEQ ID NO: 266 - protein, 429 aa, Artificial Sequence
  derived and/or modified protein sequence (wt) from DOBV(Ap/Sochi/hu)__JF920150.1__N
MATLEELQKEINNHEGQLVIARQKVKDAEKQYEKDPDDLNKRALSDRESVAQSIQGKIDELRRQLADRVAAGKNIGKERDPTGLDPGDHLKEKSMLSYGNVIDLNHLDIDEPTGQTADWLSIVVYLTSFVVPILLKALYMLTTRGRQTTKDNKGMRIRFKDDSSFEDVNGIRKPKHLFLSMPNAQSSMKADEITPGRFRTAVCGLYPAQVKARNLVSPVMSVIGFLSLAKNWTERVEEWLDLPCKLLSEPSPTSLTKGPSTNRDYLNQRQGALAKMETKEAQAVRKHAIDAGCNLVDHIDSPSSIWVFAGAPDRCPPTCLFVAGMAELGAFFAVLQDMRNTIMASKTIGTSEEKLRKKSSFYQSYLRRTHSMGIQLDQRIIVLFMVDWGKEAVDSFHLGDDMDPELRGLAQALIDQKVKEISNQEPLKL

SEQ ID NO: 267 - protein, 429 aa, Artificial Sequence
  derived and/or modified protein sequence (wt) from DOBV(Ap1584/Sochi-01)__EU188449.1__N
MATLEELKKEINNHEGQLVIARQKVKDAEKQYEKDPDDLNKRALSDRESVAQSIQGKIDELRRQLADRVAAGKNIGKERDPTGLDPGDHLKEKSMLSYGNVIDLNHLDIDEPTGQTADWLSIVVYLTSFVVPILLKALYMLTTRGRQTTKDNKGMRIRFKDDSSFEDVNGIRKPKHLFLSMPNAQSSMKADEITPGRFRTAVCGLYPAQVKARNLVSPVMSVIGFVSLAKNWTERVEEWLDLPCKLLSEPSPTSLTKGPSTNRDYLNQRQGALAKMETKEAQAVRKHAIDAGCNLVDHIDSPSSIWVFAGAPDRCPPTCLFVAGMAELGAFFAVLQDMRNTIMASKTIGTSEEKLRKKSSFYQSYLRRTQSMGIQLDQRIIVLFMVDWGKEAVDSFHLGDDMDPELRGLAQALIDQKVKEISNQEPLKL

SEQ ID NO: 268 - protein, 429 aa, Artificial Sequence
  derived and/or modified protein sequence (wt) from DOBV(DOB/Gola/235Af/07)__KC848495.1__N
MATLEELQKEINNHEGQLVIARQKVKDAEKQYEKDPDDLNKRALSDRESIAQSIQGKIDELRRQLADRVAAGKNIGKERDPTGLDPGDHLKEKSMLSYGNVIDLNHLDIDEPTGQTADWLSIVVYLTSFVVPILLKALYMLTTRGRQTTKDNKGMRIRFKDDSSFEDVNGIRKPKHLFLSMPNAQSSRKADEITPGRFRTAICGLYPAQVKARNLISPVMSVIGFLALAKNWTERVEEWLDLPCKLLSEPSPTSLTKGPSTNRDYLNQRQGALAKMETKEAQAVRKHAIDAGCNLIDHIDSPSSIWVFAGAPDRCPPTCLFIAGMAELGAFFAVLQDMRNTIMASKTIGTSEEKLKKKSSFYQSYLRRTQSMGIQLDQRIIVLFMVDWGKEAVDSFHLGDDMDPELRGLAQALIDQKVKEISNQEPLKL

SEQ ID NO: 269 - protein, 429 aa, Artificial Sequence
  derived and/or modified protein sequence (wt) from DOBV(DOB/Gola/343Af/07)__KC848498.1__N
MATLEELQKEINNHEGQLVIARQKVKDAEKQYEKDPDDLNKRALSDRESIAQSIQGKIDELRRQLADRVAAGKNIGKERDPTGLDPGDHLKEKSMLSYGNVIDLNHLDIDEPTGQTADWLSIVVYLTSFVVPILLKALYMLTTRGRQTTKDNKGMRIRFKDDSSFEDVNGIRKPKHLFLSMPNAQSSMKADEITPGRFRTAICGLYPAQVKARNLISPVMSVIGFLALAKNWTERVEEWLDLPCKLLSEPSPTSLTKGPSTNRDYLNQRQGALAKMETKEAQAVRKHATDAGCNLIDHIDSPSSIWVFAGAPDRCPPTCLFIAGMAELGAFFAVLQDMRNTIMASKTIGTSEEKLKKKSSFYQSYLRRTQSMGIQLDQRIIVLFMVDWGKEAVDSFHLGDDMDPELRGLAQALIDQKVKEISNQEPLKL

SEQ ID NO: 270 - protein, 429 aa, Artificial Sequence
  derived and/or modified protein sequence (wt) from DOBV(DOB/Pecs/27Aa/06)__KC848499.1__N
MATLEELQKEINSHEGQLVIARQKVKDAEKQYEKDPDDLNKRALSDRESVAQSIQSKIDELRRQLADRVAAGKNIGKERDPTGLDPGDHLKEKSMLSYGNVIDLNHLDIDEPTGQTADWLSIVVYLTSFVVPILLKALYMLTTRGRQTTKDNKGMRVRFKDDSSFEDVNGIRKPKHLFLSMPNAQSSMKADEITPGRFRTAVCGLYPAQVKARNLVSPVMSVIGFLALAKNWTERVEEWLDLPCKLLSEPSPTSLTKGPSTNRDYLNQRQGALAKMETKEAQAVRKHAIDAGCNIIDHIDSPSSIWVFAGAPDRCPPTCLFIAGMAELGAFFSVLQDMRNTIMASKTIGTSEEKLRKKSSFYQSYLRRTQSMGIQLDQRIIVLFMVDWGKEAVDSFHLGDDMDPELRGLAQALIDQKVKEISNQEPLKL

SEQ ID NO: 271 - protein, 429 aa, Artificial Sequence
  derived and/or modified protein sequence (wt) from DOBV(DOB/Pecs/31Aa/06)__KC848500.1__N
MATLEELQKEINSHEGQLVIARQKVKDAEKQYEKDPDDLNKRALSDRESVAQSIQSKIDELRRQLADRVAAGKNIGKERDPTGLDPGDHLKEKSMLSYGNVIDLNHLDIDEPTGQTADWLSIVVYLTSFVVPILLKALYMLTTRGRQTTKDNKGMRIRFKDDSSFEDVNGIRKPKHLFLSMPNAQSSMKADEITPGRFRTAVCGLYPAQVKARNLVSPVMSVIGFLALAKNWTERVEEWLDLPCKLLSEPSPTSLTKGPSTNRDYLNQRQGALAKMETKEAQAVRKHAIDAGCNIIDHIDSPSSIWVFAGAPDRCPPTCLFIAGMAQLGAFFSVLQDMRNTIMASKTIGTSEEKLRKKSSFYQSYLRRTQSMGIQLDQRIIVLFMVDWGKEAVDSFHLGDDMDPELRGLAQALIDQKMKEISNQEPLKL

SEQ ID NO: 272 - protein, 429 aa, Artificial Sequence
  derived and/or modified protein sequence (wt) from DOBV(DOB/Sarmellek/77Aa/06)__KC848501.1__N
MATLEELQKEINSHEGQLVIARQKVKDAEKQYEKDPDDLNKRALSDRESVAQSIQSKIDELRRQLADRVASGKNIGKERDPTGLDPGDHLTEKSMLSYGNVIDLNHLDIDEPTGQTADWLSIVVYLTSFVVPILLKALYMLTTRGRQTTKDNKGMRIRFKDDSSFEDVNGIRKPKHLFLSMPNAQSSMKADEITPGRFRTAICGLYPAQVKARNLVSPVMSVIGFLALAKNWTERVEEWLDLPCKLLSEPSPTSLTKGPSTNRDYLNQRQGALAKMETKEAQAVRKHAIDAGCNIIDHIDSPSSIWVFAGAPDRCPPTCLFIAGMAELGAFFSVLQDMRNTIMASKTVGTSEEKLRKKSSFYQSYLRRTQSMGIQLDQRIIVLFMVDWGKEAVDSFHLGDDMDPELRSLAQALIDQKVKEISNQEPLKL

SEQ ID NO: 273 - protein, 429 aa, Artificial Sequence
  derived and/or modified protein sequence (wt) from DOBV(GER/05/239/Aa)__GQ205405.1__N
MATLEELQKEINSHEGQLVIARQKVKDAEKQYEKDPDDLNKRALSDRESVAQSIQGKIDELRRQLADRVAAGKNIGKERDPTGLDPGDHLKEKSMLSYGNVIDLNHLDIDEPTGQTADWLSIVVYLTSFVVPILLKALYMLTTRGRQTTKDNKGMRIRFKDDSSFEDVNGIRKPKHLFLSMPNAQSSMKADEITPGRFRTAICGLYPAQVKARNLVSPVMSVIGFLALAKNWTERVEEWLDLPCKLLSEPSPTSLTKGPSTNRDYLSQRQGALAKMETKEAQAVRKHAIDAGCNIIDHIDSPSSIWVFAGAPDRCPPTCLFIAGMAELGAFFAVLQDMRNTIMASKTIGTSEEKLRKKSSFYQSYLRRTQSMGIQLDQRIIVLFMVDWGKEAVDSFHLGDDMDPELRSLAQALIDQKVKEISNQEPLKL

SEQ ID NO: 274 - protein, 429 aa, Artificial Sequence
  derived and/or modified protein sequence (wt) from DOBV(GER/05/477/Af)__GQ205406.1__N
MATLEELQKEINSHEGQLVIARQKVKDAEKQYEKDPDDLNKRALSDRESVAQSIQGKIDELRRQLADRVAAGKNIGKERDPTGLDPGDHLKEKSMLSYGNVIDLNHLDIDEPTGQTADWLSIVVYLTSFVVPILLKALYMLTTRGRQTTKDNKGMRIRFKDDSSFEDVNGIRKPKHLFLSMPNAQSSMKADEITPGRFRTAICGLYPAQVKARNLVSPVMSVIGFLALAKNWTERVEEWLDLPCKLISEPSPTSLTKGPSTNRDYLSQRQGALAKMETKEAQAVRKHAIDAGCNIIDHIDSPSSIWVFAGAPDRCPPTCLFIAGMAELGAFFAVLQDMRNTIMASKTIGTSEEKLRKKSSFYQSYLRRTQSMGIQLDQRIIVLFMVDWGKEAVDSFHLGDDMDPELRSLAQALIDQKVKEISNQEPLKL

SEQ ID NO: 275 - protein, 429 aa, Artificial Sequence
  derived and/or modified protein sequence (wt) from DOBV(GER/07/293/Aa)__GQ205401.1__N
MATLEELQKEINSHEGQLVIARQKVKDAEKQYEKDPDDLNKRALSDRESVAQSIQGKIDELRRQLADRVAAGKNIGKERDPTGLDPGDHLKEKSMLSYGNVIDLNHLDIDEPTGQTADWLSIVVYLTSFVVPILLKALYMLTTRGRQTTKDNKGMRIRFKDDSSFEDVNGIRKPKHLFLSMPNAQSSMKADEITPGRFRTAICGLYPAQVKARNLVSPVMSVIGFLALAKNWTERVEDWLDLPCKLLSEPSPTSLTKGPSTNRDYLNQRQGALAKMETKEAQAVRKHAIDAGCNIIDHIDSPSSIWVFAGAPDRCPPTCLFIAGMAELGAFFAVLQDMRNTIMASKTIGTSEEKLRKKSSFYQSYLRRTQSMGIQLDQRIIVLLMVDWGKEAVDSFHLGDDMDPELRGLAQALIDQKVKEISNQEPLKL

SEQ ID NO: 276 - protein, 429 aa, Artificial Sequence
  derived and/or modified protein sequence (wt) from DOBV(GER/07/424/Aa)__GQ205403.1__N
MATLEELQKEINSHEGQLVIARQKVKDAEKQYEKDPDDLNKRALSDRESVAQSIQGKIDELRRQLADRVAAGKNIGKERDPTGLDPGDHLKEKSMLSYGNVIDLNHLDIDEPTGQTADWLSIVVYLTSFVVPILLKALYMLTTRGRQTTKDNKGMRIRFKDDSSFEDVNGIRKPKHLFLSMPNAQSSMKADEITPGRFRTAICGLYPAQVKARNLVSPVMSVIGFLALAKNWTERVEDWLDLPCKLLSEPSPTSLTKGPSTNRDYLNQRQGALAKMETKEAQAVRKHAIDAGCNIIDHIDSPSSIWVFAGAPDRCPPTCLFIAGMAELGAFFAVLQDMRNTIMASKTIGTSEEKLRKKSSFYQSYLRRTQSMGIQLDQRIIVLFMVDWGKEAVDSFHLGDDMDPELRGLAQALIDQKVKEISNQEPLKL

SEQ ID NO: 277 - protein, 429 aa, Artificial Sequence
  derived and/or modified protein sequence (wt) from DOBV(GER/08/118/Aa)__GQ205407.1__N
MATLEELQKEINSHEGQLVIARQKVKDAEKQYEKDPDDLNKRALSDRESVAQSIQGKIDELRRQLADRVAAGKNIGKERDPTGLDPGDHLKEKSMLSYGNVIDLNHLDIDEPTGQTADWLSIVVYLTSFVVPILLKALYMLTTRGRQTTKDNKGMRIRFKDDSSFEDVNGIRKPKHLFLSMPNAQSSMKADEITPGRFRTAICGLYPAQVKARNLVSPVMSVIGFLALAKNWTERVEDWLDLPCKLLSEPSPTSLTKGPSTNRDYLNQRQGALAKMETKEAQAVRKHAIDAGCNIIDHIDSPSSIWVFAGAPDRCPPTCLFIAGMAELGAFFAVLQDMRNTIMASKTVGTSEEKMRKKSSFYQSYLRRTQSMGIQLDQRIIVLFMVDWGKEAVDSFHLGDDMDPELRGLAQALIDQKVKEISNQEPLKL

SEQ ID NO: 278 - protein, 429 aa, Artificial Sequence
  derived and/or modified protein sequence (wt) from DOBV(GER/08/131/Af)__GQ205408.1__N
MATLEELQKEINSHEGQLVIARQKVKDAEKQYEKDPDDLNKRALSDRESVAQSIQGKIDELRRQLADRVAAGKNIGKERDPTGLDPGDHLKEKSMLSYGNVIDLNHLDIDEPTGQTADWLSIVVYLTSFVVPILLKALYMLTTRGRQTTKDNKGMRIRFKDDSSFEDVNGIRKPKHLFLSMPNAQSSMKADEITPGRFRTAVCGLYPAQVKARNLVSPVMSVIGFLALAKNWTERVEDWLDLPCKLLSEPSPTSLTKGPSTNRDYLNQRQGALAKMETKEAQAVRKHAIDAGCNIIDHIDSPSSIWVFAGAPDRCPPTCLFIAGMAELGAFFAVLQDMRNTIMASKTIGTSEEKLRKKSSFYQSYLRRTQSMGIQLDQRIIVLFMVDWGKEAVDSFHLGDDMDPELRGLAQALIDQKVKEISNQEPLKL

SEQ ID NO: 279 - protein, 429 aa, Artificial Sequence
  derived and/or modified protein sequence (wt) from HTNV(76-118/POR)__KT885049.1__N
MATMEELQREINAHEGQLVIARQKVRDAEKQYEKDPDELNKRALTNREGVAVSIQAKIDELKMQLADRIATGKNLGKEQDPTGVEPGDHLKERSMLSYGNVLDLNHLDIDEPTGQTADWLSIIVYLTSFVVPILLKALYMLTTRGRQTTKDNKGTRIRFKDDSSFEDVNGIRKPKHLYVSLPNAQSSMKAEEITPGRYRTAVCGLYPAQIKARQMISPVMSVIGFLALAKDWSDRIEQWLIEPCKLLPDTAAVSLLGGPATNRDYLRQRQVALGNMETKESKAIRQHAEAAGCSMIEDIESPSSIWVFAGAPDRCPPTCLFIAGIAELGAFFSILQDMRNTIMASKTVGTSEEKLRKKSSFYQSYLRRTQSMGIQLDQRIIVLFMVAWGKEAVDNFHLGDDMDPELRTLAQSLIDVKVKEISNQEPLKL

SEQ ID NO: 280 - protein, 429 aa, Artificial Sequence
  derived and/or modified protein sequence (wt) from HTNV(A16)__AF288646.1__N
MATMEELQREINAHEGQLVIARQKVRDAEKQYEKDPDELNKRALTDREGLAASIQAKIDELKRQLADRIATGKNLGKEQDPTGVEPGDHLKERSMLSYGNVLDLNHLDIDEPTGQTADWLSIVIYLTSFVVPILLKALYMLTTRGRQTTKDNKGTRIRFKDDSSFEDVNGIRKPKHLYVSLPNAQSSMKAEEITPGRYRTAICGLYPAQIKARQMISPVMSVIGFLALAKDWSDRIEQWLSEPCKLLPDTAAVSLHGGPATNRDYLRQRQVALGNMETKESKAIRQHAESAGCSMVEDIESPSSIWVFAGAPNRCPPTCLFIAGIAELGAFFSILQDMRNTIMASKTVGTSEEKLRKKSSFYQSYLRRTQSMGIQLDQRIIVLFMVAWGKEAVDNFHLGDDMDPVLRTLAQSLIDVKVKEISNQEPLKL

SEQ ID NO: 281 - protein, 429 aa, Artificial Sequence
  derived and/or modified protein sequence (wt) from HTNV(CA09082007)__HQ834499.1__N
MATMEELQREINAHEGQLVIARQKVRDAEKQYEKDPDELNKRALTDREGVAASIQAKIDELKRQLADRIATGKNLGKEQDPTGVEPGDHLKERSMLSYGNVLDLNHLDIDEPTGQTADWLSIVIYLTSFVVPILLKALYMLTTRGRQTTKDNKGTRIRFKDDSSFEDVNGIRKPKHLYVSLPNAQSSMKAEEITPGRYRTAICGLYPAQIKARQMISPVMSVIGFLALAKDWSDRIEQWLSEPCKLLPDTAAVSLHGGPATNRDYLRQRQVALGNMETKESKAIRQHAESAGCSMVEDIESPSSIWVFAGAPDRCPPTCLFIAGIAELGAFFSILQDMRNTIMASKTVGTSEEKLRKKSSFYQSYIRRTQSMGIQLDQRIIVLFMVAWGKEAVDNFHLGDDMDPELRTLAQSLIDLKVKEISNQEPLKL

SEQ ID NO: 282 - protein, 429 aa, Artificial Sequence
  derived and/or modified protein sequence (wt) from HTNV(CA10081109)__HQ834500.1__N
MPTSGELQREINAHEGQLVIARQKVRDAEKQYEKDPDELNKRALTDREGVAASIQAKIDELKRQLADRIATGKNLGKEQDPTGVEPGDHLKERSMLSYGNVLDLNHLDIDEPTGQTADWLSIVIYLTSFVVPILLKALYMLTTRGRQTTKDNKGTRIRFKDDSSFEDVNGIRKPKHLYVSLPNAQSSMKAEEITPGRYRTAICELYPAQIKASKMISPVMSVIGFLALAKDWSDRIEQWLSEPCKLLPDTAAVSLHGGPATNRDYLRQRQVALGNMETKESKAIRQHAESAGCSMVEDIESPSSIWVFAGAPDRCPPTCLFIAGIAELGAFFSILQDMRNTIMASKTVGTSEEKLRKKSSFYQSYLRRTQSMGIQLDQRIIVLFMVAWGKEAVDNPHAGDDVDPSLGMLAQSLIDVKVKEISNQEPLKL

SEQ ID NO: 283 - protein, 429 aa, Artificial Sequence
  derived and/or modified protein sequence (wt) from HTNV(CA10081113)__HQ834501.1__N
MATSGELQREINAHEGQLVIARQKVRDAEKQYEKDPDELNKRALTDREGVAASIQAKIDELKRQLADRIATGKNLGKEQDPTGVEPGDHLKERSMLSYGNVLDLNHLDIDEPTGQTADWLSIVIYLTSFVVPILLKALYMLTTRGRQTTKDNKGTRIRFKDDSSFEDVNGIRKPKHLYVSLPNAQSSMKAEEITPGRYRTAIFELYPAQIKARQMISPVMSVIGFLALAKDWSDRIEQWLSEPCKLLPDTAAVSLHGGPATNRDYLRQRQVALGNMETKESKAIRQHAESAGCSMVEDIESPSSIWVFAGAPDRCPPTCLFIAGIAELGAFFSILQDMRNTIMASKTVGTSEEKLRKKSSFYQSYLRRTQSMGIQLDQRIIVLFMVAWGKEAVDNRHLMNIVDPEPRALAQSLIDVKVKEISNQEPLKL

SEQ ID NO: 284 - protein, 429 aa, Artificial Sequence
  derived and/or modified protein sequence (wt) from HTNV(CA10081203)__HQ834502.1__N
MATNGELQREINAHEGQLVIARQKVRDAEKQYEKDPDELNKRALTDREGVAASIQAKIDELKRQLADRIATGKNLGKEQDPTGVEPGDHLKERSMLSYGNVLDLNHLDIDEPTGQTADWLSIVIYLTSFVVPILLKALYMLTTRGRQTTKDNKGTRIRFKDDSSFEDVNGIRKPKHLYVSLPNAQSSMKAEEITPGRYRTAIFGLYPAQIKARQMISPVMSVIGFLALAKDWSDRIEQWLSEPCKLLPDTAAVSLHGGPATNRDYLRQRQVALGNMETKESKAIRQHAESAGCSMVEDIESPSSIWVFAGAPDRCPPTCLFIAGIAELGAFFSILQDMRNTIMASKTVGTSEEKLRKKSSFYQSYLRRTQSMGIQLDQRIIVLFMVAWGKEAVDELHSGDGEHHASRTLAQSLIDVKVKEISNQEPLKL

SEQ ID NO: 285 - protein, 429 aa, Artificial Sequence
  derived and/or modified protein sequence (wt) from HTNV(CA10081206)__HQ834503.1__N
MATIEELQREINAHEGQLVIARQKVRDAEKQYEKDPDELNKRALTDREGVAASIQAKIDELKRQLADRIATGKNLGKEQDPTGVEPGDHLKERSMLSYGNVLDLNHLDIDEPTGQTADWLSIVIYLTSFVVPILLKALYMLTTRGRQTTKDNKGTRIRFKDDSSFEDVNGIRKPKHLYVSLPNAQSSMKAEEITPGRYRTAICGLYPAQIKARQMISPVMSVIGFLALAKDWSDRIEQWLSEPCKLLPDTAAVSLHGGPATNRDYLRQRQVALGNMETKESKAIRQHAESAGCSMVEDIESPSSIWVFAGAPDRCPPTCLFIAGIAELGAFFSILQDMRNTIMASKTVGTSEEKLRKKSSFYQSYLRRTQSMGIQLDQRIIVLFMVAWGKEAVDNFHAWDGMDPELRTLAQSLIDVKVKEISNQEPLKL

SEQ ID NO: 286 - protein, 429 aa, Artificial Sequence
  derived and/or modified protein sequence (wt) from HTNV(CA10081708)__HQ834504.1__N
MPTSGELQREINAHEGQLVIARQKVRDAEKQYEKDPDELNKRALTDREGVAASIQAKIDELKRQLADRIATGKNLGKEQDPTGVEPGDHLKERSMLSYGNVLDLNHLDIDEPTGQTADWLSIVIYLTSFVVPILLKALYMLTTRGRQTTKDNKGTRIRFKDDSSFEDVNGIRKPKHLYVSLPNAQSSMKAEEITPGRYRTAIFELYPAQIKARKMISPVMSVIGFLALAKDWSDRIEQWLSEPCKLLPDTAAVSLHGGPATNRDYLRQRQVALGNMETKESKAIRQHAESAGCSMVEDIESPSSIWVFAGAPDRCPPTCLFIAGIAELGAFFSILQDMRNTIMASKTVGTSEEKLRKKSSFYQSYLRRTQSMGIQLDQRIIVLFMVAWGKEAVDNPHTGDDADPELRTLAQSLIDVKVKEISNQEPLKL

SEQ ID NO: 287 - protein, 429 aa, Artificial Sequence
  derived and/or modified protein sequence (wt) from HTNV(CA10081905)__HQ834505.1__N
MATSGELQREINAHEGQLVIARQKVRDAEKQYEKDPDELNKRALTDREGVAASIQAKIDELKRQLADRIATGKNLGKEQDPTGVEPGDHLKERSMLSYGNVLDLNHLDIDEPTGQTADWLSIVIYLTSFVVPILLKALYMLTTRGRQTTKDNKGTRIRFKDDSSFEDVNGIRKPKHLYVSLPNAQSSMKAEEITPGRYRTAIFELYPAQIKARKMISPVMSVIGFLALAKDWSDRIEQWLSEPCKLLPDTAAVSLHGGPATNRDYLRQRQVALGNMETKESKAIRQHAESAGCSMVEDIESPSSIWVFAGAPDRCPPTCLFIAGIAELGAFFSILQDMRNTIMASKTVGTSEEKLRKKSSFYQSYLRRTQSMGIQLDQRIIVLFMVAWGKEAVDNHHLINAGDHELRTLAQSLIDVKVKEISNQEPLKL

SEQ ID NO: 288 - protein, 429 aa, Artificial Sequence
  derived and/or modified protein sequence (wt) from HTNV(E142)__AF288644.1__N
MATMEELQREINAHEGQLVIARQKVRDAEKRYEKDPDELNKRTLTDREGVAASIQAKIDELKRQLADRIATGKNLGKEQDPTGVEPGDHLKERSMLSYGNVLDLNHLDIDEPTGQTADWLSIVIYLTSFVVPILLKALYMLTTRGRQTTKDNKGTRIRFKDDSSSEDVNGIRKPKHLYVSLPNAQSSMKAEEITPGRYRTAICGLYPAQIKARQMISPVMSVIGFLALAKDWSDRIEQWLSEPCKLLPDTAAVSLHGGPATNRDYLRQRQVALGNMETKESKAIRQHAESAGCSMIEDIESPSSIWVFAGAPDRCPPTCLFIAGIAELGAFFSILQDMRNTIMASKTVGTSEEKLRKKSSFYQSYLRRTQSMGIQLDQRIIVLFMVAWGKEVVDNFHLGDDMDPELRTLAQSLIDVKVKEISNQEPLKL

SEQ ID NO: 289 - protein, 429 aa, Artificial Sequence
  derived and/or modified protein sequence (wt) from HTNV(H10150)__HQ834506.1__N
MATMGELQREINAHEGQLVIARQKVRDAEKQYEKDPDELNKRALTDREGVAASIQAKIDELKRQLADRIATGKNLGKEQDPTGVEPGDHLKERSMLSYGNVLDLNHLDIDEPTGQTADWLSIVIYLTSFVVPILLKALYMLTTRGRQTTKDNKGTRIRFKDDSSFEDVNGIRKPKHLYVSLPNAQSSMKAEEITPGRYRTAIFGLYPAQIKARQMISPVMSVIGFLALAKDWSDRIEQWLSEPCKLLPDTAAVSLHGGPATNRDYLRQRQVALGNMETKESKAIRQHAESAGCSMVEDIESPSSIWVFAGAPDRCPPTCLFIAGIAELGAFFSILQDMRNTIMASKTVGTSEEKLRKKSSFYQSYLRRTQSMGIQLDQRIIVLFMVAWGKEAVDNHHWANAIGSELRTLAQSLIDVKVKEISNQEPLKL

SEQ ID NO: 290 - protein, 429 aa, Artificial Sequence
  derived and/or modified protein sequence (wt) from HTNV(Aa03-161)__KT935024.1__N
MATMEELQREINAHEGQLVIARQKVRDAEKQYEKDPDELNKRALTDREGVAVSIQAKIDELKRQLADRIATGKNLGKEQDPTGVEPGDHLKERSMLSYGNVLDLNHLDIDEPTGQTADWLSIVVYLTSFVVPILLKALYMLTTRGRQTTKDNKGTRIRFKDDSSFEDVNGIRKPKHLYVSLPNAQSSMKAEEITPGRYRTAVCGLYPAQIKARQMISPVMSVIGFLALAKDWSDRIEQWLSEPCKLLPDAAAVSLLGGPATNRDYLRQRQVALGNMETKESKAIRQHAEAAGCSMIEDIESPSSIWVFAGAPDRCPPTCLFIAGIAELGAFFSILQDMRNTIMASKTVGTSEEKLRKKSSFYQSYLRRTQSMGIQLDQRIIVLFMVAWGKEAVDNFHLGDDMDPELRTLAQSLIDVKVKEISNQEPLKL

SEQ ID NO: 291 - protein, 429 aa, Artificial Sequence
  derived and/or modified protein sequence (wt) from HTNV(Aa04-722)__KU207190.1__N
MATMEELQREINAHEGQLVIARQKVRDAERQYEKDPDELNKRALTDREGVAVSIQAKIDELKRQLADRIATGKNLGKEQDPTGVEPGDHLKERSMLSYGNVLDLNHLDIDEPTGQTADWLSIVVYLTSFVVPILLKALYMLTTRGRQTTKDNKGTRIRFKDDSSFEDVNGIRKPKHLYVSLPNAQSSMKAEEITPGRYRTAVCGLYPAQIKARQMISPVMSVIGFLALAKDWSDRIEQWLSEPCKLLPDTAAVSLLGGPATNRDYLRQRQVALGNMETKESKAIRQHAEAAGCSMIEDIESPSSIWVFAGAPDRCPPTCLFIAGIAELGAFFSILQDMRNTIMASKTVGTSEEKLRKKSSFYQSYLRRTQSMGIQLDQRIIVLFMVAWGKEAVDNFHLGDDMDPELRTLAQSLIDVKVKEISNQEPLKL

SEQ ID NO: 292 - protein, 429 aa, Artificial Sequence
  derived and/or modified protein sequence (wt) from HTNV(Aa05-190)__KT935027.1__N
MATMEELQREINAHEGQLVIARQKVRDAEKQYEKDPDELNKRALTDREGVAVSIQAKIDELKRQLADRIATGKNLGKEQDPTGVEPGDHLKERSMLSYGNVLDLNHLDIDEPTGQTADWLSIVVYLTSFVVPILLKALYMLTTRGRQTTKDNKGTRIRFKDDSSFEDVNGIRKPKHLYVSLPNAQSSMKAEEITPGRYRTAVCGLYPAQIKARQMISPVMSVIGFLALAKDWSDRIEQWLSEPCKLLPDTAAVSLLGGPATNRDYLRQRQVALGNMETKESKAIRQHAEAAGCSMIEDIESPSSIWVFAGAPDRCPPTCLFIAGIAELGAFFSILQDMRNTIMASKTVGTSEEKLRKKSSFYQSYLRRTQSMGIQLDQRIIVLFMVAWGKEAVDNFHLGDDMDPELRTLAQSLIDVKVKEISNQEPLKL

SEQ ID NO: 293 - protein, 429 aa, Artificial Sequence
  derived and/or modified protein sequence (wt) from HTNV(Aa10-123)__KT935036.1__N
MATMEELQREINAHEGQLVIARQKVRDAEKQYEKDPDELNKRALTDREGVAVSIQAKIDELKRQLADRIATGKNLGKEQDPTGVEPGDHLKERSMLSYGNVLDLNHLDIDEPTGQTADWLSIVVYLTSFVVPILLKALYMLTTRGRQTTKDNKGTRIRFKDDSSFEDVNGIRKPKHLYVSLPNAQSSMKAEEITPGRYRTAVCGLYPAQIKARQMISPVMSVIGFLALAKDWSDRIEQWLSEPCKLLPDTTAVSLLGGPATNRDYLRQRQVALGNMETKESKAIRQHAEAAGCSMIEDIESPSSIWVFAGAPDRCPPTCLFVAGIAELGAFFSILQDMRNTIMASKTVGTSEEKLRKKSSFYQSYLRRTQSMGIQLDQRIIVLFMVAWGKEAVDNFHLGDDMDPELRTLAQSLIDVKVKEISNQEPLKL

SEQ ID NO: 294 - protein, 429 aa, Artificial Sequence
  derived and/or modified protein sequence (wt) from HTNV(Aa10-265)__KU207194.1__N
MATMEELQREINAHEGQLVIARQKVRDAEKQYEKDPDELNKRALTDREGVAVSIQAKIDELKRQLADRIATGKNLGKEQDPTGVEPGDHLKERSMLSYGNVLDLNHLDIDEPTGQTADWLSIVVYLTSFVVPILLKALYMLTTRGRQTTKDNKGTRIRFKDDSSFEDVNGIRKPKHLYVSLPNAQSSMKAEEITPGRYRTAVCGLYPAQIKARQMISPVMSVIGFLALAKDWSDRIEQWLSEPCKLLPDTAAVSLLGGPATNRDYLRQRQVALGNMETKESKAIRQHAEAAGCSMIEDIESPSSIWVFAGAPDRCPPTCLFVAGIAELGAFFSILQDMRNTIMASKTVGTSEEKLRKKSSFYQSYLRRTQSMGIQLDQRIIVLFMVAWGKEAVDNFHLGDDMDPELRTLAQSLIDVKVKEISNQEPLKL

SEQ ID NO: 295 - protein, 429 aa, Artificial Sequence
  derived and/or modified protein sequence (wt) from HTNV(AA1028)__AF427318.1__N
MATMEELQREINAHEGQLVIARQKVRDAEKQYEKDPDELNKRALTDREGVAVSIQAKIDELKRQLADRIATGKNLGKEQDPTGVEPGDHLKERSMLSYGNVLDLNHLDIDEPTGQTADWLSIVVYLTSFVVPILLKALYMLTTRGRQTTKDNKGTRIRFKDDSSFEDVNGIRKPKHLYVSLPNAQSSMKAEEITPGRYRTAICGLYPAQIKARQMISPVMSVIGFLALAKDWSDRIEQWLSEPCKLLPDTAAVSLLGGPATNRDYLRQRQVALGNMETKESKAIRQHAEAAGCSMIEDIESPSSIWVFAGAPDRCPPTCLFIAGIAELGAFFSILQDMRNTIMASKTVGTSEEKLRKKSSFYQSYLRRTQSMGIQLDQRIIVLFMVAWGKEAVDNFHLGDDMDPELRTLAQSLIDVKVKEISNQEPLKL

SEQ ID NO: 296 - protein, 429 aa, Artificial Sequence
  derived and/or modified protein sequence (wt) from HTNV(Aa10-434)__KT935038.1__N
MATMEELQREINAHEGQLVIARQKVRDAEKQYGKDPDELNKRALTDREGVAVSIQAKIDELKRQLADRIATGKNLGKEQDPTGVEPGDHLKERSMLSYGNVLDLNHLDIDEPTGQTADWLSIVVYLTSFVVPILLKALYMLTTRGRQTTKDNKGTRIRFKDDSSFEDVNGIRKPKHLYVSLPNAQSSMKAEEITPGRYRTAVCGLYPAQIKARQMISPVMSVIGFLALAKDWSDRIEQWLSEPCKLLPDTAAVSLLGGPATNRDYLRQRQVALGNMETKESKAIRQHAEAAGCSMIEDIESPSSIWVFAGAPDRCPPTCLFIAGIAELGAFFSILQDMRNTIMASKTVGTSEEKLRKKSSFYQSYLRRTQSMGIQLDQRIIVLFMVAWGKEAVDNFHLGDDMDPELRTLAQSLIDVKVKEISNQEPLKL

SEQ ID NO: 297 - protein, 429 aa, Artificial Sequence
  derived and/or modified protein sequence (wt) from HTNV(Aa14-362)__KT935049.1__N
MATMEELQREINAHEGQLVIARQKVRDAEKQYEKDPDELNKRALTDREGVAVSIQAKIDELKRQLADRIATGKNLGKEQDPTGVEPGDHLKERSMLSYGNVLDLNHLDIDEPTGQTADWLSIVVYLTSFVVPILLKALYMLTTRGRQTTKDNKGTRIRFKDDSSFEDVNGIRKPKHLYVSLPNAQSSMKAEEITPGRYRTAVCGLYPAQIKARQMISPVMSVIGFLALAKDWSDRVEQWLSEPCKLLPDTAAVSLLGGPATNRDYLRQRQVALGNMETKESKAIRQHAEAAGCSMIEDIESPSSIWVFAGAPDRCPPTCLFIAGIAELGAFFSILQDMRNTIMASKTVGTSEEKLRKKSSFYQSYLRRTQSMGIQLDQRIIVLFMVAWGKEAVDNFHLGDDMDPELRTLAQSLIDVKVKEISNQEPLKL

SEQ ID NO: 298 - protein, 429 aa, Artificial Sequence
  derived and/or modified protein sequence (wt) from HTNV(Aa14-404)__KT935052.1__N
MATMEELQREINAHEGQLVIARQKVRDAEKQYEKDPDELNKRALTDREGVAVSIQAKIDELKRQLADRIATGKNLGKEQDPTGVEPGDHLKERSMLSYGNVLDLNHLDIDEPTGQTADWLSIVVYLTSFVVPILLKALYMLTTRGRQTTKDNKGTRIRFKDDSSFEDVNGIRKPKHLYVSLPNAQSSMKAEEITPGRYRTAVCGLYPAQIKARQMISPVMSVIGFLALAKDWSDRIEQWLSEPCKLLPDTAAVSLLGGPATNRDYLRQRQVALGNMETKESKAIRQHAEAAGCSMIEDIESPSSIWVFAGAPDRCPPTCLFIAGIAELGAFFSILQDMRNTIMASKTVGTSEEKLRKKSSFYQSYLRRTQSMGIQLDQRIIVLFMVAWGKEAVDNFHLGDDMDPELRTLAQSLIDVKVKEISSQEPLKL

SEQ ID NO: 299 - protein, 429 aa, Artificial Sequence
  derived and/or modified protein sequence (wt) from HTNV(Aa15-56)__KU207195.1__N
MATMEELQREINAHEGQLVIARQKVRDAEKQYEKDPDELNKRALTDREGVAVSIQAKIDELKRQLADRIATGKNLGKEQDPTGVEPGDHLKERSMLSYGNVLDLNHLDIDEPTGQTADWLSIVVYLTSFVVPILLKALYMLTTRGRQTTKDNKGTRIRFKDDSSFEDVNGIRKPKHLYVSLPNAQSSMKAEEITPGRYRTAVCGLYPAQIKARQMISPVMSVIGFLALAKDWSDRIEQWLNEPCKLLPDTAAVSLLGGPATNRDYLRQRQVALGNMETKESKAIRQHAEAAGCSMIEDIESPSSIWVFAGAPDRCPPTCLFIAGIAELGAFFSILQDMRNTIMASKTVGTSEEKLRKKSSFYQSYLRRTQSMGIQLDQRIIVLFMVAWGKEAVDNFHLGDDMDPELRTLAQSLIDVKVKEISNQEPLKL

SEQ ID NO: 300 - protein, 429 aa, Artificial Sequence
  derived and/or modified protein sequence (wt) from HTNV(AA1719)__AF427319.1__N
MATMEELQREINAHEGQLVIARQKVRDAEKQYEKDPDELNKRALTDREGVAVSIQAKIDELKRQLADRIATGKNLGKEQDPTGVEPGDHLKERSMLSYGNVLDLNHLDIDEPTGQTADWLSIVVYLTSFVVPILLKALYMLTTRGRQTTKDNKGTRIRFKDDSSFEDVNGIRKPKHLYVSLPNAQSSMKAEEITPGRYRTAICGLYPAQIKARQMISPVMSVIGFLALAKDWSDRIEQWLSEPCKLLPDTAAVSLLGGPATNRDYLRQRQVALGNMETKESKAIRQHAEAAGCSIIEDIESPSSIWVFAGAPDRCPPTCLFIAGIAELGAFFSILQDMRNTIMASKTVGTSEEKLRKKSSFYQSYLRRTQSMGIQLDQRIIVLFMVAWGKEAVDNFHLGDDMDPELRTLAQSLIDVKVKEISNQEPLKL

SEQ ID NO: 301 - protein, 429 aa, Artificial Sequence
  derived and/or modified protein sequence (wt) from HTNV(AP1168)__AF427323.1__N
MATMEELQKEINAHEGQLVIARQKVRDAERQYEKDPDELNKRALTDREGVAASIQAKIDELKRQLADRIATGKNLGKEQDPTGVEPGDHLKERSMLSYGNVLDLNHLDIDEPTGQTADWLSIVVYLTSFVVPILLKALYMLTTRGRQTTKDNKGTRIRFKDDSSFEDVNGIRKPKHLYVSLPNAQSSMKAEEITPGRYRTAICGLYPAQIKARQMVSPVMSVIGFLALAKDWGDRIEQWLSEPCKLLPDTAAVSLHGGPATNRDYLRQRQAALGNMETKESKAIRQHAETAGCSMIEDIESPSSIWVFAGAPDRCPPTCLFIAGIAELGAFFSILQDMRNTIMASKTVGTSEEKLRKKSSFYQSYLRRTQSMGIQLDQRIIVLFMVAWGKEAVDNFHLGDDMDPELRTLAQSLIDLKVKEISNQEPLKL

SEQ ID NO: 302 - protein, 429 aa, Artificial Sequence
  derived and/or modified protein sequence (wt) from HTNV(AP708)__AF427322.1__N
MATMEELQKEINAHEGQLVIARQKVRDAERQYEKDPDELNKRALTDREGVAASIQAKIDELKRQLADRIATGKNLGKEQDPTGVEPGDHLKERSMLSYGNVLDLNHLDIDEPTGQTADWLSIVVYLTSFVVPILLKALYMLTTRGRQTTKDNKGTRIRFKDDSSFEDVNGIRKPKHLYVSLPNAQSSMKAEEITPGRYRTAICGLYPAQIKARQMVSPVMSVIGFLALAKDWGDRIEQWLSEPCKLLPDTAAVSLHGGPATNRDYLRQRQAALGNMETKESKAIRQHAETAGCSMIEDIESPSSVWVFAGAPDRCPPTCLFIAGIAELGAFFSILQDMRNTIMASKTVGTSEEKLRKKSSFYQSYLRRTQSMGIQLDQRIIVLFMVAWGKEAVDNFHLGDDMDPELRTLAQSLIDLKVKEISNQEPLKL

SEQ ID NO: 303 - protein, 429 aa, Artificial Sequence
  derived and/or modified protein sequence (wt) from HTNV(DandongHu-32)__KC570386.1__N
MATMEELQREINAHEGQLVIARQKVRDAEKQYEKDPDELNKRALTDREGVAVSIQAKIDELKRQLADRIATGKNLGKEQDPTGVEPGDHLKERSMLSYGNVLDLNHLDIDEPTGQTADWLSIVVYLTSFVVPILLKALYMLTTRGRQTTKDNKGTRIRFKDDSSFEDVNGIRKPKHLYVSLPNAQSSMKAEEITPGRYRTAICGLYPAQIKARQMISPVMSVIGFLALAKDWSDRIEQWLSEPCKLLPDTAAVSLLGGPATNRDYLRQRQVALGNMETKESKAIRQHAEAAGCSMIEDIESPSSIWVFAGAPDRCPPTCLFIAGIAELGAFFSILQDMRNTIMASKTVGTSEEKLRKKSSFYQSYLRRTQSMGIQLDQRIIVLFMVAWGKEAVDNFHLGDDMDPELRILAQSLIDVKVKEISNQEPLKL

SEQ ID NO: 304 - protein, 429 aa, Artificial Sequence
  derived and/or modified protein sequence (wt) from HTNV(DandongHu-34)__KC570387.1__N
MATMEELQREINAHEGQLVIARQKVRDAEKQYEKDPDELNKRALTDREGVAVSIQAKIDELKRQLADRIATGKNLGKEQDPTGVEPGDHLKERSMLSYGNVLDLNHLDIDEPTGQTADWLSIVVYLTSFVVPILLKALYMLTTRGRQTTKDNKGTRIRFKDDSSFEDVNGIRKPKHLYVSLPNAQSSMKAEEITPGRYRTAICGLYPAQIKARQMISPVMSVIGFLALAKDWSDRIEQWLSEPCKLLPDTAAVSLLGGPATNRDYLRQRQVALGNMETKESKAIRQHAEAAGCSMIEDIESPSSIWVFAGAPDRCPPTCLFIAGMAELGAFFSILQDMRNTIMASKTVGTSEEKLRKKSSFYQSYLRRTQSMGIQLDQRIIVLFMVAWGKEAVDNFHLGDDMDPELRTLAQSLIDVKVKEISNQEPLKL

SEQ ID NO: 305 - protein, 429 aa, Artificial Sequence
  derived and/or modified protein sequence (wt) from HTNV(DandongHu-89)__KC570389.1__N
MATMEELQREINAHEGQLVIARQKVRDAEKQYEKDPDELNKRALTDREGVAVSIQAKIDELKRQLADRIATGKNLGKEQDPTGVEPGDHLKERSMLSYGNVLDLNHLDIDEPTGQTADWLSIVVYLTSFVVPILLKALYMLTTRGRQTTKDNKGTRIRFKDDSSFEDVNGIRKPKHLCVSLPNAQSSMKAEEITPGRYRTAICGLYPAQIKARQMISPVMSVIGFLALAKDWSDRIEQWLSEPCKLLPDTAAVSLLGGPATNRDYLRQRQVALGNMETKESKAIRQHAEAAGCSMIEDIESPSSIWVFAGAPDRCPPTCLFIAGIAELGAFFSILQDMRNTIMASKTVGTSEEKLRKKSSFYQSYLRRTQSMGIQLDQRIIVLFMVAWGKEAVDNFHLGDDMDPELRTLAQSLIDVKVKEISNQEPLKL

SEQ ID NO: 306 - protein, 429 aa, Artificial Sequence
  derived and/or modified protein sequence (wt) from HTNV(DandongHu-91)__KC570390.1__N
MATMEELQREINAHEGQLVIARQKVRDAEKQYEKDPDELNKRALTDREGVAVSIQAKIDELKRQLADRIATGKNLGKEQDPTGVEPGDHLKERSMLSYGNVLDLNHLDIDEPTGQTADWLGIVIYLTSFVVPILLKALYMLTTRGRQTTKDNKGTRIRFKDDSSFEDVNGIRKPKHLYVSLPNAQSSMKAEEITPGRYRTAICGLYPAQIKARQMISPVMSVIGFLALAKDWSDRIEQWLSEPCKLLPDTAAVSLLGGPATNRDYLRQRQVALGNMETKESKAIRQHAEAAGCSMIEDIESPSSIWVFAGAPDRCPPTCLFIAGMAELGAFFSILQDMRNTIMASKTVGTSEEKLRKKSSFYQSYLRRTQSMGIQLDQRIIVLFMVAWGKEAVDNFHLGDDMDPELRTLAQSLIDVKVKEISNQEPLKL

SEQ ID NO: 307 - protein, 429 aa, Artificial Sequence
  derived and/or modified protein sequence (wt) from HTNV(Fuyuan-Aa-145)__KJ857349.1__N
MATMEELQREINAHEGQLVIARQKVRDAEKQYEKDPDELNKRALTDREGVAVSIQAKIDELKRQLADRIATGKNLGKEQDPTGVEPGDHLKERSMLSYGNVLDLNHLDIDEPTGQTADWLSIVVYLTSFVVPILLKALYMLTTRGRQTTKDNKGTRIRFKDDSSFEDVNGIRKPKHLYVSLPNAQSSMKAEEITPGRYRTAICGLHPAQIKARQMISPVMSVIGFLALAKDWSDRIEQWLSEPCKLLPDTAAVSLLGGPATNRDYLRQRQVALGNMETKESKAIRQHAEAAGCSMIEDIESPSSIWVFAGAPDRCPPTCLFIAGIAELGAFFSILQDMRNTIMASKTVGTSEEKLRKKSSFYQSYLRRTQSMGIQLDQRIIVLFMVAWGKEAVDNFHLGDDMDPELRTLAQSLIDVKVKEISNQEPLKL

SEQ ID NO: 308 - protein, 429 aa, Artificial Sequence
  derived and/or modified protein sequence (wt) from HTNV(Fuyuan-Aa-26)__KJ857347.1__N
MATMEELQREINAHEGQLVIARQKVRDAEKQYEKDPDELNKRALTDREGVAVSIQAKIDELKRQLADRIATGKNLGKEQDPTGVEPGDHLKERSMLSYGNVLDLNHLDIDEPTGQTADWLSIVVYLTSFAVPILLKALYMLTTRGRQTTKDNKGTRIRFKDDSSLEDVNGIRKPKHLYVSLPNAQSSMKAEEITPGRYRTAICGLYPAQIKARQMISPVMSVIGFLALAKDWSDRIEQWLSEPCKLLPDTAAVSLLGGPATNRDYLRQRQVALGNMETKESKAIRQHAEAAGCSMIEDIESPSSIWVFAGAPDRCPPTCPFIAGIAELGAFFSILQDMRNTIMASKTVGTSEEKLRKKSSFYQSYLRRTQSMGIQLDQRIIVLFMVAWGKEAVDNFHLGDDMDPELRTLAQSLIDVKVKEISNQEPLKL

SEQ ID NO: 309 - protein, 429 aa, Artificial Sequence
  derived and/or modified protein sequence (wt) from HTNV(JS1)__KP970572.1__N
MATMEELQREINAHEGQLVIARQKVRDAEKQYENDPDELNKRALTNREGVAVSIQAKIDELKRQLADRIATGKNLGKEQDPTGVEPGDHLKERSMLSYGNVLDLNHLDIDEPTGQTADWLSIIVYLTSFVVPILLKALYMLTTRGRQTTKDNKGTRIRFKDDSSFEDVNGIRKPKHLYVSLPNAQSSMKAEEITPGRYRTAVCGLYPAQIKARQMISPVMSVIGFLALAKDWSDRIEQWLIEPCKLLPDTAAVSLLGGPATNRDYLRQRQVALGNMETKESKAIRQHAEAAGCSMIEDIESPSSIWVFAGAPDRCPPTCLFIAGIAELGAFFSILQDMRNTIMASKTVGTSEEKLRKKSSFYQSYLRRTQSMGIQLDQRIIVLFMVAWGKEAVDNFHLGDDMDPELRTLAQSLIDVKVKEISNQEPLKL

SEQ ID NO: 310 - protein, 429 aa, Artificial Sequence
  derived and/or modified protein sequence (wt) from HTNV(LongquanAa-08-150)__JQ912697.1__N
MATMEELQREIDAHEGQLVIARQKVRDAEKQYEKDPDELNKRALTDREGVAASIQAKIDELKRQLADRIATGKNLGKEQDPTGVEPGDHLKERSMLSYGNVLDLNHLDIDEPTGQTADWLSIVVYLTSFVVPILLKALYMLTTRGRQTTKDNKGTRIRFKDDSSFEDVNGIRKPKHLYVSLPNAQSSMKAEEITPGRYRTAICGLYPAQIKARQMISPVMSVIGFLALAKDWADRIEQWLSEPCKLLPDTAAVSLHGGPATNRDYLRQRQVALGNMETKESKAIRQHAETAGCSMIEDIESPSSIWVFAGAPDRCPPTCLFIAGIAELGAFFSILQDMRNTIMASKTVGTSEEKLRKKSSFYQSYLRRTQSMGIQLDQRIIVLFMVAWGKEAVDNFHLGDDMDPELRTLAQSLIDVKVKEISNQEPLKL

SEQ ID NO: 311 - protein, 429 aa, Artificial Sequence
  derived and/or modified protein sequence (wt) from HTNV(LongquanAa-08-157)__JQ912698.1__N
MATMEELQREINAHEGQLVIARQKVRDAEKQYEKDPDELNKRALTDREGVAASIQAKIDELKRQLADRIATGKNLGKEQDPTGVEPGDHLKERSMLSYGNVLDLNHLDIDEPTGQTADWLSIVVYLTSFVVPILLKALYMLTTRGRQTTKDNKGTRIRFKDDSSFEDVNGIRKPKHLYVSLPNAQSSMKAEEITPGRYRTAICGLYPAQIKARQMISPVMSVIGFLALAKDWADRIEQWLSEPCKLLPDTAAVSLHGGPATNRDYLRQRQVALGNMETKESKAIRQHAETAGCSMIEDIESPSSIWVFAGAPDRCPPTCLFIAGIAELGAFFSILQDMRNTIMASKTVGTSEEKLRKKSSFYQSYLRRTQSMGIQLDQRIIVLFMVAWGKEAVDNFHLGDDMDPELRTLAQSLIDVKVKEISNQEPLKL

SEQ ID NO: 312 - protein, 429 aa, Artificial Sequence
  derived and/or modified protein sequence (wt) from HTNV(LongquanAa-08-314)__JQ912709.1__N
MATMEELQREINAHEGQLVIARQKVRDAEKQYEKDPDELNKRALTDREGVAASMQAKIDELKRQLADRIATGKNLGKEQDPTGVEPGDHLKERSMLSYGNVLDLNHLDIDEPTGQTADWLSIVVYLTSFVVPILLKALYMLTTRGRQTTKDNKGTRIRFKDDSSFEDVNGIRKPKHLYVSLPNAQSSMKAEEITPGRYRTAICGLYPAQIKARQMISPVMSVIGFLALAKDWADRIEQWLSEPCKLLPDTAAVSLHGGPATNRDYLRQRQVALGNMETKESKAIRQHAETAGCSMIEDIESPSSIWVFAGAPDRCPPTCLFIAGIAELGAFFSILQDMRNTIMASKTVGTSEEKLRKKSSFYQSYLRRTQSMGIQLDQRIIVLFMVAWGKEAVDNFHLGDDMDPELRTLAQSLIDVKVKEISNQEPLKL

SEQ ID NO: 313 - protein, 429 aa, Artificial Sequence
  derived and/or modified protein sequence (wt) from HTNV(LongquanAa-08-573)__JQ912714.1__N
MATMEELQREINAHEGQLVIARQKVRDAEKQYEKDPDELNKRALTDREGVAASIQAKIDELKRQLADRIATGKNLGKEQDPTGVEPGDHLKERSMLSYGNVLDLNHLDIDEPTGQTADWLSIVVYLTSFVVPILLKALYMLTTRGRQTTKDNKGTRIRFKDDSSFEDVNGIRKPKHLYVSLPNAQSSMKAEEITPGRYRTAICGLYPAQIKARQMISPVMSVIGFLALAKDWADRIEQWLSEPCKLLPDTAAVSLHGGPATNRDYLRQRQVALGNMETKESKAIRQHAATAGCSMIEDIESPSSIWVFAGAPDRCPPTCLFIAGIAELGAFFSILQDMRNTIMASKTVGTSEEKLRKKSSFYQSYLRRTQSMGIQLDQRIIVLFMVAWGKEAVDNFHLGDDMDPELRTLAQSLIDVKVKEISNQEPLKL

SEQ ID NO: 314 - protein, 429 aa, Artificial Sequence
  derived and/or modified protein sequence (wt) from HTNV(LongquanAa-09-113)__JQ912716.1__N
MATMEELQREINAHEGQLVIARQKVRDAEKQYEKDPDELNKRALTDREGVAASIQAKIDELKRQLADRIATGKNLGKEQDPTGVEPGDHLKERSMLSYGNVLDLNHLDIDEPTGQTADWLSIVVYLTSFVVPILLKALYMLTTRGRQTTKDNKGTRIRFKDDSSFEDVNGTRKPKHLYVSLPNAQSSMKAEEITPGRYRTAICGLYPAQIKARQMISPVMSVIGFLALAKDWADRIEQWLSEPCKLLPDTAAVSLHGGPATNRDYLRQRQVALGNMETKESKAIRQHAETAGCSMIEDIESPSSIWVFAGAPDRCPPTCLFIAGIAELGAFFSILQDMRNTIMASKTVGTSEEKLRKKSSFYQSYLRRTQSMGIQLDQRIIVLFMVAWGKEAVDNFHLGDDMDPELRTLAQSLIDVKVKEISNQEPLKL

SEQ ID NO: 315 - protein, 429 aa, Artificial Sequence
  derived and/or modified protein sequence (wt) from HTNV(LongquanAa-09-191)__JQ912719.1__N
MATMEELQREINAHEGQLVIARQKVRDAEKQYEKDPDELNKRALTDREGVAASIQAKIDELKRQLADRIATGKNLGKEQDPTGVEPGDHLKERSMLSYGNVLDLNHLDIDEPTGQTADWLSIVVYLTSFVVPILLKALYMLTTRGRQTIKDNKGTRIRFKDDSSFEDVNGIRKPKHLYVSLPNAQSSMKAEEITPGRYRTAICGLYPAQIKARQMISPVMSVIGFLALAKDWADRIEQWLSEPCKLLPDTAAVSLHGGPATNRDYLRQRQVALGNMETKESKAIRQHAETAGCSMIEDIESPSSIWVFAGAPDRCPPTCLFIAGIAELGAFFSILQDMRNTIMASKTVGTSEEKLRKKSSFYQSYLRRTQSMGIQLDQRIIVLFMVAWGKEAVDNFHLGDDMDPELRTLAQSLIDVKVKEISNQEPLKL

SEQ ID NO: 316 - protein, 429 aa, Artificial Sequence
  derived and/or modified protein sequence (wt) from HTNV(LongquanAa-09-192)__JQ912720.1__N
MATMEELQREINAHEGQLVIARQKVRDAEKQYEKDPDELNKRALTDREGVAASMQGKIDELKRQLADRIATGKNLGKEQDPTGVEPGDHLKERSMLSYGNVLDLNHLDIDEPTGQTADWLSIVVYLTSFVVPILLKALYMLTTRGRQTTKDNKGTRIRFKDDSSFEDVNGIRKPKHLYVSLPNAQSSMKAEEITPGRYRTAICGLYPAQIKARQMISPVMSVIGFLALAKDWADRIEQWLSEPCKLLPDTAAVSLHGGPATNRDYLRQRQVALGNMETKESKAIRQHAETAGCSMIEDIESPSSIWVFAGAPDRCPPTCLFIAGIAELGAFFSILQDMRNTIMASKTVGTSEEKLRKKSSFYQSYLRRTQSMGIQLDQRIIVLFMVAWGKEAVDNFHLGDDMDPELRTLAQSLIDVKVKEISNQEPLKL

SEQ ID NO: 317 - protein, 429 aa, Artificial Sequence
  derived and/or modified protein sequence (wt) from HTNV(LongquanAa-10-46)__JQ912754.1__N
MATMEELQREINAHEGQLVIARQKVRDAEKQYEKDPDELNKRALTDREGVAASIQAKIDELKRQLADRIATGKNLGKEQDPTGVEPGDHLKERSMLSYGNVLDLNHLDIDEPTGQTADWLSIVVYLTSFVVPILLKALYMLTTRGRQTTKDNKGTRIRFKDDSSFEDVNGIRKPEHLYVSLPNAQSSMKAEEITPGRYRTAICGLYPAQIKARQMISPVMSVIGFLALAKDWADRIEQWLSEPCKLLPDTAAVSLHGGPATNRDYLRQRQVALGNMETKESKAIRQHAETAGCSMIEDIESPSSIWVFAGAPDRCPPTCLFIAGIAELGAFFSILQDMRNTIMASKTVGTSEEKLRKKSSFYQSYLRRTQSMGIQLDQRIIVLFMVAWGKEAVDNFHLGDDMDPELRTLAQSLIDVKVKEISNQEPLKL

SEQ ID NO: 318 - protein, 429 aa, Artificial Sequence
  derived and/or modified protein sequence (wt) from HTNV(LongquanAa-11-745)__KC344237.1__N
MATMEELQKEINAHEGQLVIARQKVRDAEKQYEKDPDELNKRALTDREGVAASIQAKIDELKRQLADRIATGKNLGKEQDPTGVEPGDHLKERSMLSYGNVLDLNHLDIDEPTGQTADWLSIVVYLTSFVVPILLKALYMLTTRGRQTTKDNKGTRIRFKDDSSFEDVNGIRKPKHLYVSLPNAQSSMKAEEITPGRYRTAICGLYPAQIKARQMISPVMSVIGFLALAKDWADRIEQWLSEPCKLLPDTAAVSLHGGPATNRDYLRQRQVALGNMETKESKAIRQHAETAGCSMIEDIESPSSIWVFAGAPDRCPPTCLFIAGIAELGAFFSILQDMRNTIMASKTVGTSEEKLRKKSSFYQSYLRRTQSMGIQLDQRIIVLFMVAWGKEAVDNFHLGDDMDPELRTLAQSLIDVKVKEISNQEPLKL

SEQ ID NO: 319 - protein, 429 aa, Artificial Sequence
  derived and/or modified protein sequence (wt) from HTNV(ROKA14-11)__KU207207.1__N
MATMEELQREINAHEGQLVIARQKVRDAEKQYEKDPDELNKRALTDREGVAVSIQAKIDELKRQLADRIATGKNLGKEQDPTGVEPGDHLKERSMLSYGNVLDLNHLDIDEPTGQTADWLSIVVYLTSFVVPILLKALYMLTTRGRQTTKDNKGTRIRFKDDSSFEDVNGIRKPKHLYVSLPNAQSSMKAEEITPGRYRTAVCGLYPAQIKARQMISPVMSVIGFLALAKDWSDRIEQWLSEPCKLLPDTAAVSLLGGPATNRDYLRQRQVALGNMETKESKAIRQHAEAAGCSMIEDIESPSSIWVFAGAPDRCPPTCLFVAGIAELGAFFSILQDMRNTIMASKTVGTSEEKMRKKSSFYQSYLRRTQSMGIQLDQRIIVLFMVAWGKEAVDNFHLGDDMDPELRTLAQSLIDVKVKEISNQEPLKL

SEQ ID NO: 320 - protein, 429 aa, Artificial Sequence
  derived and/or modified protein sequence (wt) from HTNV(US8A14-2)__KU207208.1__N
MATMEELQREINAHEGQLVIARQKVRDAEKQDGKDPDELNKRALTDREGVAVSIQAKIDELKRQLADRIATGKNLGKEQDPTGVEPGDHLKERSMLSYGNVLDLNHLDIDEPTGQTADWLSIVVYLTSFVVPILLKALYMLTTRGRQTTKDNKGTRIRFKDDSSFEDVNGIRKPKHLYVSLPNAQSSMKAEEITPGRYRTAVCGLYPAQIKARQMISPVMSVIGFLALAKDWSDRIEQWLSEPCKLLPDTAAVSLLGGPATNRDYLRQRQVALGNMETKESKAIRQHAEAAGCSMIEDIESPSSIWVFAGAPDRCPPTCLFIAGIAELGAFFSILQDMRNTIMASKTVGTSEEKLRKKSSFYQSYLRRTQSMGIQLDQRIIVLFMVAWGKEAVDNFHLGDDMDPELRTLAQSLIDVKVKEISNQEPLKL

SEQ ID NO: 321 - protein, 429 aa, Artificial Sequence
  derived and/or modified protein sequence (wt) from HTNV(US8A15-1)__KU207209.1__N
MATMEELQREINAHEGQLVIARQKVRDAEKQYEKDPDELNKRALTDREGVAVSIQAKIDELKRQLADRIATGKNLGKEQDPTGVEPGDHLKERSMLSYGNVLDLNHLDIDEPTGQTADWLSIVVYLTSFVVPILLKALYMLTTRGRQTTKDNKGTRIRFKDDSSFEDVNGIRKPKHLYVSLPNAQSSMKAEEITPGRYRTAVCGLYPAQIKARQMISPVMSVIGFLALAKDWSDRIEQWLSEPCKLLPDTAAVSLLGGPATNRDYLRQRQVALGNMETKESKAIRQHAEAAGCSMIEDIESPSSIWVFAGAPDRCPPTCLFIAGIAELGAFFSILQDMRNTIMASKIVGTSEEKLRKKSSFYQSYLRRTQSMGIQLDQRIIVLFMVAWGKEAVDNFHLGDDMDPELRTLAQSLIDVKVKEISNQEPLKL

SEQ ID NO: 322 - protein, 429 aa, Artificial Sequence
  derived and/or modified protein sequence (wt) from HTNV(YaluRiver13)__HQ611981.1__N
MATMEELQREINAHEGQLVIARQKVRDAEKQYEKDPDELNKRALTDREGVAVSIQAKIDELKRQLADRIATGKNLGKEQDPTGVEPGDHLKERSMLSYGNVLDLNHLDIDEPTGQTADWLSIVVYLTSFVVPILLKALYMLTTRGGQTTKDNKGTRIRFKDDSSFEDVNGIRKPKHLYVSLPNAQSSMKAEEITPGRYRTAICGLYPAQIKARQMISPVMSVIGFLALAKDWSDRIEQWLSEPCKLLPDTAAVSLLGGPATNRDYLRQRQVALGNMETKESKAIRQHAEAAGCSMIEDIESPSSIWVFAGAPDRCPPTCLFIASIGELGAFFSILQDMRNTIMASKTVGTSEEKLRKKSSFYQSYLRRTQSMGIQLDQRIIVLFMVSWGKEAVDNFHLGDDMDPELRTLAQSLIDVKVKEIPNQEPLKL

SEQ ID NO: 323 - protein, 429 aa, Artificial Sequence
  derived and/or modified protein sequence (wt) from HTNV(84FLi)__AY017064.1__N
MATMEELQREINAHEGQLVIARQKVRDAEKQYEKDPDELNKRTLTDREGVAASIQAKIDELKRQLADRIATGKNLGKEQDPTGVEPGDHLKERSMLSYGNVLDLNYLDIDEPTGQTADWLSIVIYLTSFVVPILLKALYMLTTRGRQTTKDNKGTRIRFKDDSSFEDVNGIRKPKHLYVSLPNAQSSMKAEEITPGRYRTAICGLYPAQIKARQMISPVMSVIGFLALAKDWSDRIEQWLSEPCKLLPDTAAVSLHGGPATNRDYLRQRQVALGNMETKESKAIRQHAESAGCSMIEDIESPSSIWVFAGAPDRCPPTCLFIAGIAELGAFFSILQDMRNTIMASKTVGTSEEKLRKKSSFYQSYLRRTQSMGIQLDQRIIVLFMVAWGKEAVDNFHLGDDMDPELRTLAQSLIDVKVKEISNQEPLKL

SEQ ID NO: 324 - protein, 429 aa, Artificial Sequence
  derived and/or modified protein sequence (wt) from HTNV(Bao14)__AB127998.1__N
MATMEELQREINAHEGQLVIARQKVRDAEKQYEKDPDELNKRTLTDREGVAVSIQAKIDELKRQLADRIATGKNLGKEQDPTGVEPGDHLKERSMLSYGNVLDLNHLDIDEPTGQTADWLSIVVYLTSFVVPILLKALYMLTTRGRQTTKDNKGTRIRFKDDSSFEDVNGIRKPKHLYVSLPNAQSSMKAEEITPGRYRTAICGLYPAQIKARQMISPVMSVIGFLALAKDWSDRIEQWLSEPCKLLPDTAAVSLLGGPATNRDYLRQRQVALGNMETKESKAIRQHAEAAGCSMIEDIESPSSIWVFAGAPDRCPPTCLFIAGIAELGAFFSILQDMRNTIMASKTVGTSEEKLRKKSSFYQSYLRRTQSMGIQLDQRIIVLFMVAWGKEAVDNFHLGDDMDPELRTLAQSLIDVKVKEISNQEPLKL

SEQ ID NO: 325 - protein, 429 aa, Artificial Sequence
  derived and/or modified protein sequence (wt) from HTNV(Chen4)__AB027101.1__N
MATMEELQREINAHEGQLVIARQKVRDAEKQYEKDPDELNKRTLTDREGVAASIQAKIDELKRQLADRIATGKNLGKEQDPTGVEPGDHLKERSMLSYGNVLDLNHLDIDEPTGQTADWLSIVIYLTSFVVPILLKALYMLTTRGRQTTKDNKGTRIRFKDDSSFEDVNGIRKPKHLYVSLPNAQSSMKAEEITPGRYRTAICGLYPAQIKARQMISPVMSVIGFLALAKDWSDRIEQWLSAPCKLLPDTAAVSLHGGPATNRDNLRQRQVALGNMETKESKAIRQHAESAGCSMIEDIESPSSIWVFAGAPDRCPPTCLFIAGIAELGAFFSILQDMRNTIMASKTVGTSEEKLRKKSSFYQSYLRRTQSMGIQLDQRIIVLFMVAWGKEAVDNFRLGDDMDPELRTLAQSLIDVKVKEISNQEPLKL

SEQ ID NO: 326 - protein, 429 aa, Artificial Sequence
  derived and/or modified protein sequence (wt) from HTNV(Hu)__AB027111.1__N
MATMEELQREINAHEGQLVIARQKVRDAEKQYEKDPDELNKRALTDREGVAASIQAKIDELKRQLADRIATGKNLGKEQDPTGVEPGDHLKERSMLSYGNVLDLNHLDIDEPTGQTADWLSIVIYLTSFVVPILLKALYMLTTRGRQTTKDNKGTRIRFKDDSSFEDVNGIRKPKHLYVSLPNAQSSMKAEEITPGRYRTAICGLYPAQIKARQMISPVMSVIGFLALAKDWSDRIEQWLSEPCKLLPDTAAVSLHGGPATNRDYLRQRQVALGNMETKESKAIRQHAEAAGCSMIEDIESPSSIWVFAGAPDRSPPTCMFIAGIDELGAFFSILQDMRNTIMASKTVGTSEEKLRKKSSFYQSYLRRTQSMGIQLDQRIIVLFMVAWGKEAVDNFHLGDDMDPELRTLAQSLIDIKVKEISNQEPLKL

SEQ ID NO: 327 - protein, 429 aa, Artificial Sequence
  derived and/or modified protein sequence (wt) from HTNV(HubeiHu02)__JQ665905.1__N
MATMEELQKEINAHEGQLVIARQKVRDAEKQYEKDPDELNKRTLTDREGVAASIQAKIDELKRQLADRIATGKNLGKEQDPTGVEPGDHLKERSMLSYGNVLDLNHLDIDEPTGQTADWLSIVIYLTSFVVPILLKALYMLTTRGRQTTKDNKGTRIRFKDDSSFEDVNGIRKPKHLYVSLPNAQSSMKAEDITPGRYRTAICGLYPAQIKARQMISPVMSVIGFLALAKDWSDRIEQWLSEPCKLLPDTAAVSLHGGPATNRDYLRQRQVALGNMETKESKAIRQHAESAGCSMIEDIESPSSIWVFAGAPDRCPPTCLFIAGIAELGAFFSILQDMRNTIMASKTVGTSEEKLRKKSSFYQSYLRRTQSMGIQLDQRIIVLFMVAWGKEAVDNFHLGDDMDPELRTLAQSLIDVKVKEISNQEPLKL

SEQ ID NO: 328 - protein, 429 aa, Artificial Sequence
  derived and/or modified protein sequence (wt) from HTNV(HV004)__JQ083395.1__N
MATMEELQKEINAHEGQLVIARQKVRDAEKQYEKDPDELNKRALTDREGVAASIQAKIDELKRQLADRIATGKNLGKEQDPTGVEPGDHLKERSMLSYGNVLDLNHLDIDEPTGQTADWLSIVIYLTSFVVPILLKALYMLTTRGRQTTKDNKGTRIRFKDDSSFEDVNGIRKPKHLYVSLPNAQSSMKAEEITPGRYRTAICGLYPAQIKARQMISPVMSVIGFLALAKDWSDRIEQWLSEPCKLLPDTAAVSLHGGPATNRDYLRQRQVALGNMETKESKAIRQHAESAGCSMIEDIESPSSIWVFAGAPDRCPPTCLFIAGIAELGAFFSILQDMRNTIMASKTVGTSEEKLRKKSSFYQSYLRRTQSMGIQLDQRIIVLFMVAWGKEAVDNFHLGDDMDPELRTLAQSLIDVKVKEISNQEPLKL

SEQ ID NO: 329 - protein, 429 aa, Artificial Sequence
  derived and/or modified protein sequence (wt) from HTNV(Maaji-1)__AF321094.1__N
MATMEELQKEINAHEGQLVIARQKVRDAERQYEKDPDELNKRTLTDREGVAASIQAKIDELKRQLADRIATGKNLGKEQDPTGVEPGDHLKERSMLSYGNVLDLNHLDIDEPTGQTADWLSIVIYLTSFVVPILLKALYMLTTRGRQTTKDNKGTRIRFKDDSSFEDVNGIRKPKHLYVSLPNAQSSMKAEEITPGRYRTAVCGLYPAQIKARQMISPVMSVIGFMALAKDWSERIEQWLSEPCKLLPDTSAVSLLGGPATNKDYLRQRQVALGNMETKESKAIRQQAEASGCSMIEDIESPSSIWVFAGAPDRCPPTCLFIAGMAELGAFFSILQDMRNTIMASKTVGTSEEKLRKKSSFYQSYLRRTQSMGIQLDQRIIVLFMVAWGKEAVDNFHLGDDMDPELRTLAQSLIDVKVKEISNQEPLKL

SEQ ID NO: 330 - protein, 429 aa, Artificial Sequence
  derived and/or modified protein sequence (wt) from HTNV(Maaji-2)__AF321095.1__N
MATMEELQREINAHEGQLVIARQKVRDAEKQYEKDPDELNKRTLTDREGVAVSIQAKIDELKRQLADRIATGKNFGKEQDPTGVEPGDHLKERSMLSYGNVLDLNHLDIDEPTGQTADWLSIVVYLTSFVVPILLKALYMLTTRGRQTTKDNKGTRIRFKDDSSFEDVNGIRKPKHLYVSLPNAQSSMKAEEITPGRYRTAVCGLYPAQIKARQMISPVMSVIGFLALAKDWSDRIEQWLSEPCKLLPDTAAVSLLGGPATNRDYLRQRQVALGNMETKESKAIRQHAEAAGCSMIEDIESPSSIWVFAGAPDRCPPTCLFIAGIAELGAFFSILQDMRNTIMASKTVGTSEEKLRKKSSFYQSYLRRTQLMGIQLDQRIIVLFMVAWGKEAVDNFHLGDDMDPELRTLAQSLIDVKVKEISNQEPLKL

SEQ ID NO: 331 - protein, 429 aa, Artificial Sequence
  derived and/or modified protein sequence (wt) from HTNV(N8)__DQ658415.1__N
MATMEELQREINAHEGQLVIARQKVRDAEKQYEKDPDELNKRTLTDREGVAASIQAKIDELKRQLADRIATGKNLGKEQDPTGVEPGDHLKERSMLSYGNVLDLNHLDIDEPTGQTADWLSIVIYLTSFVVPILLKALYMLTTRGRQTTKDNKGTRIRFKDDSSFEDVNGIRKPKHLYLSLPNAQSSMKAEEITPGRYRTAICGLYPAQIKARQMISPVMSVIGFLALAKDWSDRIEQWLSEPCKLLPDAAAVSLHGGPATNRDYLRQRQVALGNMETKESKAIRQHAETAGCSMIDDIESPSSIWVFAGAPDRCPPTCLFIAGIAELGAFFSILQDMRNTIMASKTVGTSEEKLRKKSSFYQSYLRRTQSMGIQLDQRIIVLFMVAWGKEAVDNFHLGDDMDPELRTLAQSLIDVKVKEISNQEPLKL

SEQ ID NO: 332 - protein, 429 aa, Artificial Sequence
  derived and/or modified protein sequence (wt) from HTNV(Q32)__AB027097.1__N
MATMEELQREINAHEGQLVIARLKVRDAEKPYEKDPDELNMRTLTDREGVAASIQAKIDELKRQLADRIATGKNLGKEQDPTGVEPGDHLKERSMLSYGNVLDLNHLDIDEPTGQTADWLSIVIYLTSFVVPILLKALYMLTTRGRQTTKDNKGTRIRFKDDSSFEDVNGIRKPKHLYVSLPNAQSSMKAEEITPGRYRTAICGLYPAQIKARQMISPVMSVIGFLALAKDWSDRIEQWLSEPCKLLPDTAAVSLHGGPATNRDYLRQRQVALGNMETKESKAIRQHAESAGCSMVEDIESPSSIWVFAGAPDRCPPTCLFIAGIAELGAFFSILQDMRNTIMASKTVGTSEEKLRKKSSFYQSYLRRTQSMGIQLDQRIIVLFMVAWGKEAVDNFQPGDDMDPELRTLAQSLIDVKVKEISNQEPLKL

SEQ ID NO: 333 - protein, 429 aa, Artificial Sequence
  derived and/or modified protein sequence (wt) from HTNV(SXHu2012B1)__KC844226.1__N
MATMEELQREINAHEGQLVIARQKVRDAEKQYEKDPDELNKRALTDREGVAASIQAKIDELKRQLADRIATGKNLGKEQDPTGVEPGDHLKERSMLSYGNVLDLNHLDIDEPTGQTADWLSIVIYLTSFVVPILLKALYMLTTRGRQTTKDNKGTRIRFKDDSSFEDVNGIRKPKHLYVSLPNAQSSMKAEEITPGRYRTAICGLYPAQIKARQMISPVMSVIGFLALAKDWSDRIEQWLSEPCKLLPDTAAVSLHGGPATNRDYLRQRQVALGNMETKESKAIRQHAESAGCSMVEDIESPSSIWVFAGAPDRCPPTCLFIAGIAELGAFFSILQDMRNTIMASKTVGTSEEKLRKKSSFYQSYLRRTQSMGIQLDQRIIVLFMVAWGKEAVDNFHLGDDMDPELRTLAQSLIDVKVKEISNQEPLKL

SEQ ID NO: 334 - protein, 429 aa, Artificial Sequence
  derived and/or modified protein sequence (wt) from HTNV(TJJ16)__AY839871.1__N
MATMEELQREINAHEGQLVIARQKVRDAEKQYEKDPDELNKRALTDREGLAASIQAKIDELKRQLADRIATGKNLGKERDPTGVEPGDHLKERSMLSYGNVLDLNHLDIDEPTGQTADWLSIVIYLTSFVVPILLKALYMLTTRGRQTTKDNKGTRIRFKDDSSFEDVNGIRKPKHLYVSLPNAQSSMKAEEITPGRYRTAICGLYPAQIKARQMISPVMSVIGFLALAKDWSDRIEQWLSEPCKLLPDTAAVSLHGGPATNRDYLRQRQVALGNMETKESKAIRQHAESAGCSMVEDIESPSSIWVFAGAPDRCPPTCLYIAGIAELGAFFSILQDMRNTIMASKTVGTSEEKLRKKSSFYQSYLRRTQSMGIQLDQRIIVLFMVAWGKEAVDNFHLGDDMDPELRTLAQSLIDVKVKEISNQEPLKL

SEQ ID NO: 335 - protein, 429 aa, Artificial Sequence
  derived and/or modified protein sequence (wt) from HTNV(WCL)__KM355414.1__N
MATMEELQREINAHEGQLVIARQKVRDAEKQYEKDPDELNKRALTDREGVAVSIQAKIDELERQLADRIATGKNLGKEQDPTGVEPGDHLKERSMLSYGNVLDLNHLDIDEPTGQTADWLSIVVYLTSFVVPILLKALYMLTTRGRQTTKDNKGTRIRFKDDSSFEDVNGIRKPKHLYVSLPNAQSSMKAEEITPGRYRTAICGLYPAQIKARQMISPVMSVIGFLALAKDWSDRIEQWLSEPCKLLPDTAAVSLLGGPATNRDYLRQRQVALGNMETKESKAIRQHAEAAGCSMIEDIESPSSIWVFAGAPDRCPPTCLFIAGIAELGAFFSILQDMRNTIMASKTVGTSEEKLRKKSSFYQSYLRRTQSMGIQLDQRIIVLFMVAWGKEAVDNFHLGDDMDPELRTLAQSLIDVKVKEISNQEPLKL

SEQ ID NO: 336 - protein, 429 aa, Artificial Sequence
  derived and/or modified protein sequence (wt) from HTNV(YN509)__GU329991.1__N
MATMEELQKEINAHEGQLIIAKQKVKDAEKQYEKDPDELNKRALTDREGVAASIQAKIDELKRQLADRIATGKNLGQDRDPTGVEPGDHLKERSMLSYGNILDLNHLDIDEPTGQTADWLSIIVYLTSFVVPILLKALYMLTTRGRQTAKDNKGTRIRFKDDSSFEDVNGIRKPKHLYVSMPNAQSSMKAEEITPGRYRTAVCGLYPAQIKARQMVSPVMSVIGFMALAKDWTDRIENWLGEPCKLLPDTSSVILLGGPATNRDYIRQRQVALGNMETKEAKAVRQHAESAGCSMIDNIDSPSSIWVFAGAPDRCPPTCLFVAGLAELGAFFSILQDMRNTIMASKTVGTSEEKMRKKSSFYQSYLRRTQSMGIQLDQRIIVLFMVAWGKEAVDNFHLGDDMDPELRNLAQSLIDQKVKEISNQEPLKL

SEQ ID NO: 337 - protein, 429 aa, Artificial Sequence
  derived and/or modified protein sequence (wt) from HTNV(YU62)__AY748309.1__N
MATMEELQREINAHEGQLVIARQKVRDAEKQYEKDPDELNKRALTDREGLAASIQAKIDELKRQLADRIATGKNLGKEQDPTGVEPGDHLKERSMLSYGNVLDLNHLDIDEPTGQTADWLSIVIYLTSFVVPILLKALYMLTTRGRQTTKDNKGTRIRFKDDSSFEDVNGIRKPKHLYVSLPNAQSSMKAEEITPGRYRTAICGLYPAQIKARQMISPVMSVIGFLALAKDWSDRIEQWLSEPCKLLPDTAAVSLHGGPATNRDYLRQRQVALGNMETKESKAIRQHAESAGCSMVEDIESPSSIWVFAGAPDRCPPTCLFIAGIAELGAFFSILQDMRNTIMASKTVGTSEEKLRKKSSFYQSYLRRTQSMGIQLDQRIIVLFMVAWGKEAVDNFHLGDDMDPELRTLAQSLIDVKVKEISNQEPLKL

SEQ ID NO: 338 - protein, 429 aa, Artificial Sequence
  derived and/or modified protein sequence (wt) from HTNV(ZLS6-11)__FJ753396.1__N
MATMEELQREINAHEGQLVIARQKVRDAEKQYEKDPDELNKRALTDREGVAASIQAKIDELKRQLADRIATGKNLGKEQDPTGVEPGDHLKERSMLSYGNVLDLNHLDIDEPTGQTADWLSIVIYLTSFVVPILLKALYMLTTRGRQTTKDNKGTRIRFKDDSSFEDINGIRKPKHLYVSLPNAQSSMKAEEITPGRYRTAICGLYPAQIKARQMISPVMSVIGFLALAKDWSDRIEQWLSEPCKLLPDTAAVSLHGGPATNRDYLRQRQVALGNMETKESKAIRQHAETAGCSMIEDIESPSSIWVFAGAPDRCPPTCLFIAGIAELGAFFSILQDMRNTIMASKTVGTSEEKLRKKSSFYQSYLRRTQSMGIQLDQRIIVLFMVAWGKEAVDNFHLGDDMDPELRTLAQSLIDVKVKEISNQEPLKL

SEQ ID NO: 339 - protein, 429 aa, Artificial Sequence
  derived and/or modified protein sequence (wt) from HTNV__AB027523.1__N
MATMEELQKEINAHEGQLIIAKQKVKDAEKQYEKDPDELNKRALTDREGVSASIQAKIDELKRQLADRIATGKNLGQDRDPTGVEPGDHLKERSMLSYGNILDLNHLDIDEPTGQTADWLSIIVYLTSFVVPILLKALYMLTTRGRQTAKDNKGTRIRFKDDSSFEDVNGIRKPKHLYVSMPNAQSSMKAEEITPGGYRTAVCGLFPAQIKARQMVSPVMSVIGFMALAKDWTDRIESWLGEPCKLLPDTSAVSLLGGPATNRDYIRQRQVALGNMETKEAKAVRQHAESAGCSMIDNIDSPSSIWVFAGAPDRCPPTCLFIAGIAELGAFFSILQDMRNTIMASKTVGTSEEKMRKKSSFYQSYLRRTQSMGIQLDQRIIVLFMVAWGKEAADNFQHGDDMDPELRTLAQSLIDQKVKEISNQEPLKL

SEQ ID NO: 340 - protein, 430 aa, Artificial Sequence
  derived and/or modified protein sequence (wt) from HTNV__D25530.1__N
MMATMEELQREINAHEGQLVIARQKVRDAEKQYEKDPDELNKRALTNREGVAVSIQAKIDELKMQLADRIATGKNLGKEQDPTGVEPGDHLKERSMLSYGNVLDLNHLDIDEPTGQTADWLSIIVYLTSFVVPILLKALYMLTTRGRQTTKDNKGTRIRFKDDSSFEDVNGIRKPKHLYVSLPNAQSSMKAEEITPGRYRTAVCGLYPAQIKARQMISPVMSVIGFLALAKDWSDRIEQWLIEPCKLLPDTAAVSLLGGPATNRDYLRQRQVALGNMETKESKAIRQHAEAAGCSMIEDIESPSSIWVFAGAPDRCPPTCLFIAGIAELGAFFSILQDMRNTIMASKTVGTSEEKLRKKSSFYQSYLRRTQSMGIQLDQRIIVLFMVAWGKEAVDNFHLGDDMDPELRTLAQSLIDVKVKEISNQEPLKL

SEQ ID NO: 341 - protein, 429 aa, Artificial Sequence
  derived and/or modified protein sequence (wt) from HTNV__M14626.1__N
MATMEELQREINAHEGQLVIARQKVRDAEKQYEKDPDELNKRTLTDREGVAVSIQAKIDELKRQLADRIATGKNLGKEQDPTGVEPGDHLKERSMLSYGNVLDLNHLDIDEPTGQTADWLSIIVYLTSFVVPILLKALYMLTTRGRQTTKDNKGTRIRFKDDSSFEDVNGIRKPKHLYVSLPNAQSSMKAEEITPGRYRTAVCGLYPAQIKARQMISPVMSVIGFLALAKDWSDRIEQWLIEPCKLLPDTAAVSLLGGPATNRDYLRQRQVALGNMETKESKAIRQHAEAAGCSMIEDIESPSSIWVFAGAPDRCPPTCLFIAGIAELGAFFSILQDMRNTIMASKTVGTSEEKLRKKSSFYQSYLRRTQSMGIQLGQRIIVLFMVAWGKEAVDNFHLGDDMDPELRTLAQSLIDVKVKEISNQEPLKL

SEQ ID NO: 342 - protein, 429 aa, Artificial Sequence
  derived and/or modified protein sequence (wt) from HTNV__X95077.1__N
MATMEELQREINAHEGQLVIARQKVRDAEKQYEKDPDELNKRTLTDREGVAVSIQAKIDELKRQLADRIATGKNLGKEQDPTGVEPGDHLKERSMLSYGNVLDLNHLDIDEPTGQTADWLSIVVYLTSFVVPTLLKALYMLTTRGRQTTKDNKGTRIRFKDDSSFEDVNGIRKPKHLYVSLPNAQSSMKAEEITPGRYRTAVCGLYPAQIKARQMISPVMSVIGFLALAKDWSDRIEQWLSEPCKLLPDTTAVSLLGGPATNRDYLRQRQVALGNMETKESKAIRQHAEAAGCSMIEDIESPSSIWVFAGAPDRCPPTCLFIAGIAELGAFFSILQDMRNTIMASKTVGTSEEKLRKKSSFYQSYLRRTQSMGIQLDQRIIVLFMVAWGKEAVDNFHLGDDMDPELRTLAQSLIDVKVKEISNQEPLKL

SEQ ID NO: 343 - protein, 429 aa, Artificial Sequence
  derived and/or modified protein sequence (wt) from HTNV(CGAa1011)__EF990913.1__N
MATMEELQREINAHEGQLVIARQKVRDAEKQYEKDPDELNKRTLTDREGVAASIQAKIDELKRQLADRIATGKNLGKEQDPTGVEPGDHLKERSMLSYGNVLDLNHLDIDEPTGQTADWLSIVIYLTSFVVPILLKALYMLTTRGRQTTKDNKGTRIRFKDDSSFEDVNGIRKPKHLDVSLPNAQSSMKAEEITPGRYRTAICGLYPAQIKARQMISPVMSVIGFLALAKDWSDRIEQWLGEPCKLLPDTAAVSLLGGPATNRDYLRQRQVALGNMETKESKAIRQHAETAGCSMIEDIESPSSIWVFAGAPDRCPPTCLFIAGIAELGAFFSVLQDMRNTIMASKTVGTSEEKLRKKSSFYQSYLGRTQSMGIQLDQRIIVLFMVAWGKEAVDNFHLGDDVDPELRTLAQSLIDVKVKEISDQEPLKL

SEQ ID NO: 344 - protein, 429 aa, Artificial Sequence
  derived and/or modified protein sequence (wt) from HTNV(CGAa1015)__EF990912.1__N
MATMEELQREINAHEGQLVIARQKVRDAEKQYEKDPDELNKRTLTDREGVAASIQAKIDELKRQLADRIATGKNLGKEQDPTGVEPGDHLKERSMLSYGNVLDLNHLDIDEPTGQTADWLSIVIYLTSFVVPILLKALYMLTTRGRQTTKDNKGTRIRFKDDSSFEDVNGIRKPKHLDVSLPNAQSSMKAEEITPGRYRTAICGLYPAQIKARQMISPVMSVIGYLALAKDWSDRIEQWLGEPCKLLPDTAAVSLLGGPATNRDYLRQRQVALGNMETKESKAIRQHAETAGCSMIEDIESPSSIWVFAGAPDRCPPTCLFIAGIAELGAFISVLQDMRNTIMASKTVGTSEEKLRKKSSFYQSYLGRTQSMGIQLDQRIIVLFMVAWGKEAVDNFHLGDDVDPELRTLAQSLIDVKVKEISDQEPLKL

SEQ ID NO: 345 - protein, 429 aa, Artificial Sequence
  derived and/or modified protein sequence (wt) from HTNV(CGAa2)__EU092219.1__N
MATMEELQREINAHEGQLVIARQKVRDAEKQYEKDPDELNKRTLTDREGVAASIQAKIDELKRQLADRIATGKNLGKEQDPTGVEPGDHLKERSMLSYGNVLDLNHLDIDEPTGQTADWLSIVIYLTSFVVPILLKALYMLTTRGRQTTKDNKGTRIRFKDDSSFEDVNGIRKPKHLYVSLPNAQSSMKAKEITPGRYRTAICGLYPAQIKARQMISPVMSVIGFLALAKDWSDRIEQWLSEPCKLLPDTAAVSLHGGPATNRDYLRQRQVALGNMEPKESKAIRQHAESAGCSMVEDIESPSSIWVFAGAPDRCPPTCLFIAGIAELGAFFSILQDMRNTIMASKTVGTSEEKLRKKSSFYQSYLRRTQSMGIQLDQRIIVLFMVAWGKEAVDNFHLGDDMDPELRTLAQSLIDVKVKEISNQEPLKL

SEQ ID NO: 346 - protein, 429 aa, Artificial Sequence
  derived and/or modified protein sequence (wt) from HTNV(CGAa31MP7)__EF990911.1__N
MATMEELQREINAHEGQLVIARQKVRDAEKQYEKDPDELNKRTLTDREGVAASIQAKIDELKRQLADRIATGKNLGKEQDPTGVEPGDHLKERSMLSYGNVLDLNHLDIDEPTGQTADWLSIVIYLTSFVVPILLKALYMLTTRGRQTTKDNKGTRIRFKDDSSFEDVNGIRKPKHLYVSLPNAQSSMKAEEITPGRYRTAICGLYPAQIKARQMISPVMSVIGFLALAKDWSDRIEQWLSEPCKLLPDTAAVSLHGGPATNRDYLRQRQVALGNMETKESKAIRQHAESAGCSMVEDIESPSSIWVFAGAPDRCPPTCLFIAGIAELGAFFSILQDMRNTIMASKTVGTSEEKLRKKSSFYQSYLRRTQSMGIQLDQRIIVLFMVAWGKEAVDNFHLGDDMDPELRTLAQSLIDVKVKEISNQEPLKL

SEQ ID NO: 347 - protein, 429 aa, Artificial Sequence
  derived and/or modified protein sequence (wt) from HTNV(CGAa31P9)__EF990910.1__N
MATMEELQREINAHEGQLVIARQKVRDAEKQYEKDPDELNKRTLTDREGVAASIQAKIDELKRQLADRIATGKNLGKEQDPTGVEPGDHLKERSMLSYGNVLDLNHLDIDEPTGQTADWLSIVIYLTSFVVPILLKALYMLTTRGRQTTKDNKGTRIRFKDDSSFEDVNGIRKPKHLYVSLPNAQSSMKAEEITPGRYRTAICGLYPAQIKARQMISPVMSVIGFLALAKDWSDRIEQWLSEPCKLLPDTAAVSLHGGPATNRDYLRQRQVALGNMETKESKAIRQHAESAGCSMVEDIESPSSIWVFAGAPDRCPPTCLFIAEIAELGAFFSILQDMRNTIMASKTVGTSEEKLRKKSSFYQSYLRRTQSMGIQLDQRIIVLFMVAWGKEAVDNFHLGDDMDPELRTLAQSLIDVKVKEISNQEPLKL

SEQ ID NO: 348 - protein, 429 aa, Artificial Sequence
  derived and/or modified protein sequence (wt) from HTNV(CGAa4MP9)__EF990915.1__N
MATMEELQREINAHEGQLVIARQKVRDAEKQYEKDPDELNKRTLTDREGVAASIQAKIDELKRQLADRIATGKNLGKEQDPTGVEPGDHLKERSMLSYGNVLDLNHLDIDEPTGQTADWLSIVIYLTSFVVPILLKALYMLTTRGRQTTKDNKGTRIRFKDDSSFEDVNGIRKPKHLYVSLPNAQSSMKAEEITPGRYRTAICGLYPAQIKARQMISPVMSVIGFLALAKDWSDRIEQWLGEPCKLLPDTAAVSLLGGPATNRDYLRQRQVALGNMETKESKAIRQHAETAGCSMIEDIESPSSIWVFAGAPDRCPPTCLFIAGIAELGAFFSVLQDMRNTIMASKTVGTSEEKLRKKSSFYQSYLRRTQSMGIQLDQRIIVLFMVAWGKEAVDNFHLGDDMDPELRTLAQSLIDVKVKEISNQEPLKL

SEQ ID NO: 349 - protein, 429 aa, Artificial Sequence
  derived and/or modified protein sequence (wt) from HTNV(CGAa75)__EU092220.1__N
MATMEELQREINAHEGQLVIARQKVRDAEKQYEKDPDELNKRTLTDREGVAASIQAKIDELKRQLADRIATGKNLGKEQDPTGVEPGDHLKERSMLSYGNVLDLNHLDIDEPTGQTADWLSIVIYLTSSVVPILLKALYMLTTRGRQTTKDNKGTRIRFKDDSSFEDVNGIRKPKHLYVSLPNAQSSMKAEEITPGRYRTAICGLYPAQIKARQMISPVMNVIGFLALAKDWSDRIEQWLSEPCKLLPDTAAVSLHGGPATNRDYLRQRQVALGNMETKESKAIRQHAESAGCSMVEDIESPSSIWVFAGAPDRCPPTCLFIAGIAELGAFFSILQDMRNTIMASKTVGTSEEKLRKKSSFYQSYLRRTQSMGIQLDQRIIVLFMVAWGKEAVDNFHLGDDMDPELRTLAQSLIDVKVKEISNQEPLKL

SEQ ID NO: 350 - protein, 429 aa, Artificial Sequence
  derived and/or modified protein sequence (wt) from HTNV(CGHu1)__EU092218.1__N
MATMEELQREINAHEGQLVIARQKVRDAEKQYEKDSDELNKRTLTDREGVAVSIQAKIDELKRQLADRIATGKNLGKEQDPTGVEPGDHLKERSMLSYGNVLDLNHLDIDEPTGQTADWLSIVVYLTSLVVPILLKALYMLTTKGRQTTKDNKGTRIRFKDDSSFEDVNGIRKPKHLYVSLLNAQSSMKAEEITPGRYRTAICGPYPAQIKARQMISPVMSVIGFLALAKDWSDRIEQWLSEPCKLLPDTAAVSLLGGPATNRDYLRQRQVALGNMETKESKAIRQHAEAAGCSMIEDIESPSSIWVSAGAPDRCPPTCLFIAGIAELGAFFSILQDMRNTIMASKTVGTSEEKLRKKSSFYQSYLRRTQSMGIQLDQRIIVLFMVAWGKEAVDNFHLGDDMDPELRTLAQSLIDVKVKEISNQEPLKL

SEQ ID NO: 351 - protein, 429 aa, Artificial Sequence
  derived and/or modified protein sequence (wt) from HTNV(CGHu2)__EU363813.1__N
MATMEELQREINAHEGQLVIARQKVRDAEKQYEKDPDELNKRTLTDREGVAASIQAKIDELKRQLADRIATGKNLGKEQDPTGVEPGDHLKERSMLSYGNVLDLNHLDIDEPTGQTADWLSIVIYLTSLVVPILLKALYMLTTRGRQTTKDNKGTRIRFKDDSSFEDVNGIRKPKHLYVSLPNAQSSMKAEEITPGRYRTAICGLYPAQIKARQMISPVMSVIGFLALAKDWSDRIEQWLSEPCKLLPDTAAVSLHGGPATNRDYLRQRQVALGNMETKESKAIRQHAESAGCSMVEDIESPSSIWVFAGAPDRCPPTCLFIAGIAELGAFFSISQDMRNTIMASKTVGTSEEKLRKKSSFYQSYLRRTQSMGIQLDQRIIVLFMVAWGKEAVDNFHLGDDMDPELRTLAQSLIDVKVKEISNQEPLKL

SEQ ID NO: 352 - protein, 429 aa, Artificial Sequence
  derived and/or modified protein sequence (wt) from HTNV(CGHu3612)__EF990909.1__N
MATMEELQREINAHEGQLVIARQKVRDAEKQYEKDPDELNKRALTDREGLAASIQAKIDELKRQLADRVATGKNLGKEQDPTGVEPGDHLKERSMLSYGNVLDLNHLDIDEPTGQTADWLSIVIYLTSFVVPILLKALYMLTTRGRQTTKDNKGTRIRFKDDSSFEDVNGIRKPKHLYVSLPNAQSSMKAEEITPGRYRTAICGLYPAQIKARQMISPVMSVIGFLALAKDWSDRIEQWLSEPCKLLPDTAAVSLHGGPATNRDYLRQRQVALGNMETKESKAIRQHAESAGCSMVEDIESPSSIWVFAGAPDRCPPTCLFIAGIAELGAFFSILQDMRNTIMASKTVGTSEEKLRKKSSFYQSYLRRTQSMGIQLDQRIIVLFMVAWGKEAVDNFHLGDDMDPELRTLAQSLIDVKVREISNQEPLKL

SEQ ID NO: 353 - protein, 429 aa, Artificial Sequence
  derived and/or modified protein sequence (wt) from HTNV(CGRn15)__EU363810.1__N
MATMEELQREINAHEGQLVIARQKVRDAEKQYEKDPDELNKRTLTDREGVAASIQAKIDELKRQLADRIATGKNLGKEQDPTGVEPGDHLKERSMLSYGNVLDLNHLDIDEPTGQTADWLSIVIYLTSFVVPILLKALYMLTTRGRQTTKDNKGTRIRFKDDSSFEDVNGIRKPKHLYVTLPNAQSSMKAEEITPGRYRTAICGLYPAQIKARQMISPVMSVIGFLALAKDWSDRIEQWLSEPCKLLPDTAAVSLHGGPATNRDYLRQRQVALGNMETKESKAIRQHAESAGCSMVEDIESPSSIWVFAGAPDRCPPTCLFIAGIAELGAFFSILQDMRNTIMASKTVGTSEEKLRKKSSFYQSYLRRTQSMGIQLDQRIIVLFMVAWGKEAVDNFHLGDDMDPELRTLAQSLIDVKVKEISNQEPLKL

SEQ ID NO: 354 - protein, 429 aa, Artificial Sequence
  derived and/or modified protein sequence (wt) from HTNV(CGRn2616)__EU363811.1__N
MATMEELQREINAHEGQLVIARQKVRDAGKQYEKDPDELNKRTLTDREGVAASIQAKIDELKRQLADRIATGKNLGKEQDPTGVEPGDHLKERSMLSYGNVLDLNHLDIDEPTGQTADWLSIVIYLTSFVVPILLKALYMLTTRGRQTTKDNKGTRIRFKDDSSFEDVNGIRKPKHLYVSLPNAQSSMKAEEITPGRYRTAICGLYPAQIKARQMISPVMSVIGFLALAKDWSDRIEQWLSEPCKLLPDTAAVSLHGGPATNRDYLRQRQVALGNMETKESKAIRQHAESAGCSMVEDIGSPSSIWVFAGAPDRCPPTCLFIAGIAELGAFFSILQDMRNTIMASKTVGTSEEKLRKKSSFYQSYLRRTQSMGIQLDQRIIVLFMVAWGKEAVDNFHLGDDMDPELRTLAQSLIDVEVKEISNQEPLKL

SEQ ID NO: 355 - protein, 429 aa, Artificial Sequence
  derived and/or modified protein sequence (wt) from HTNV(CGRn53)__EF990907.1__N
MATMEELQREINAHEGQLVIARQKVRDAEKQYEKDPDELNKRALTDREGVAASIQAKIDELKRQLADRIATGKNLGKEQDPTGVEPGDHLKERSMLSYGNVLDLNHLDIDEPTGQTADWLSIVIYLTSFVVPILLKALYMLTTRGRQTTKDNKGTRIRFKDDSSFEDVNGIRKPKHLYVSLPNAQSSMKAEEITPGRYRTAICGLYPAQIKARQMISPVMSVIGFLALAKDWSDRIEQWLSEPCKLLPDTAAVSLHGGPATNRDYLRQRQVALGNMETKESKAIRQHAEAAGCSMIEDIESPSSIWVFAGAPDRCPPTCLFIAGIAELGAFFSILQDMRNTIMASKTVGTSEEKLRKKSSFYQSYLRRTQSMGIQLDQRIIVLFMVAWGKEAVDNFHLGDDMDPELRTLAQSLIDVKVKEISNQEPLKL

SEQ ID NO: 356 - protein, 429 aa, Artificial Sequence
  derived and/or modified protein sequence (wt) from HTNV(CGRn5310)__EF990906.1__N
MATMEELQREINAHEGQLVIARQKVRDAEKQYEKDPDEPNKRALTDREGVAASIQAKIDELKRQLADRIATGKNLGKEQDPTGVEPGDHLKERSMLSYGNVLDLNHLDIDEPTGQTADWLSIVIYLTSFVVPILLKALYMLTTRGRQTTKDNKGTRIRFKDDSSFEDVNGIRKPKHLYVSLPNAQSSMKAEEITPGRYRTAICGLYPAQIKARQMISPVMSVIGFLALAKDWSDRIEQWLSEPCKLLPDTAAVSLHGGPATNRDYLRQRQVALGNMETKESKAIRQHAEAAGCSMIEDIESPSSIWVFAGAPDRCPPTCLFIAGIAELGAFFSILQDMRNTIMASKTVGTSEEKLRKKSSFYQSYLRRTQSMGIQLDQRIIVLFMVAWGKEAVDNFHLGDDMDPELRTLAQSLIDVKVKEISNQEPLKL

SEQ ID NO: 357 - protein, 429 aa, Artificial Sequence
  derived and/or modified protein sequence (wt) from HTNV(CGRn93MP8)__EF990905.1__N
MATMEELQREINAHEGQLVIARQKVRDAEKQYEKDPDELNKRALTDREGVAAPIQAKIDELKRQLADRIATGKNLGKEQDPTGVEPGDHLKERSMLSYGNVLDLNHLDIDEPTGQTADWLSIVIYLTSFVVPILLKALYMLTTRGRQTTKDNKGSRIRFKDDSSFEDVNGIRKPKHLYVSLPNAQSSMKAEEITPGRYRTAICGLYPAQIKARQMISPVMSVIGFLALAKDWSDRIEQWLSEPCKLLPDTAAVSLHGGPATNRDYLRQRQVALGNMETKESKAIRQHAEAAGCSMIEDIESPSSIWVFAGAPDRCPPTCLFIAGIAELGAFFSILQDMRNTIMASKTVGTSEEKLRKKSSFYQSYLRRTQSMGIQLDQRIIVLFMVAWGKEAVDNFHLGDDMDPELRTLAQSLIDVKVKEISNQEPLKL

SEQ ID NO: 358 - protein, 429 aa, Artificial Sequence
  derived and/or modified protein sequence (wt) from HTNV(CGRn93P8)__EF990904.1__N
MATMEELQREINAHEGQLVIARQKVRDAEKQYEKDPDELNKRALTDREGVAASIQAKIDELKRQLADRIATGKNLGKEQDPTGVEPGDHLKERSMLSYGNVLDLNHLDIDEPTGQTADWLSIVIYLTSFVVPILLKALYMLTTRGRQTTKDNKGTRIRFKDDSSFEDVNGIRKPKHLYVSLPNAQSSMKAEEITPGRYRTAICGLYPAQIKARQMISPVMSVIGFLALAKDWSDRIEQWLSEPCKLLPDTAAVSLHGGPATNRDYLRQRQVALGNMETKESKAIRQHAEAAGCSMIEDIESPSSIWVFAGAPDRCPPTCLFIAGIAELGAFISILQDMRNTIMASKTVGTSEEKLRNKSSFYQSYLRRTQSMGIQLDQRIIVLFMVAWGKEAVDNFHLGDDMDPELRTLAQSLIDVKVKEISNQEPLKL

SEQ ID NO: 359 - protein, 429 aa, Artificial Sequence
  derived and/or modified protein sequence (wt) from HTNV(CGRni1)__EU363812.1__N
MATMEELQREINAHEGQLVIARQKVRDAEKQYEKDPDELNKRTLTDREGVAASIQAKIDELKRQLADRIATGKNLGREQDPTGVEPGDHLKERSMLSYGNVLDLNHLDIDEPTGQTADWLSIVIYLTSFVVPILLKALYMLTTRGRQTTKDNKGTRIRFKDDSSFEDINGIRKPKHLYVSLPNAQSSMKAEEITPGRYRTAICGLYPAQIKARQMISPVMSVIGFLALAKDWSDRIEQWLSEPCKLLPDTAAVSLHGGPATNRDYLRQRQVALGNMETKESKAIRQHAESAGCSMVEDIESPSSIWVFAGAPDRCPPTCLFIAGIAELGAFFSILQDMRNTIMASKTVGTSEEKLRKKSSFYQSYLRRTQSMGIQLDQRIIVLLMVAWGKEAVDNFHLGDDMDPELRTLAQSLIDVKVKEISNQEPLKL

SEQ ID NO: 360 - protein, 429 aa, Artificial Sequence
  derived and/or modified protein sequence (wt) from HTNV(CJAp93)__EF208929.1__N
MATMEELQREINAHEGQLVIARQKVRDAEKQYEKDPDELNKRTLTDREGVAVSIQAKIDELKRQLADRIATGKNLGKEQDPTGVEPGDHLKERSMLSYGNVLDLNHLDIDEPTGQTADWLSIVVYLTSFVVPILLKALYMLTTRGRQTTKDNKGTRIRFKDDSSFEDVNGIRKPKHLYVSLPNAQSSMKAEEITPGRYRTAICGLYPAQIKARQMISPVMSVIGFLALAKDWSDRIEQWLSEPCKLLPDTAAVGLLGGPATNRDYLRQRQVALGNMETKESKAIRQHAEAAGCSMIEDIESPSSIWVFAGAPDRCPPTCLFIAGIAELGAFFSILQDMRNTIMASKTVGTSEEKLRKKSSFYQSYLRRTQSMGIQLDQRIIVLFMVAWGKEAVNNFHLGDDMDPELRTLAQSLIDVKVKEISNQEPLKL

SEQ ID NO: 361 - protein, 429 aa, Artificial Sequence
  derived and/or modified protein sequence (wt) from HTNV(Aa14_207)__KX687234.1__N
MATMEELQREINAHEGQLVIARQKVRDAEKQYGKDPDELNKRALTDREGVAVSIQAKIDELKRQLADRIATGKNLGKEQDPTGVEPGDHLKERSMLSYGNVLDLNHLDIDEPTGQTADWLSIVVYLTSFVVPILLKALYMLTTRGRQTTKDNKGTRIRFKDDSSFEDVNGIRKPKHLYVSLPNAQSSMKAEEITPGRYRTAVCGLYPAQIKARQMISPVMSVIGFLALAKDWSDRIEQWLSEPCKLLPDTAAVSLLGGPATNRDYLRQRQVALGNMETKESKAIRQHAEAAGCSMIEDIESPSSIWVFAGAPDRCPPTCLFVAGIAELGAFFSILQDMRNTIMASKTVGTSEEKLRKKSSFYQSYLRRTQSMGIQLDQRIIVLFMVAWGKEAVDNFHLGDDMDPELRTLAQSLIDVKVKEISNQEPLKL

SEQ ID NO: 362 - protein, 429 aa, Artificial Sequence
  derived and/or modified protein sequence (wt) from HTNV(Aa14_234)__KX687235.1__N
MATMEELQREINAHEGQLVIARQKVRDAEKQYEKDPDELNKRALTDREGVAVSIQAKIDELKRQLADRIATGKNLGKEQDPTGVEPGDHLKERSMLSYGNVLDLNHLDIDEPTGQTADWLSIVVYLTSFVVPILLKALYMLTTRGRQTTKDNKGTRIRFKDDSSFEDVNGIRKPKHLYVSLPNAQSSMKAEEITPGRYRTAVCGLYPAQIKARQMISPVMSVIGFLALAKDWSDRIEQWLGEPCKLLPDTAAVSLLGGPATNRDYLRQRQVALGNMETKESKAIRQHAEAAGCSMIEDIESPSSIWVFAGAPDRCPPTCLFIAGIAELGAFFSILQDMRNTIMASKTVGTSEEKLRKKSSFYQSYLRRTQSMGIQLDQRIIVLFMVAWGKEAVDNFHLGDDMDPELRTLAQSLIDVKVKEISNQEPLKL

SEQ ID NO: 363 - protein, 429 aa, Artificial Sequence
  derived and/or modified protein sequence (wt) from HTNV(Aa14_239)__KX687236.1__N
MATMEELQREINAHEGQLVIARQKVRDAEKQDGKDPDELNKRALTDREGVAVSIQAKIDELKRQLADRIATGKNLGKEQDPTGVEPGDHLKERSMLSYGNVLDLNHLDIDEPTGQTADWLSIVVYLTSFVVPILLKALYMLTTRGRQTTKDNKGTRIRFKDDSSFEDVNGIRKPKHLYVSLPNAQSSMKAEEITPGRYRTAVCGLYPAQIKARQMISPVMSVIGFLALAKDWSDRIEQWLGEPCKLLPDTAAVSLLGGPATNRDYLRQRQVALGNMETKESKAIRQHAEAAGCSMIEDIESPSSIWVFAGAPDRCPPTCLFIAGIAELGAFFSILQDMRNTIMASKTVGTSEEKLRKKSSFYQSYLRRTQSMGIQLDQRIIVLFMVAWGKEAVDNFHLGDDMDPELRTLAQSLIDVKVKEISNQEPLKL

SEQ ID NO: 364 - protein, 429 aa, Artificial Sequence
  derived and/or modified protein sequence (wt) from HTNV(AY133/2011)__KY807166.1__N
MATMEELQREINAHEGQLVIARQKVRDAEKQYEKDPDELNKRALTDREGVAASIQAKIDELKRQLADRIATGKNIGKEQDPTGVEPGDHLKERSMLSYGNVLDLNHLDIDEPTGQTADWLSIVIYLTSFVVPILLKALYMLTTRGRQTTKDNKGTRIRFKDDSSFEDVSGIRKPKHLYLSLPNAQSSMKAEEITPGRYRTAICGLYPAQIKARQMISPVMSVIGFLALAKDWSDRIEQWLSEPCKLLPDTAAVSLHGGPATNRDYLRQRQVALGNMETKESKAIRQHAETAGCSMIDDIESPSSIWVFAGAPDRCPPTCLFIAGIAELGAFFSILQDMRNTIMASKTVGTSEEKLRKKSSFYQSYLRRTQSMGIQLDQRIIVLFMVAWGKEAVDNFHLGDDMDPELRTLAQSLIDVKVKEISNQEPLKL

SEQ ID NO: 365 - protein, 429 aa, Artificial Sequence
  derived and/or modified protein sequence (wt) from HTNV(GAN13/2011)__KY807168.1__N
MATMEELQREINAHEGQLVIARQKVRDAEKQYEKDPDELNKRALTDREGVAASIQAKIDELKRQLADRIATGKNLGKEQDPTGVEPGDHLKERSMLSYGNVLDLNHLDIDEPTGQTADWLSIVIYLTSFVVPILLKALYMLTTRGRQTTKDNKGTRIRFKDDSSFEDVNGIRKPKHLYLSLPNAQSSMKAEEITPGRYRTAICGLYPAQIKARQMISPVMSVIGFLALAKDWSDRIEQWLSEPCKLLPDTAAVSLHGGPATNRDYLRQRQVALGNMETKESKAIRQHAETAGCSMIDDIESPSSIWVFAGAPDRCPPTCLFIAGIAELGAFFSILQDMRNTIMASKTVGTSEEKLRKKSSFYQSYLRRTQSMGIQLDQRIIVLFMVAWGKEAVDNFHLGDDMDPELRTLAQSLIDVKVKEISNQEPLKL

SEQ ID NO: 366 - protein, 429 aa, Artificial Sequence
  derived and/or modified protein sequence (wt) from HTNV(GAN19/2011)__KY807172.1__N
MATMEELQREINAHEGQLVIARQKVRDAEKQYEKDPDELNKRALTDREGVAASIQAKIDELKRQLADRIATGKNLGKEQDPTGVEPGDHLKERSMLSYGNVLDLNHLDIDEPTGQTADWLSIVIYLTSFVVPILLKALYMLTTRGRQTTKDNKGTRIRFKDDSSFEDVNGIRKPKHLYLSLPNAQSSMKAEEITPGRYRTAICGLYPAQIKARQMTSPVMSVIGFLALAKDWSDRIEQWLSEPCKLLPDTAAVSLHGGPATSRDYLRQRQVALGNMETKESKAIRQHAETAGCSMIDDIESPSSIWVFAGAPDRCPPTCLFIAGIAELGAFFSILQDMRNTIMASKTVGTSEEKLRKKSSLYQSYLRRTQSMGIQLDQRIIVLFMVAWGKEAVDNFHLGDDMDPELRTLAQSLIDVKVKEISNQEPLKL

SEQ ID NO: 367 - protein, 429 aa, Artificial Sequence
  derived and/or modified protein sequence (wt) from HTNV(LR1)__AF288294.1__N
MATMEELQREINAHEGQLVIARQKVRDAEKQYEKDPDELNKRALTNREGVAVSIQAKIDELKMQLADRIATGKNLGKEQDPTGVEPGDHLKERSMLSYGNVLDLNHLDIDEPTGQTADWLSIIVYLTSFVVPILLKALYMLTTRGRQTTKDNKGTRIRFKDDSSFEDVNGIRKPKHLYVSLPDAQSSMKAEEITPGRYRTAVCGLYPAQIKARQMISPVMSVIGFLALAKDWSDRIEQWLIEPCKLLPDTAAVSLLGGPATNRDYLRQRQVALGNMETKESKAIRQHAEAAGCSMIEDIESPSSIWVFAGAPDRCPPTCLFIAGIAELGAFFSILQDMRNTIMASKTVGTSEEKLRKKSSFYQSYLRRTQSMGIQLDQRIIVLFMVAWGKEAVDNFHLGDDMDPELRTLAQSLIDVKVKEISNQEPLKL

SEQ ID NO: 368 - protein, 429 aa, Artificial Sequence
  derived and/or modified protein sequence (wt) from HTNV(RG9)__AF288296.1__N
MATMEELQREINAHEGQLVIARQKVRDAEKQYEKDPDELNKRTLTDREGVAASIQAKIDELKRQLADRIATGKNLGKEQDPTGVEPGDHLKERSMLSYGNVLDLNHLDIDEPTGQTADWLSIVIYLTSFVVPILLKALYMLTTRGRQTTKDNKGTRIRFKDDSSFEDVNGIRKPKHLYVSLPNAQSSMKAEEITPGRYRTAICGLYPAQIKARQMISPVMSVIGFLALAKDWSDRIEQWLSEPCKLLPDTAAVSLHGGPATNRDYLRQRQVALGNMETKESKAIRQHAESAGCSMIEDIESPSSIWVFAGAPDRCPPTCLFIAGIAELGAFFSILQDMRNTITASKTVGTSEEKLRKKSSFYQSYLRRTQSMGIQLDQRIIVLFMVAWGKEAVDNFHLGDDMDPELRTLAQSLIDVKVKEISNQEPLKL

SEQ ID NO: 369 - protein, 429 aa, Artificial Sequence
  derived and/or modified protein sequence (wt) from HTNV(S85-46)__AF288659.1__N
MATMEELQREINAHEGQLVIARQKVRDAEKQYEKDPDELNKSALTNREGVAVSIQAKIDELKMQLADRIATGKNLGKEQDPTGVEPGDHLKERSMLSYGNVLDLNHLDIDEPTGQTADWLSIIVYLTSFVVPILLKALYMLTTRGRQTTKDNKGTRIRFKDDSSFEDVNGIRKPKHLYVSLPNAQSSMKAEEITPGRYRTAVCGLYPAQIKARQMISPVMSVIGFLALAKDWSDRIEQWLIEPCKLLPDTAAVSLLGGPATNRDYLRQRQVALGNMETKESKAIRQHAEAAGCSMIEDIESPSSIWVFAGAPGRCPPTCLFIAGIAELGAFFSILQDMRNTIMASKTVGTSEEKLRKKSSFYQSYLRRTQSMGIQLDQRIIVLFMVAWGKEAVDNFHLGDDMDPELRTLAQSLIDVKVKEISNQEPLKL

SEQ ID NO: 370 - protein, 429 aa, Artificial Sequence
  derived and/or modified protein sequence (wt) from HTNV(SN7)__AF288657.1__N
MATMEELQREINAHEGQLVIARQKVRDAEKQYEKDPDELNKRTLTDREGVAASIQAKIDELKRQLADRIATGKNLGKEQDPTGVEPGDHLKERSMLSYGNVLDLNHLDIDEPTGQTADWLSIVIYLTSFVVPILLKALYMLTTRGRQTTKDNKGTRIRFKDDSSFEDVNGIRKPKHLYVSLPNAQSSMKTEEITPGRYRTAICGLYPAQIKARQMISPVMSVIGFLALAKDWSDRIEQWLSEPCKLLPDTAAVSLHGGPATNRDYLRQRQVALGNMETKESKAIRQHAESAGCSMIEDIESPSSIWVFAGAPDRCPPTCLFIAGIAELGAFFSILQDMRNTIMASKTVGTSEEKLRKKSSFYQSYLRRTQSMGIQLDQRIIVLFMVAWGKEAVDNFHLGDDMDPELRTLAQSLIDVKVKEISNQEPLKL

SEQ ID NO: 371 - protein, 429 aa, Artificial Sequence
  derived and/or modified protein sequence (wt) from HTNV(84FLi)__AF366568.1__N
MATMEELQREINAHEGQLVIARQKVRDAEKQYEKDPDELNKRTLTDREGVAASIQAKIDELKRQLADRIATGKNLGKEQDPTGVEPGDHLKERSMLSYGNVLDLNHLDIDEPTGQTADWLSIVIYLTSFVVPILLKALYMLTTRGRQTTKDNKGTRIRFKDDSSFEDVNGIRKPKHLYVSLPNAQSSMKAEEITPGRYRTAICGLYPAQIKARQMISPVMSVIGFLALAKDWSDRIEQWLSEPCKLLPDTAAVSLHGGPATNRDYLRQRQVALGNMETKESKAIRQHAESAGCSMIEDIESPSSIWVFAGAPNRCPPTCLFIAGIAELGAFFSILQDMRNTIMASKTVGTSEEKLRKKSSFYQSYLRRTQSMGIQLDQRIIVLFMVAWGKEAVDNFHLGDDMDPELRTLAQSLIDVKVKEISNQEPLKL

SEQ ID NO: 372 - protein, 429 aa, Artificial Sequence
  derived and/or modified protein sequence (wt) from HTNV(KHF,clone:4)__LC209206.1__N
MATMEELQREINAHEGQLVIARQKVRDAEKQYEKDPDELNKRTLTDREGVAVSIQAKIDELKRQLADRIATGKNLGKEQDPTGVEPGDHLKERSMLSYGNVLDLNHLDIDEPTGQTADWLSIVVYLTSFVVPILLKALYMLTTRGRQTTKDNKGTRIRFKDDSSFEDVNGIRKPKHLYVSLPNAQSSMKAEEITPGRYRTAVCGLYPAQIKARQMISPVMSVIGFLALAKDWSDRIEQWLSEPCKLLPDTAAVSLLGGPATNRDYLRQRQVALGNMETKESKAIRQHAEAAGCSMIEDIESPSSIWVFAGAPDRCPPTCLFIAGIAELGAFFSILQDMRNTIMASKTVGTSEEKLRKKSSFYQSYLRRTQSMGIQLDQRIIVLFMVAWGKEAVDNFHLGDDMDPELRTLAQSLIDVKVKEISNQEPLKL

SEQ ID NO: 373 - protein, 428 aa, Artificial Sequence
  derived and/or modified protein sequence (wt) from LANV(510B)__AF005727.1__N
MSNLQEVQEGITLHEQQLVAARQKLKDAEKAVEVDPDDVNKSTLQSRRAAVSALENKLAELKRQLADLVAAQKLAAKPVDPTGLEPDDHLKEKSALRYGNVLDVNAIDLEEPSGQTADWKAIGAYILGFVIPIILKALYMLSTRGRQTVKENKGTRIRFKDDSSFEEVNGIRKPKHLYVSMPTAQSTMKADEITPGRFRTIACGLFPAQIKARNIISPVMGVIGFGHFVKDWMERIDNFLGEDCPFLPKARVQSEAFMSTNRAYFLNRQRQVDESRIQDIVDLIQAAEASSATLFNDIATPHSAWVFACAPDRCPPTALYVAGVPELGAFFAILQDMRNTIMASKSVGTAEEKLKKKSAFYQSYLRRTQSMGIQLDQKIIILYMLSWGKEAVNHFHLGDDMDPELRQLAQTLIDAKVKEISNQEPLKL

SEQ ID NO: 374 - protein, 428 aa, Artificial Sequence
  derived and/or modified protein sequence (wt) from LANV(12234)__ALD61435.1__N
MSTLQEVQEGITLHEQQLVAARQKLKDAEKAVEVDPDDVNKSTLQSRRAAVSALENKLAELKRQLADLVAAQKLAAKPVDPTGLEPDDHLKEKSALRYGNVLDVNAIDLEEPSGQTADWKAIGAYILGFVIPIILKALYMLSTRGRQTVKENKGTRIRFKDDSSFEEVNGIRKPKQLYVSMPTAQSTMKADEITPGRFRTIACGLFPAQIKARNIISPVMGVIGFSHFVKDWMERIDDFLAADCPFLPKPRVQSEAFMATNRAYFINRQRQIDESRMPDIMDLIQAAEAGSATLFNDIATPHSAWVFACAPDRCPPTALYVAGVPELGAFFAILQDMRNTIMASKSVGTAEEKLKKKSAFYQSYLRRTQSMGIQLDQKIIILYMLSWGKEAVNHFHLGDDMDPELRQLAQTLIDTKVKEISNQEPLKL

SEQ ID NO: 375 - protein, 423 aa, Artificial Sequence
  derived and/or modified protein sequence (wt) from LQUV(Longquan-Rs-32)__JX465422.1__N
MATGRDLQDELEQIEQEITQAKAKYEKQKAAIGEEPDTIELKVLQQREETIHMLEEKRKELLQRIAQQMKSPRQPVKGRDLDEDEHLSERSTLRYGNVIDLEELDIDEPAGGSADWLAIGIYIFSFPVQLLLKTLYILTTRGRQTIKENKGNRLRFKDSSSTMDVNGVKTPRHLYISLPTAQSSMKTEEITPGRYRTVACGILSGEMRARKLVSPVMGVIGFNYLAEKWGEYIDAFLMKQSPHLPVSTGSPESATNFAYLIQRQDVLNKSKTVEYLELWEQAEKAGRHLVDRIESPLTPWLFAGSPDRCPPTSLYVAGIAELGAFFSILQDIRNAIMASKLVGTAEEKLKRKSSFYQSYLRRTQSMGVQLDQRIIILYMMEWGKMMVDHFHLGDDMDSELRKACQSLIDEKVAQVSNQEALKL

SEQ ID NO: 376 - protein, 423 aa, Artificial Sequence
  derived and/or modified protein sequence (wt) from LQUV(Longquan-Ra-14)__JX465414.1__N
MATGRDLQDELEQIEQEITQAKAKYEKQKAAIGEEHDTIELKVLQQREETIHMLEEKRKELLQRIAQQMKSPRQPVKGRDLDEDEHLSERSTLRYGNVIDLEELDIDEPAGGSADWLAIGIYIFSFPVQLLLKTLYILTTRGRQTIKENKGNRLRFKDSSSTMDVNGVKTPRHLYISLPTAQSSMKTEEITPGRYRTVACGILSGEMRARKLVSPVMGVIGFNYLAEKWGEYIDAFLMKQSPHLPVSTGSPESATNFAYLIQRQDVLNKSKTVEYLELWEQAEKAGRHLVDRIESPLTPWLFAGSPDRCPPTSLYVAGIAELGAFFSILQDIRNAIMASKLVGTAEEKLKRKSSFYQSYLRRTQSMGVQLDQRIIILYMMEWGKMMVDHFHLGDDMDSELRKACQSLIDEKVAQVSNQEALKL

SEQ ID NO: 377 - protein, 423 aa, Artificial Sequence
  derived and/or modified protein sequence (wt) from LQUV(Longquan-Ra-25)__JX465415.1__N
MATGRDLQDELEQIEQEITQAKAKYEKQKAAIGEEPDTIELKVLQQREETIHMLEEKRKELLQRIAQQMKSPKQPVKGRDLDEDEHLSERSTLRYGNVIDLEELDIDEPAGGSADWLAIGIYIFSFPVQLLLKTLYILTTRGRQTIKENKGNRLRFKDSSSTMDVNGVKTPRHLYISLPTAQSSMKTEEITPGRYRTVACGILSGEMRARKLVSPVMGVIGFNYLAEKWGEYIDAFLMKQSPHLPVSTGSPESATNFAYLIQRQDVLNKSKTVEYLELWEQAEKAGRHLVDRIESPLTPWLFAGSPDRCPPTSLYVAGIAELGAFFSILQDIRNAIMASKLVGTAEEKLKRKSSFYQSYLRRTQSMGIQLDQRIIILYMMEWGKMMVDHFHLGDDMDSELRKACQSLIDEKVAQVSNQEALKL

SEQ ID NO: 378 - protein, 428 aa, Artificial Sequence
  derived and/or modified protein sequence (wt) from NYV(RI-1)__U09488.1__N
MSTLKEVQDNITLHEQQLVTARQKLKDAEKAVEVDPDDVNKSTLQGRRAAVSALETKLGELKRQLADLIAAQKLASKPIDPTGIEPDDHLKEKSSLRYGNVLDVNSIDLEEPSGQTADWKAIGMYILSFAIPIILKALYMLSTRGRQTVKENKGTRIRFKDDSSYEEVNGIRKPRHLYVSMPTAQSTMKADEITPGRFRTIACGLFPAQVKARNIISPVMGVIGFNFFVKDWMDRIDDFLAERCPFLPEPRDPKDAALGTNRAYFITRQAQVDESKVVDIEELIVDARAESATLFADIATPHSVWVFACAPDRCPPTALYVAGMPELGAFFAILQDMRNTIMASKSVGTAEEKLKKKSAFYQSYLRRTQSMGIQLDQKIIILYMIHWGKEAVNHFHLGDDMDPELRELAQALVDAKVKEISNQEPLKL

SEQ ID NO: 379 - protein, 433 aa, Artificial Sequence
  derived and/or modified protein sequence (wt) from PUUV(K27)__L08804.1__N
MSDLTDIQEEITRHEQQLVVARQKLKDAERAVEVYPDDVIKNTLQARQQTVSALEDKLADYKRRMADAVSRKKMDTKPTDPTGIEPDDHLKERSSLRYGNVLDVNAIDIEEPSGQTADWYTIGVYVIGFTIPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWPEKIREFMEKECPFIKPEVKPGTPAQEVEFLKRNRVYFMTRQDVLDKNHVADIDKLIDYAASGDPTSPDDIKSPNAPWVFACAPDRSPPTCIYVAGMAELGAFFSILQDMRNTIMASKTVGTAEEKLKRKSSFYQSYLRRTQSMGIQLDQRIILLYMLEWGKEMVDHFHLGDDMDPELRGLAQSLIDQKVKEISNQEPLKI

SEQ ID NO: 380 - protein, 433 aa, Artificial Sequence
  derived and/or modified protein sequence (wt) from PUUV(KS13/855)__KX815394.1__N
MSDLTDIQEDITRHEQQLVVARQKLKDAEKAVEMDPDDVNKNTLQARQQTVSALEDKLADFKRRMADAVSRKKMDTKPTDPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWAERIREFMEKECPFIKPEVKPGTPAQEVEFLKKNKVYFMQRQDVLDKNHVADIDKLIDYAASGDPTSPDNIESPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLAQALIDQKVKEISNQEPLKI

SEQ ID NO: 381 - protein, 433 aa, Artificial Sequence
  derived and/or modified protein sequence (wt) from PUUV(KS14/118)__KX815395.1__N
MSDLTDIQEDITRHEQQLVVARQKLKDAERAVEVDPDDVNKNTLQARQQTVSALEDKLADFKRRMADAVSRKKMDTKPTDPTGIEPDDHLKERSSLRYGNVLDVNAIDIEEPSGQTADWYTIGVYVIGFTIPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKNWPERIKEFMEKECPFIKPEVKPGTPAQEVEFLKRNKVYFMNRQDVLDKNHVADIDKLIDYAASGDPTSPDDIESPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLAQALIDQKVKEISNQEPLKI

SEQ ID NO: 382 - protein, 433 aa, Artificial Sequence
  derived and/or modified protein sequence (wt) from PUUV(LT15/201)__KX757841.1__N
MSDLTDIQEDITRHEQQLVVARQKLKDAEKAVEMDPDDVNKNTLQARQQTVSALEDKLADFKRRMADAVSRKKMDTKPIDPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWAERIREFMEKECPFIKPEVKPGTPAQEVEFLKKNKVYFMQRQDVLDKNHVADIDKLIDYAASGDPTSPDNIESPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLAQALIDQKVKEISNQEPLKI

SEQ ID NO: 383 - protein, 433 aa, Artificial Sequence
  derived and/or modified protein sequence (wt) from PUUV(PUU/Ernstbrunn/Cg641/1995)__AJ888752.1__N
MSDLTDIQEDITRHEQQLVVARQKLKDAEKAVEMDPDDVNKNTLQARQQTVSALEDKLADFKRRMADAVSRKKMDTKPTDPTGIEPDDHLKERSSLRYGNVLDVNAIDIEEPSGQTADWYTIGVYVIGFTLPIILKALYMLSTRGRQTVKENKGTRIRFKDDTSFEDINGIKRPKHLYVSMPTAQSTMKAEKLTPGRFRTIVCGLFPTQIQVRNIMSPVMGVIGFSFFVKDWSERVRDFMEKECPFIKPEIKPGTPPQEAEFLKRNKVYFMQRQDVLDKNHVADIDKLIDYAASGDPTSPDNLESPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLAQALIDQKVKEISNQEPLKI

SEQ ID NO: 384 - protein, 433 aa, Artificial Sequence
  derived and/or modified protein sequence (wt) from PUUV(PUU/Klippitztoerl/Cg9/1995)__AJ888751.1__N
MSDLTDIQEDITRHEQQLVVARQKLKDAEKAVEMDPDDVNKNTLQARQQTVSALEDKLADFKRRMADAVSRKKMDTKPTDPTGIEPDDHLKERSSLRYGNVLDVNAIDIEEPGGQTADWYTIGVYVIGFTLPIILKALYMFSTRGRQTVKENKGTRIRFKDDTSFEDINGIRRPKHLYVSMPTAQSTMKAEELTPGRFRTIVCGLFPTQIQVRNIMSPVMGVIGFSFFVKDWSERVRDFMEKECPFIKPEIKPGTPPQEAEFLKRNKVYFMQRQDVLDKNHVADIDKLIDYAASGDPTSPDNLESPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLAQALIDQKVKEISNQEPLKI

SEQ ID NO: 385 - protein, 433 aa, Artificial Sequence
  derived and/or modified protein sequence (wt) from PUUV(Balkan-1)__AJ314600.1__N
MSDLTDIQEDITRHEQQLVVARQKLKDAEKAVEMDPDDVNKNTLQARQQTVSALEDKLADFKRRMADAVSRKKMDTKPTDPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWSERVREFMEKECPFIKPEIKPGTPPQEAEFLKRNKVYFMQRQDVLDKNHVADIDKLLDYAASGDPTSHDNIESPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLAQALIDQKVKEISNQEPLKI

SEQ ID NO: 386 - protein, 433 aa, Artificial Sequence
  derived and/or modified protein sequence (wt) from PUUV(Balkan-2)__AJ314601.1__N
MSDLTDIQEDITRHEQQLVVARQKLKDAEKAVEMDPDDVNKNTLQARQQTVSALEDKLADFKRRMADAVSRKKMDTKPTDPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVFGLFPTQIQVRNIMSPVMGVIGFSFFVKDWSERVREFMEKECPFIKPEIKPGAPPQEAEFLKRNKVYFMQRQDVLDKNHVADIDKLIDYAASGDPTSPDNIESPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLAQALIDQKVKEISNQEPLKI

SEQ ID NO: 387 - protein, 433 aa, Artificial Sequence
  derived and/or modified protein sequence (wt) from PUUV(Baltic/205Cg/00)__AJ314599.1__N
MSDLADIQEDITRHEQQLVVARQKLKDAERAVEVDPDDVNKNTLQARQQTVSALEDKLADYKRRMADAVSRKKMDTKPTDPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWPERIKEFMEKECPFIKPEVKPGTPTQEVEFLKRNKVYFMNRQDVLDKNHVADIDKLIDYAASGDPTSPDDIESPNAPWVFACAPDRCPPTCIYVAGMAELGAFFSILQDMRSTIMASKTVGTAEEKLKKKSSFYQSYLRRTQSMGIQLDQRIILLYMLEWGKEMVDHFHLGDDMDPELRGLAQALIDQKVKEISNQEPLKI

SEQ ID NO: 388 - protein, 433 aa, Artificial Sequence
  derived and/or modified protein sequence (wt) from PUUV(Baltic/49Cg/00)__AJ314598.1__N
MSDLADIQEDITRHEQQLVVARQKLKDAERAVEVDPDDVNKNTLQARQQTVSALEDKLADYKRRMADAVSRKKMDTKPTDPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWPERIKEFMEKECPFIKPEVKPGTPAQEVEFLKRNKVYFMNRQDVLDKNHVADIDKLIDYAASGDPTSPDDIESPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLAQALIDQKVKEISNQEPLKI

SEQ ID NO: 389 - protein, 433 aa, Artificial Sequence
  derived and/or modified protein sequence (wt) from PUUV(Pallasjarvi/63Cg/98)__AJ314597.1__N
MSDLTDIQEDITRHEQQLVVARQKLKDAERAVEVDPDDVNKNTLQARQQTVSALEDKLADYKRRMADAVSRKKMDTKPTDPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWSERIREFMEKECPFIKPEVKPGTPAQEVEMLKRNKIYFMQRQDVLDKNHVADIDKLIDYAASGDPTSPDNIDSPNAPWVFACAPDRCPPTCIYVAGMAELGAFFSILQDMRNTIMASKTVGTAEEKLKKKSSFYQSYLRRTQSMGIQLDQRIILLFMLEWGKEMVDHFHLGDDMDPELRGLAQALIDQKVKEISNQEPLKI

SEQ ID NO: 390 - protein, 433 aa, Artificial Sequence
  derived and/or modified protein sequence (wt) from PUUV(Sotkamo 2009)__HE801633.1__N
MSDLTDIQEDITRHEQQLIVARQKLKDAERAVEVDPDDVNKNTLQARQQTVSALEDKLADYKRRMADAVSRKKMDTKPTDPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWSERIREFMEKECPFIKPEVKPGTPAQEIEMLKRNKIYFMQRQDVLDKNHVADIDKLIDYAASGDPTSPDNIDSPNAPWVFACAPDRCPPTCIYVAGMAELGAFFSILQDMRNTIMASKTVGTAEEKLKKKSSFYQSYLRRTQSMGIQLDQRIILLFMLEWGKEMVDHFHLGDDMDPELRGLAQALIDQKVKEISNQEPLKI

SEQ ID NO: 391 - protein, 433 aa, Artificial Sequence
  derived and/or modified protein sequence (wt) from PUUV(CG 13891)__U22423.1__N
MSDLTDIQEDITRHEQQLVVARQKLKDAEKAVEMDPDDVNKNTLQARQQTVSALEDKLADFKRQMADAVSRKKMDTKPTDPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWADRIRESMEKECPFLKPDVKPGTPAQETEFLKRNKIYFMQRQEVLDKNHVAEIDKLIDYAASGDPTSPDNIESPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLAQALIDQKVKEISNQEPLKI

SEQ ID NO: 392 - protein, 433 aa, Artificial Sequence
  derived and/or modified protein sequence (wt) from PUUV(CG1820)__M32750.1__N
MSDLTDIQEEITRHEQQLVVARQKLKDAERAVEVDPDDVNKSTLQARQQTVSALEDKLADYKRRMADAVSRKKMDTKPTDPTGIEPDDHLKERSSLRYGNVLDVNAIDIEEPSGQTADWYTIGVYVIGFTIPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWPEKIREFMEKECPFIKPEVKPGTPAQEVEFLKRNRVYFMTRQDVLDKNHVADIDKLIDYAASGDPTSPDDIESPNAPWVFACAPDRCPPTCIYVAGMAELGAFFSILQDMRNTIMASKTVGTAEEKLKKKSSFYQSYLRRTQSMGIQLDQRIILLYMLEWGREMVDHFHLGDDMDPELRGLAQSLIDQKVKEISNQEPLKI

SEQ ID NO: 393 - protein, 433 aa, Artificial Sequence
  derived and/or modified protein sequence (wt) from PUUV(Bussjo_95-1)__AM746297.1__N
MSDLTDIQEDITRHEQQLVVARQKLKDAEKAVEMDPDDVNKNTLQARQQTVSALEDKLADFKRRMADAVSRKKMDTKPTDPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWPDRIREFMEKECPFIKPEVKPGTPTQEIEFLKKNKVYFMDRQNVLDKNHVADIDKLIDYAASGDPTSPDNIESPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLAQALIDQKVKEISNQDPLKI

SEQ ID NO: 394 - protein, 433 aa, Artificial Sequence
  derived and/or modified protein sequence (wt) from PUUV(CG144)__AF367064.1__N
MSDLTDIQEDITRHEQQLVAARQKLKDAERAVEMDPDDVNKNTLQARQQTVSALEDKLADYKRRMADAVSRKKMDTKPADPTGIEPDDHLKERSSLRYGNVLDVNAIDIEEPSGQTADWYTIGIYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWPERIREFMEKECPFIKPEVKPGTPAQEIEMLKKNKIYFMHRQDVLDKNHVADIDKLIDYAASGDPTSPDNIDSPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLAQALIDQKVKEISNQEPLKI

SEQ ID NO: 395 - protein, 433 aa, Artificial Sequence
  derived and/or modified protein sequence (wt) from PUUV(CG168)__AF367065.1__N
MSDLTDIQEDITRHEQQLVAARQKLKDAERAVEMDPDDVNKNTLQARQQTVSALEDKLADYKRRMADAVSRKKMDTKPADPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWPERIREFMEKECPFIKPEVKPGIPAQEIEMLKKNKIYFMHRQDVLDKNHVADIDKLIDYAASGDPTSPDNIDSPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLAQALIDQKVKEISNQEPLKI

SEQ ID NO: 396 - protein, 433 aa, Artificial Sequence
  derived and/or modified protein sequence (wt) from PUUV(CG17/Baskiria-2001)__AF442613.1__N
MSDLADIQEEITRHEQQLVAARQKLKDAERAVEVDPDDVNKNTLQARQQTVSALEDKLADYKRRMADAVSRKKMDTKPTDPTGIEPDDHLKERSSLRYGNVLDVNAIDIEEPSGQTADWYTIGVYVIGFTIPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWPEKIREFMEKECPFIKPEVKPGTPAQEVEFLKRNRVYFMTRQDVLDKNHVADIDKLIDYAASGDPTSPDDIESPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLAQSLIDQKVKEISNQEPLKI

SEQ ID NO: 397 - protein, 433 aa, Artificial Sequence
  derived and/or modified protein sequence (wt) from PUUV(CG215)__AF367066.1__N
MSDLTDIQEDITRHEQQLVAARQKLKDAERAVEMDPDDVNKNTLQARQQTVSALEDKLADYKRRMADAVSRKKMDTKPADPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWPERIREFMEKECPFIKPEVKPGTPAQEIEMLKKNKIYFMHRQDVLDKNHVADIDKLIDYAASGDPTSPDNIDSPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLAQTLIDQKVKEISNQEPLKI

SEQ ID NO: 398 - protein, 433 aa, Artificial Sequence
  derived and/or modified protein sequence (wt) from PUUV(CG315)__AF367068.1__N
MSDLTDIQEDITRHEQQLVAARQKLKDAERAVEMDPDDVNKNTLQARQQTVSALEDKLADYKRRMADAVSRKKMDTKPADPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWPERIREFMEKECPFMKPEVKPGTPAQEIEMLKKNKIYFMHRQDVLDKNHVADIDKLIDYAASGDPTSPDNIDSPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLAQALIDQKVKEISNQEPLKI

SEQ ID NO: 399 - protein, 433 aa, Artificial Sequence
  derived and/or modified protein sequence (wt) from PUUV(CRF161)__AF367069.1__N
MSDLTDIQEDITRHEQQLVAARQKLKDAERAVEMDPDDVNKNTLQARQQTVSALEDKLADYKRRMADAVSRKKMDTKPADPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWPERIREFMEKECPFIKPEVKPGTPAQEIEMLKKNKIYFMHRQDVLDKNHVADIDKLIDYAASGDPTSPDNIDSPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLAQALIDQKVKEISNQEPLKI

SEQ ID NO: 400 - protein, 433 aa, Artificial Sequence
  derived and/or modified protein sequence (wt) from PUUV(CRF308)__AF367070.1__N
MSDLTDIQEDITRHEQQLVAARQKLKDAERAVEMDPDDVNKNTLQARQQTVSALEDKLADYKRRMADAVSRKKMDTKPADPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWPERIREFMEKECPFIKPEVKPGTPAQEIEMLKKNKIYFMHRQDVLDKNHVADMDKLIDYAASGDPTSPDNIDSPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLAQALIDQKVKEISNQEPLKI

SEQ ID NO: 401 - protein, 433 aa, Artificial Sequence
  derived and/or modified protein sequence (wt) from PUUV(CRF366)__AF367071.1__N
MTDLTDIQEDITRHEQQLVAARQKLKDAERAVEMDPDDVNKNTLQARQQTVSALEDKLADYKRRMADAVSRKKMDTKPADPTGIEPDDHLKERSSLRYGNVLDVNAIDIEEPSGQTADWYTIGIYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWPERIREFMEKECPFIKPEVKPGTPAQEIEMLKKNKIYFMHRQDVLDKNHVADIDKLIDYAASGDPTSPDNIDSPNTPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLAQALIDQKVKEISNQEPLKI

SEQ ID NO: 402 - protein, 433 aa, Artificial Sequence
  derived and/or modified protein sequence (wt) from PUUV(Djaknebole_98-1)__AM746310.1__N
MSDLTDIQEDITRHEQQLVVARQKLKDAEKAVEMDPDDVNKNTLQARQQTVSALEDKLADFKRRMADAVSRKKMDTKPTDPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWADRIREFMEKECPFIKPEVKPGTPTQEIEFLKKNKVYFMDRQNVLDKNHVADIDKLIDYAASGDPTSPDNIESPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLAQALIDQKVKEISNQDPLKI

SEQ ID NO: 403 - protein, 433 aa, Artificial Sequence
  derived and/or modified protein sequence (wt) from PUUV(Fusong 114-05)__EF488804.1__N
MSDLKDIQEDIARHEQQLVVARQKLRDAEKAVEMDPDDVNKNTLQARQQTVSALEDKIADFKRRMADIVSRKKMDTKPADPTGIEPDDHLKERSSLRYGNVLDVNAIDIEEPSGQTADWYTIGVYIIEFTLPIILKALYMLSTRGRQTAKENKGTRIRFKDDTSFEDVNGIRRPKHLYVSMPTAQSTMKAEELTPGRFRTIVCGLFPTQIQVRNIMSPVMGVIGFSFFAKDWPDRIKEFMEKECPFIKPEVKPGTPAKEVEILKRNKIYFMQRQGVLDKNHVPDIDKLIDYAASGDPTSPRNIDSPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRSLAQALIDQKVKEISNQEPLKI

SEQ ID NO: 404 - protein, 433 aa, Artificial Sequence
  derived and/or modified protein sequence (wt) from PUUV(Fusong 199-05)__EF488803.1__N
MSDLKDIQEDIARHEQQLVAARQKLRDAEKAVEMDPDDVNKNTLQARQQTVSALEDKIADFKRRMADIVSRKKMDTKPADPTGIEPDDHLKERSSLRYGNVLDVNAIDIEEPSGQTADWYTIGVYIIGFTLPIILKALYMLSTRGRQTVKENKGTRIRFKDDTSFEDVNGIRRPKHLYVSMPTAQSTMKAEELTPGRFRTIVCGLFPTQIQVRNIMSPVMGVIGFSFFAKDWPDRIKEFMEKECPFIKPEVKPGTPAKEVEILKRNKIYFMQRQDVLDKNHVPDIDKLIDYAASGDPTSPENIDSPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRSLAQALIDQKVKEISNQEPLKI

SEQ ID NO: 405 - protein, 433 aa, Artificial Sequence
  derived and/or modified protein sequence (wt) from PUUV(Fusong 200-05)__EF211820.1__N
MSDLKDIQEDIARHEQQLVVARQKLRDAEKAVEMDPDDVNKNTLQARQQTVSALEDKIADFKRRMADIVSRKKMDTKPADPTGIEPDDHLKERSSLRYGNVLDVNAIDIEEPSGQTADWYTIGVYIIGFTLPIILKALYMLSTRGRQTVKENKGTRIRFKDDTSFEDVNGIRRPKHLYVSMPTAQSTMKAEELTPGRFRTIVCGLFPTQIQVRNIMSPVMGVIGFSFFAKDWPDRIKEFMEKECPFIKPEVKPGTPAKEVEILKRNKIYFMQRQDVLDKNHVPDIDKLIDYAASGDPTSPENIDSPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRSLAQALIDQKVKEISNQEPLKI

SEQ ID NO: 406 - protein, 433 aa, Artificial Sequence
  derived and/or modified protein sequence (wt) from PUUV(Fusong 900-06)__EF488806.1__N
MSDLKDIQEDIARHEQQLVVARQKLRDAEKAVEMDPDDVNKNTLQARQQTVSALEDKIADFKRRMADIVSRKKMDTKPADPTGIEPDDHLKERSSLRYGNVLDVNAIDIEEPSGQTADWYTIGVYIIGFTLPIILKALYMLSTRGRQTVKENKGTRIRFKDDTSFEDVNGIRRPKHLYVSMPTAQSTMKAEELTPGRFRTIVCGLFPTQIQVRNIMSPVMGVIGFSFFAKDWPDRIKEFMEKECPFIKPEVKPGTPAKEVEILKRNKIYFMQRRDVLDKNHVPDIDKLIDYAASGDPTSPENIDSPNAPWVFACAPDRCPPTCIYVAGMAELGAFFSILQDMRNTIMASKTVGTAEEKLKKKSSFYKSYLRRTQSMGIQLDQRIILLYMLEWGKEMVDHFHLGDDMDPELRSLAQALIDQKVKEISNQEPLKI

SEQ ID NO: 407 - protein, 433 aa, Artificial Sequence
  derived and/or modified protein sequence (wt) from PUUV(Gumboda_98-2)__AM746316.1__N
MSDLTDIQEDITRHEQQLVVARQKLKDAEKAVEMDPDDVNKNTLQARQQTVSALEDKLADFKRRMADAVSRKKMDTKPTDPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWADRIREFMEKECPFIKPEVKPGTPTQEIEFLKKNKVYFMDRQNVLEKNHVADIDKLIDYAASGDPTSPDNIESPNAPWVFSCAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLAQALIDQKVKEISNQDPLKI

SEQ ID NO: 408 - protein, 433 aa, Artificial Sequence
  derived and/or modified protein sequence (wt) from PUUV(Gumboda_98-4)__AM746318.1__N
MSDLTDIQEDITRHEQQLVVARQKLKDAEKAVEMDPDDVNKNTLQARQQTVSALEDKLADFKRRMADAVSRKKMDTKPTDPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWADRIREFMEKECPFIKPEVKPGTPTQEIEFLKKNKVYFMDRQNVLDKNHVADIDKLIDYAASGDPTSPDNIESPNAPWVFSCAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLAQALIDQKVKEISNQDPLKI

SEQ ID NO: 409 - protein, 433 aa, Artificial Sequence
  derived and/or modified protein sequence (wt) from PUUV(Kamiiso-8Cr-95)__AB010730.1__N
MSDLKDIQEDITRHEQQLVVARQKLRDAEKAVEMDPDDVNKNTLQARQQTVSALEDKLADFKRRMADVVSRKKMDTKPADPTGIEPDDHLKERSSLRYGNVLDVNAIDIEEPSGQTADWYTIGVYIIGFTLPIILKALYMLSTRGRQTVKENKGTRIRFKDDTSFEDINGIRRPKHLYVSMPTAQSTMKAEEITPGRFRTIVCGLFPTQIQVRNIMSPVMGVIGFSFFVKDWPERIKEFMEKECPFIKPEVKPGTPAKEVEILKRNKVYFMQRQDVLDKNHVPDIDKLIDYAASGDPTSPDNIDSPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLAQALIDQKVKEISNQEPLKI

SEQ ID NO: 410 - protein, 433 aa, Artificial Sequence
  derived and/or modified protein sequence (wt) from PUUV(Mu/07/1219)__KJ994776.1__N
MSDLTDIQEDITRHEQQLVVARQKLKDAEKAVEMDPDDVNKNTLQARQQTVSALEDKLADYKRRMADAVSRKKMDTKPTDPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWAERIREFMEKECPFIKPEVKPGTPAQEAEFLKRNKVYFMQRQDVLDKNHVADIDKLIDYAASGDPTSPDNIESPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLAQALIDQKVKEISNQEPLKI

SEQ ID NO: 411 - protein, 433 aa, Artificial Sequence
  derived and/or modified protein sequence (wt) from PUUV(Opina916)__AF294652.1__N
MSDLTDIQEDITRHEQQLVVARQKLKDAEKAVEMDPDDVNKNTLQARQQTVSALEDKLADFKRRMADAVSRKKMDTKPVDPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWAERIREFMEKECPFIKPEVKPGTPAQEAEFLKKNRIYFMQRQEVLDKNHVADIDKLIDYAASGDPTSPDNIESPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLAQALIDQKVKEISNQEPLKI

SEQ ID NO: 412 - protein, 433 aa, Artificial Sequence
  derived and/or modified protein sequence (wt) from PUUV(Palbole_98-1)__AM746327.1__N
MSDLTDIQEDITCHEQQLVVARQKLKDAEKAVEMDPDDVNKNTLQARQQTVSALEDKLADFKRRMADAVSRKKMDTKPTDPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWADRIREFMEKECPFIKPEVKPGTPTQEIEFLKKNKVYFMDRQNVLDKNHVADIDKLIDYAASGDPTSPDNIESPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLAQALIDQKVKEISNQDPLKI

SEQ ID NO: 413 - protein, 433 aa, Artificial Sequence
  derived and/or modified protein sequence (wt) from PUUV(Palbole_98-2)__AM746328.1__N
MSDLTDIQEDITRHEQQLVVARQKLKDAEKAVEMDPDDVNKNTLQARQQTVSALEDKLADFKRRMADAVSRKKMDTKPTDPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWADRIREFMEKECPFIKPEVKPGTPTQEIEFLKKNKVYFMDRQNVLDKNHVADIDKLIDYAASGDPTSPDNIESPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGFAQALIDQKVKEISNQDPLKI

SEQ ID NO: 414 - protein, 433 aa, Artificial Sequence
  derived and/or modified protein sequence (wt) from PUUV(Palbole_98-3)__AM746329.1__N
MSDLTDIQEDITRHEQQLVVARQKLKDAEKAVEMDPDDVNKNTLQARQQTVSALEDKLADFKRRMADAVSRKKMDTKPTDPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWADRIREFMEKECPFIKPEVKPGTPTQEIEFLKKNKVYFMDRQNVLDKNHVADIDKLIDYAASGDPTSPDSIESPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLAQALIDQKVKEISNQDPLKI

SEQ ID NO: 415 - protein, 433 aa, Artificial Sequence
  derived and/or modified protein sequence (wt) from PUUV(PUUV/Ardennes/Mg156/2011)__KT247592.1__N
MSDLTDIQEDITRHEQQLVVARQKLKDAEKAVEMDPDDVNKNTLQARQQTVSALEDKLADFKRQMADAVSRKKMDTKPTDPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWADRIREFMEKECPFIKPEVKPGTPAQEVEFLKRNKIYFMQRQDVLDKNHVADIDKLIDYAASGDPTSPDNIEAPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLAQALIDQKVKEISNQEPLKI

SEQ ID NO: 416 - protein, 433 aa, Artificial Sequence
  derived and/or modified protein sequence (wt) from PUUV(PUUV/Jelgava/Mg136/2008)__JN657230.1__N
MSDLADIQEDITRHEQQLVVARQKLKDAERAVEVDPDDVNKNTLQARQQTVSALEDKLADYKRRMADAVSRKKMDTKPADPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTVVCGLFPTQIQVRNIMSPVMGVIGFSFFVKDWPDRIKEFMEKESPFIKPDVKPGTPAQEVEFLKRNKVYFMNRQDVLDKNHVADIDKLIDYAASGDPTSPDDIESPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLAQALIDQKVKEISNQEPLKI

SEQ ID NO: 417 - protein, 433 aa, Artificial Sequence
  derived and/or modified protein sequence (wt) from PUUV(PUUV/Jelgava/Mg140/2008)__JN657231.1__N
MSDLADIQEDITRHEQQLVVARQKLKDAERAVEVDPDDVNKNTLQARQQTVSALEDKLADYKRRMADAVSRKKMDTKPADPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTVVCGLFHTQIQVRNIMSPVMGVIGFSFFVKDWPDRIKEFMEKECPFIKPDVKPGTPAQEVEFLKRNKVYFMNRQDVLDKNHVADIDKLIDYAASGDPTSPDDIESPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLAQALIDQKVKEISNQEPLKI

SEQ ID NO: 418 - protein, 433 aa, Artificial Sequence
  derived and/or modified protein sequence (wt) from PUUV(PUUV/Jura/Mg2/2010)__KT247596.2__N
MSDLTDIQEDITRHEQQLVVARQKLKDAEKAVEMDPDDVNKNTLQARQQTVSALEDKLADFKRRMADAVSRKKMDTKPTDPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWADRIREFMEKECPFIKPEIKPGTPAQEAEFLKRNKIYFMQRQDVLDKNHVADIDKLIDYAASGDPTSPDNIESPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLAQALIDQKVKEISNQEPLKI

SEQ ID NO: 419 - protein, 433 aa, Artificial Sequence
  derived and/or modified protein sequence (wt) from PUUV(PUUV/Madona/Mg233/2008)__JN657232.1__N
MSDLADIQEDITRHEQQLVVARQKLKDAERAVEVDPDDVNKNTLQARQQTVSALEDKLADYKRRMADAVSRKKMDTKPTDPTGIEPDDHLKERSSLRYGNVLDVNAIDIEEPSGQTADWYTIGVYVISFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWPDRIKEFMEKECPFIKPDVKPGTPAQEIEFLKRNKVYFMNRQDVLDKNHVADIDKLIDYAASGDPTSPDDIESPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLAQALIDQKVKEISNQEPLKI

SEQ ID NO: 420 - protein, 433 aa, Artificial Sequence
  derived and/or modified protein sequence (wt) from PUUV(PUUV/Orleans/Mg23/2010)__KT247594.1__N
MSDLTDIQEVITRHEQQLVVARQKLKDAEKAVEMDPDDVNKNTLQARQQTVSALEDKLADFKRRMADAVSRKKMDTKPADPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWADRIKEFMEKECPFIKPEVKPGTPVKEAEFLKKNRVYFMQRQDVLDKNHVADIDKLIDYAAAGDPTSPDNIESPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLAQALIDQKVKEISNQEPLKI

SEQ ID NO: 421 - protein, 433 aa, Artificial Sequence
  derived and/or modified protein sequence (wt) from PUUV(Tobetsu-60Cr-93)__AB010731.1__N
MSDLKDIQEDITRHEQQLVVARQKLRDAEKAVEMDPDDVNKNTLQARQQTVSALEDKLADFKRRMADVVSRKKMDTKPADPTGIEPDDHLKDRSSLRYGNVLDVNAIDIEEPSGQTADWYTIGVYIIGFTLPIILKALYMLSTRGRQTVKENKGTRIRFKDDTSFEDINGIRRPKHLYVSMPTAQSTMKAEEITPGRFRTIVCGLFPTQIQVRNIMSPVMGVIGFSFFVKDWPERIKEFMEKECPFIKPEVKPGTPAKEVEILKRNKVYFMQRQDVLDKNHVPDIDKLIDYAASGDPTSPDNIDSPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLAQALIDQKVKEISNQEPLKI

SEQ ID NO: 422 - protein, 433 aa, Artificial Sequence
  derived and/or modified protein sequence (wt) from PUUV(Vranica)__U14137.1__N
MSDLTDIQEDITRHEQQLVVARQKLKDAEKAVEMYPDDVNKNTLQARQQTVSALEDKLADFKRRMADAVSRKKMDTKPTDPTGIEPDDHLKERSSLRYGNVLDVNAIDIEEPSGQTADWYTIGVYVIGFTLPIILKALYMLSTRGRQTVKENKGTRYRFKDDTSFEDINGIRRPKHLYVSMPTAQSTMKAEELTPGRFRTIVCGLFPTQIQVRNIMSPVMGVIGFSFFVKDWADRIREFMEKECPFIKPEVKPGTPTQEIEFLKKNKVYFMDRQNVLDKNHVADIDKLIDYAASGDPTSPDNIESPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLAQALIDQKVKEISNQDPLKI

SEQ ID NO: 423 - protein, 433 aa, Artificial Sequence
  derived and/or modified protein sequence (wt) from PUUV(P360)__L11347.1__N
MSDLTDIQEEITRHEQQLVVARQKLKDAERAVEVYPDDVNKNTLQARQQTVSALEDKLADYKRRMADAVSRKKMDTKPTDPTGIEPDDHLKERSSLRYGNVLDVNAIDIEEPSGQTADWYTIGVYVIGFTIPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWPEKIREFMEKECPFIKPEVKPGTPAQEVEFLKRNRVYFMTRQDVLDKNHVADIDKLIDYAASGDPTSPDDIESPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLAQSLIDQKVKEISNQEPLKI

SEQ ID NO: 424 - protein, 433 aa, Artificial Sequence
  derived and/or modified protein sequence (wt) from PUUV(Aijajarvi/Mg7/05)__GQ339476.1__N
MSDLTDIQEDITRHEQQLVVARQKLKDAEKAVEMDPDDVNKNTLQARQQTVSALEDKLADFKRQMADAVSRKKMDTKPTDPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKGWADRIREFMEKECPFIKPEVKPGTPTQEVEFLKKNKVYFLDRQNVLDKNHVADIDKLIDYAASGDPTSPDNIESPNAPWVFACAPDRCPPTCIYVAGMAELGAFFSILQDMRNTIMASKTVGTAEEKLKKKSSFYQSYLRRTQSMGIQLDQRIILLFMLEWGKEMVDHFHLGDDMDPELRGLAQALIDQKVKEISNQEPLKI

SEQ ID NO: 425 - protein, 433 aa, Artificial Sequence
  derived and/or modified protein sequence (wt) from PUUV(Bavaria 151/05)__EU439968.1__N
MSDLTDIQEDITRHEQQLVVARQKLKDAEKAVEMDPDDVNKNTLQARQQTVSALEDKLADYKRRMADAVSRKKMDTKPTDPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWAERIREFMEKECPFLKPEIKPGTPAQEAEFLKKNKVYFMQRQDVLDKNHVADIDKLIDYAASGDPTSPDNIESPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLAQALIDQKVKEISNQEPLKI

SEQ ID NO: 426 - protein, 433 aa, Artificial Sequence
  derived and/or modified protein sequence (wt) from PUUV(Bavaria 159/05)__EU439972.1__N
MSDLTDIHEDITRHEQQLVVARQKLKDAEKAVEMDPDDVNKNTLQARQQTVSALEDKLADYKRRMADAVSRKKMDTKPTDPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWAERIREFMEKECPFIKPEIKPGTPAQEAEFLKRNKVYFMQRQDVLDKNHVADIDKLIDYAASGDPTSPDNIESPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLAQALIDQKVKEISNQEPLKI

SEQ ID NO: 427 - protein, 432 aa, Artificial Sequence
  derived and/or modified protein sequence (wt) from PUUV(Bavaria CG 33/04)__DQ016430.2__N
MSDLTDIQEDITRHEQQLVVARQKLKDAEKAVEMDPDDVNKNTLQARQQTVSALEDKLADYKRRMADAVSRKKMDTKPTDPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWAERIREFMEKECPFIKPEIKPGTPAQEAEFLKRNKVYFMQRQDVLDKNHVADIDKLIDYAASGDPTSPDNIESPNAPWVFACAPDRCPPTCIYVAGMAELGAFSILQDMRNTIMASKTVGTAEEKLKKKSSFYQSYLRRTQSMGIQLDQRIILLYMLEWGKEMVDHFHLGDDMDPELRGLAQALIDQKVKEISNQEPLKI

SEQ ID NO: 428 - protein, 433 aa, Artificial Sequence
  derived and/or modified protein sequence (wt) from PUUV(Bavaria CG 34/04)__AY954723.2__N
MSDLTDIQEDITRHEQQLVVARQKLKDAGKAVEMDPDDVNKNTLQARQQTVSALEDKLADYKRRMADAVSRKKMDTKPTDPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWAERIREFMEKECPFIKPEMKPGTPAQEAEFLKRNKVYFMQRQDVLDKNHVADIDKLIDYAASGDPTSPDNIESPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLAQALIDQKVKEISNQEPLKI

SEQ ID NO: 429 - protein, 433 aa, Artificial Sequence
  derived and/or modified protein sequence (wt) from PUUV(Bavaria CG 41/04)__DQ016432.2__N
MSDLTDIQEDITRHEQQLVVARQKLKDAEKAVEMDPDDVNKNTLQARQQTVSALEDNLADYKRRMADAVSRKKMDTKPTDPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWAERIREFMEKECPFIKPEMKPGTPAQEAEFLKRNKVYFMQRQDVLDKNHVADIDKLIDYAASGDPTSPDNIESPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLAQALIDQKVKEISNQEPLKI

SEQ ID NO: 430 - protein, 433 aa, Artificial Sequence
  derived and/or modified protein sequence (wt) from PUUV(Bavaria CG 9/04)__AY954722.2__N
MSDLTDIQEDITRHEQQLVVARQKLKDAEKAVEMDPDDVNKNTLQARQQTVSALEDKLADYKRRMADAVSRKKMDTKPTDPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWAERIREFMEKECPFIKPEMKPGIPAQEAEFLKRNKVYFMQRQDVLDKNHVADIDKLIDYAASGDPTSPDNIESPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLAQALIDQKVKEISNQEPLKI

SEQ ID NO: 431 - protein, 433 aa, Artificial Sequence
  derived and/or modified protein sequence (wt) from PUUV(Bergsjobo/Mg25/05)__GQ339483.1__N
MSDLADIQDEITRHEQQLVAARQKLKDAERAVEVDPDDVNKNTLQARQQTVSALEDKLADFKRRMADAVSRKKMDTKPTDPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWAERIREFMEKECPFIKPEVKPGTPAQEVEFLKKNKIYFMQRQDVLDKNHVADIDKLIDYAASGDPTSPDNIESPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLAQALIDQKVKEISNQEPLKI

SEQ ID NO: 432 - protein, 433 aa, Artificial Sequence
  derived and/or modified protein sequence (wt) from PUUV(CG14444)__AJ277075.1__N
MSDLTDIQEDITRHEQQLVVARQKLKDAEKAVEMDPDDVNKNTLQARQQTVSALEDKLADFKRQMADAVSRKKMDTKPTDPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWADRIREFMEKECPFIKPEVKPGTPAQEAEFLKRNKIYFMQRQEVLDKNHVADIDKLIDYAASGDPTSPDNIEAPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLAQALIDQKVKEISNQEPLKI

SEQ ID NO: 433 - protein, 433 aa, Artificial Sequence
  derived and/or modified protein sequence (wt) from PUUV(CG14445)__AJ277076.1__N
MSDLTDIQEDITRHEQQLVVARQKLKDAEKAVEMDPDDVNKNTLQARQQTVSALEDKLADFKRQMADAVSRKKMDTKPTDPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWADRIREFMEKECPFIKPEVKPGTPAQEAEFLKRNIIYFMQRQEVLDKNHVADIDKLIDYAASGDPTSPDNIEAPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLAQALIDQKVKEISNQEPLKI

SEQ ID NO: 434 - protein, 433 aa, Artificial Sequence
  derived and/or modified protein sequence (wt) from PUUV(CG1820/POR)__KT885052.1__N
MSDLTDIQEEITRHEQQLVVARQKLKDAERAVEVDPDDVNKSTLQARQQTVSALEDKLADYKRRMADAVSRKKMDTKPTDPTGIEPDDHLKERSSLRYGNVLDVNAIDIEEPSGQTADWYTIGVYVIGFTIPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWPEKIREFMEKECPFIKPEVKPGTPAQEVEFLKRNRVYFMTRQDVLDKNHVADIDKLIDYAASGDPTSPDDIESPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLAQSLIDQKVKEISNQEPLKI

SEQ ID NO: 435 - protein, 433 aa, Artificial Sequence
  derived and/or modified protein sequence (wt) from PUUV(Couvin/59Cg/97)__AJ277034.1__N
MSDLTDIQEDITRHEQQLVVARQKLKDAEKAVEMDPDDVNKNTLQARQQTVSALEDKLADFKRQMADAVSRKKMDTKPTDPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWADRIREFMEKECPFIKPEVKPGTPAQEAEFLKRNKIYFMQRQDVLDKNHVADIDKLIDYAASGDPTSPDNIEAPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLAQALIDQKVKEISNQEPLKI

SEQ ID NO: 436 - protein, 433 aa, Artificial Sequence
  derived and/or modified protein sequence (wt) from PUUV(Evo/12Cg/93)__Z30702.1__N
MSDLTDIQEDITRHEQQLVVARQKLKDAERAVEVDPDDVNKNTLQARQQTVSALEDKLADYKRRMADAVSRKKMDTKPTDPTGIEPDDHLKERSSLRYGNVLDVNAIDIEEPSGQTADWYTIGVYVIGFTIPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWPERIREFMEKECPFIKPEIKPGTPAQEMEMLKRNKIYFMQRQDVLDKNHVADIDKLIDYAASGDPTSPDNIDSPNAPWVFACAPDRCPPTCIYVAGMAELGAFFSILQDMRNTIMASKTVGTAEEKLRKKSSFYQSYLRRTQSMGIQLDQRIILLFMLEWGKEMVDHFHLGDDMDPELRGLAQALIDQKVKEISNQEPLKI

SEQ ID NO: 437 - protein, 433 aa, Artificial Sequence
  derived and/or modified protein sequence (wt) from PUUV(Evo/14Cg/93)__Z30704.1__N
MSDLTDIQEDITRHEQQLVVARQKLKDAERAVEVDPDDVNKNTLQARQQTVSALEDKLANYKRRMADAVSRKKMDTKPTDPTGIEPDDHLKERSSLRYGNVLDVNAIDIEEPSGQTADWYTIGVYVIGFTIPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWPERIREFMEKECPFIKPEIKPGTPAQEMEMLKRNKIYFMQRQDVLDKNHVADIDKLIDYAASGGPTSPDNIDSPNAPWVFACAPDRCPPTCIYVAGMAELGAFFSILQDMRNTIMASKTVGTAEEKLKKKSSFYQSYLRRTQSMGIQLDQRIILLFMLEWGKEMVDHFHLGDDMDPELRGLAQALIDQKVKEISNQEPLKI

SEQ ID NO: 438 - protein, 433 aa, Artificial Sequence
  derived and/or modified protein sequence (wt) from PUUV(Evo/15Cg/93)__Z30705.1__N
MSDLTDIQEDITRHEQQLVVARQGLKDAERAVEVDPDDVNKNALQARQQTVSALEDKLADYKRRMADAVSRKKMDTKPTDPTGIEPDDHLKERSSLRYGNVFDVNAIDIEEPSGQTADWYTIGVYVIGFTIPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWPERIREFMEKECPFIKPEIKPGTPAQEMEMLKRNKIYFMQRQDVLDKNHVADIDKLIDYAASGDPTSPDNIDSPNAPWVFACAPDRCPPTCIYVAGMAELGAFFSILQDMRNTIMASKTVGTAEEKLKKKSSFYQSYLRRTQSMGIQLDQRIILLFMLEWGKEMVDHFHLGDDMDPELRGLAQALIDQKVKEISNQEPLKI

SEQ ID NO: 439 - protein, 433 aa, Artificial Sequence
  derived and/or modified protein sequence (wt) from PUUV(Faboviken/Mg26/05)__GQ339484.1__N
MSDLADIQDEITRHEQQLVAARQKLKDAERAVEMDPDDVNKNTLQARQQTVSALEDKLADFKRRMADAVSRKKMDTKPTDPTGIEPDDHLKEISSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWAERIREFMEKECPFIKPEVKPGTPAQEVEFLKKNKIYFMQRQDVLDKNHVADIDKLIDYAASGDPTSPDNIESPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLAQALIDQKVKEISNQEPLKI

SEQ ID NO: 440 - protein, 433 aa, Artificial Sequence
  derived and/or modified protein sequence (wt) from PUUV(Fyn)__AJ238791.1__N
MSDLTDIQEDITRHEQQLVVARQKLKDAEKAVEMDPDDVNKNTLQARQQTVSALEDKLADFKRRMADAVSRKKMDTKPTDPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWAERIREFMEKECPFIKPELKPGTNAQEAEFLKKNRVYFLNRQDVLDKNHVADIDKLIDYAASGDPTSPDNIEAPNAPWVFSCAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLAQALIDQKVKEISNQEPLKI

SEQ ID NO: 441 - protein, 433 aa, Artificial Sequence
  derived and/or modified protein sequence (wt) from PUUV(Fyn131)__AJ278093.1__N
MSDLTDIQEDITRHEQQLVVARQKLKDAEKAVEMDPDDVNKNTLEARQQTVSALEDKLADFKRRMTDAVSRKKMDTKPTDPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAPSTMKAEELTPGRFRTIVCGLFPTQIQVRNIMSPVMGVIGSSFFVKDWADRIREFMEKECPFVKPELKPGTNAQEAEFLKKNRVYFMNRQDVLDKNHVADIDKLIDYAASGDPTCPDNIEAPNAPWGFACAPHRCPPTCIYVAGMAELGAFFSILQDMRNTIMASKTVGTAEEKLKKKSSFYQSYLRRTQSMGIQLDQRIILLYMLEWGREMVDHFHLGDDMDPELRGLAQALINQKVKEISNQEPLKI

SEQ ID NO: 442 - protein, 433 aa, Artificial Sequence
  derived and/or modified protein sequence (wt) from PUUV(Fyn47)__AJ278092.1__N
MSDLTDIQEDITRHEQQLVVARQKLKDAEKAVEMDPDDVNKNTLQARQQTVSALEDKLADFKRRMADAVSRKKMDTKPTDPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAPSTMKAEELTPGRFRTIVCGLFPTQIQVRKIMSPVMGVIGFSFFVKDWVERIREFMEKECPFVKPELKPGTNAQEAEFLKKNRVYFMNRQDVLDKNHVADIDKLIDYAASGDPTSPDNIEAPNAPWVFACAPHRCPPTCIYVAGMAELGAFFSILQDMRNAIMASKTVGTAEEKLKKKSSFYQSYLRRTQSVGIQLDQRIILLYMLEWGREMVDHFHLGDDMDPELRGLAQALIDQKVKEISNQEPLKI

SEQ ID NO: 443 - protein, 433 aa, Artificial Sequence
  derived and/or modified protein sequence (wt) from PUUV(Gomselga)__AJ238790.1__N
MSDLTDIQEDITRHEQQLVVARQKLKDAERAVEVDPDDVNKNTLQARQQTVSALEDKLADYKRKMADAVSRKKMDTKPTDPTGIEPDDHLKERSSLRYGNVLDVNAIDIEDPSGQTADWYTIGVYVIGFTLPIILKALYMLSTRGRQTVKENKGTRIRFKDDTSFEEINGIRRPKHLYVSMPTAQSTMKAEELTPGRFRTIVCGLFPTQIQVRNIVSPVMGVIGFSFFVKDWSQRITEFMEKECPFIKPEVKPGTPAQEIEMFKRNKIYFMQRQDVLDKNHVADIDKSIDYAASEDPTSPDNIDSPNAPWVFACAPDRCPPTCIYVAGMAELGAFFSILQDMRNTIMASKTVGTAEEKLKKKSSFYQSYLRRTQSMGIQLDQRIILLFMLEWGKEMVDHFHLGDDMDPELRGLAQALIDQKVKEISNQEPLKI

SEQ ID NO: 444 - protein, 433 aa, Artificial Sequence
  derived and/or modified protein sequence (wt) from PUUV(Gyttjea/Mg19/05)__GQ339480.1__N
MSDLTDIQEDITRHEQQLVVARQKLKDAEKAVEMDPDDVNKNTLQARQQTVSALEDKLADFKRQMADAVSRKKMDTKPTDPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFAFFVKGWADRIREFMEKECPFIKPEVKPGTPTQEIEFLKKNKVYFLDRQTVLDKNHVADIDKLIDYAASGDPTSPDNIESPNAPWVFACAPDRCPPTCIYVAGMAELGAFFSILQDMRNTIMASKTVGTAEEKLKKKSSFYQSYLRRTQSMGIQLDQRIILLFMLEWGKEMVDHFHLGDDMDPELRGLAQALIDQKVKEISNQEPLKI

SEQ ID NO: 445 - protein, 433 aa, Artificial Sequence
  derived and/or modified protein sequence (wt) from PUUV(Karhumaki)__AJ238788.1__N
MSDLTDIQEDITRHEQQLVVARQKLKDAERAVEVDPDDVNKNTLQARQQTVSALEDKLADYKRKMADAVSRKKMDTKPTDPTGMKPDVHLKERSSLEYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWSERIREFMEKECPFIKPEVKPGTPAQEIEMLRRNKIYFMQRQDVLDKNHVADIDKLIDLAASGDPTSPDNIDSPNAPWVFACAPVRCPPTCIYVAGMAELGAFFSILQDMRNTIMASKTVGTAEEKLKKKSSFYQSYLRRTQSMGIQLDQRIILLFMLEWGKEMVDHFHLGDDMDPELRGLAQALIDQKVKEISNQEPLKI

SEQ ID NO: 446 - protein, 433 aa, Artificial Sequence
  derived and/or modified protein sequence (wt) from PUUV(Kolodozero)__AJ238789.1__N
MSDLTDIQEDITRHEQQLVVARQKLKDAERAVEVDPDDVNKNTLQARQQTVSALEDKLADYKRRMADAVSRKKMDTKPTDPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLIPTQIQVRNIMSPVMGVIGFSFFVKDWSERIREFMEKECPFIKPEVKPGTSAQEIEMLKRNKIYFMQRQDVLDKNHVADIDKLIDYAASGDPTSPDNIDSPNAPWVFACAPDRCPPTCIYVAGMAELGAFFSILQDMRNTIMASKTVGTAEEKLKKKSSFYQSYLRRTQSMGIPLDQRIILLFMLEWGQEMVDHFHLGDDMDPELRGLAQALIDQKVKEISNQEPLKI

SEQ ID NO: 447 - protein, 433 aa, Artificial Sequence
  derived and/or modified protein sequence (wt) from PUUV(Kuhmo/X11)__GU808825.1__N
MSDLTDIQEDITRHEQQLVVARQKLKDAERAVGVDPDDVNKNTLQARQQTVSALEDKLADYKRRMADAVSRKKMDTKPTDPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWSERIREFMEKECPFIKPEVKPGTPAQEIEMLKRNRIYFMQRQDVLDKNHVADIDKLIDYAASGDPTSPDNIDSPNAPWVFACAPDRCPPTCIYVAGMAELGAFFSILQDMRNTIMASKTVGTSEEKLKKKSSFYQSYLRRTQSMGIQLDQRIILLFMLEWGKEMVDHFHLGDDMDPELRGLAQALIDQKVKEISNQEPLKI

SEQ ID NO: 448 - protein, 433 aa, Artificial Sequence
  derived and/or modified protein sequence (wt) from PUUV(Kuhmo/X5)__GU808824.1__N
MSDLTDIQEDITRHEQQLVVARQKLKDAERAVEVDPDDVNKNTLQARQQTVSALEDKLADYKRRMADAVSRKKMDTKPTDPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWSERIREFMEKECPFIKPEVKPGTPAQEIEMLKRNRIYFMQRQDVLDKNHVADIDKLIDYAASGDPTSPDNIDSPNAPWVFACAPDRCPPTCIYVAGMAELGAFFSILQDMRNTIMASKTVGTAEEKLKKKSSFYQSYLRRTQSMGIQLDQRIILLFMLEWGKEMVDHFHLGDDMDPELRGLAQALIDQKVKEISNQEPLKI

SEQ ID NO: 449 - protein, 433 aa, Artificial Sequence
  derived and/or modified protein sequence (wt) from PUUV(Ljustrask/Mg20/05)__GQ339481.1__N
MSDLTDIQEDITRHEQQLVVARQKLKDAEKAVEMDPDDVNKNTLQARQQTVSALEDKLADFKRQMADAVSRKKMDTKPTDPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFAFFVKGWADRIREFMEKECPFIKPEVKPGTPTQEIEFLKKNKVYFLDRQNVLDKNHVADIDKLIDYAASGDPTSPDNIESPNAPWVFACAPDRCPPTCIYVAGMAELGAFFSILQDMRNTIMASKTVGTAEEKLKKKSSFYQSYLRRTQSMGIQLDQRIILLFMLEWGKEMVDHFHLGDDMDPELRGLAQALIDQKVKEISNQEPLKI

SEQ ID NO: 450 - protein, 433 aa, Artificial Sequence
  derived and/or modified protein sequence (wt) from PUUV(Mangelbo/Mg1/05)__GQ339485.1__N
MSDLTDIQDEITRHEQQLVAARQKLKDAERAVEMDPDDVNKNTLQARQQTVSALEDKLADFKRRMADAVSRKKMDTKPTDPTGIEPDDHLKERSSLRYGDVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWAERIREFMDKECPFIKPEVKPGTPAQEIEFLKKNKIYFMQRQDVLDKNHVADIDKLIDYAASGDPTSPDNIESPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLTQALIDQKVKEISNPEPLKI

SEQ ID NO: 451 - protein, 433 aa, Artificial Sequence
  derived and/or modified protein sequence (wt) from PUUV(Momignies/55Cg/96)__AJ277033.1__N
MSDLTDIQEDITRHEQQLVVARQKLKDAEKAVEMDPDDVNKNTLQARQQTVSALEDKLADFKRQMADAVSRKKMDTKPTDPTGIEPDDHLKERSSLRYGNVLDVNAIDIEEPSGQTADWYTIGVYVIGFTLPIILKALYMLSTRGRQTVKENKGTRIRFKDDTSFEDINGIRRSKHLYVSMPTAQSTMKAEELTPGRFRTIVCGLFPTQIQVRNIMSPVMGVIGFSFFVKDWADRIREFMEKECPFIKPEVKPGTPAQEAEFLKRNKIYFMQRQDVLDKNHVADIDKLIDYAASGDPTSPDNIEAPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLSDDMDPELRGLAQALIDQKVKEISNQEPLKI

SEQ ID NO: 452 - protein, 433 aa, Artificial Sequence
  derived and/or modified protein sequence (wt) from PUUV(Montbliart/23Cg/96)__AJ277031.1__N
MSDLTDIQEDITRHEQQLVVARQKLKDAEKAVEMDPDDVNKNTLQARQQTVSALEDKLADFKRQMADAVSRKKMDTKPTDPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWADRIREFMEKECPFIKPEVKPGTPAQEAEFLRRNKIYFMQRQEVLDKNHVADIDKLIDYAASGDPTSPDNIEAPNAPWVFACAPDRCPPTCIYIAGMAELGAFFSILQDMRNTIMASKTVGTAEEKLKKKSSFYQSYLRRTQSMGIQLDQRIILLYMLEWGKEMVDHFHLGDDMDPELRGLAQALIDQKVKEISNQEPLKI

SEQ ID NO: 453 - protein, 433 aa, Artificial Sequence
  derived and/or modified protein sequence (wt) from PUUV(MuEb10Karlstadt/10)__JN696373.1__N
MSDLTDIQEDITRHEQQLVVARQKLKDAEKAVEMDPDDVNKNTLQARQQTVSALEDKLADYKRRMADAVSRKKMDTKPTDPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWAERIREFMEKECPFIKPEIKPGTPVQEAEFLKRNKVYFMQRQEVLDKNHVADIDKLIDYAASGDPTSPDNIESPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLAQALIDQKVKEISNQEPLKI

SEQ ID NO: 454 - protein, 433 aa, Artificial Sequence
  derived and/or modified protein sequence (wt) from PUUV(MuEb12Lackenberg/10)__JN696374.1__N
MSDLTDIQEDITRHEQQLVVARQKLKDAEKAVEMDPDDVNKNTLQARQQTVSALEDKLADYKRRMADAVSRKKMDTKPTDPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWAERIREFMEKECPFIKPEMKPGTPAQEAEFLKRNKVYFMQRQDVLDKNHVADIDKLIDYAASGDPTSPDNIESPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLAQALIDQKVKEISNQEPLKI

SEQ ID NO: 455 - protein, 433 aa, Artificial Sequence
  derived and/or modified protein sequence (wt) from PUUV(Munga/Mg16/05)__GQ339487.1__N
MSDLTDIQDEITRHEQQLVAARQKLKDAERAVEMDPDDVNKNTLQARQQTVSALEDKLADFKRRMADAVSRKKMDTKPTDPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWAERIREFMEKECPFIKPEVKPGTPAQEIEFLKKNKIYFMQRQDVLDKNHVADIDKLIDYAASGDPTSPDNIESPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLAQALIDQKVKEISNQEPLKI

SEQ ID NO: 456 - protein, 433 aa, Artificial Sequence
  derived and/or modified protein sequence (wt) from PUUV(Munga/Mg2/05)__GQ339486.1__N
MSDLTDIQDEITRHEQQLVAARQKLKDAERAVEMDPDDVNKNTLQARQQTVSALEDKLADFKRRMADAVSRKKMDTKPTDPTGIEPDDHLKERSSLRYGNVLDMNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWAERIREFMEKECPFIKPEVKPGTPAQEIEFLKKNKIYFMQRQDVLDKNHVADIDKLIDYAASGDPTSPDNIESPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLAQALIDQKVKEISNQEPLKI

SEQ ID NO: 457 - protein, 433 aa, Artificial Sequence
  derived and/or modified protein sequence (wt) from PUUV(PUU/Cg-Erft)__AJ238779.1__N
MSDLTDIQEDITRHEQQLVVARQKLKDAEKAVEMDPDDVNKNTLQARQQTVSALEDKLADFKRQMADAVSRKKMDTKPTDPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWADRIKKFMEKECPFIKPEVKPGTPSQEAEFLKMNRIYFMQRQEVLDKNHVADIDKLIDYAASGDPTSPDNIEAPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLAQALIDQKVKEISNQEPLKI

SEQ ID NO: 458 - protein, 433 aa, Artificial Sequence
  derived and/or modified protein sequence (wt) from PUUV(Puu/Kazan)__Z84204.1__N
MSDLTDIQEEITRHEQQLVVARQKLKDAERAVEVDPDDVNKNTLQARQQTVSALEDKLADYKRRMADAVSRKKMDTKPTDPTGIEPDDHLKERSSLRYGNVLDVNAIDIEEPSGQTADWYTIGVYVIGFTIPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWPERIRDFMEKESPFIKPEVKPGTPAQEIEFLKRNRVYFMTRQDVLDKNHVADIDKLIDYAASGDPTSPDDIESPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLAQSLIDQKVKEISNQEPLKI

SEQ ID NO: 459 - protein, 433 aa, Artificial Sequence
  derived and/or modified protein sequence (wt) from PUUV(PUU/Mignovillard/CgY02/2005)__AM695638.1__N
MGDLTDIQEDITRHEQQLVVARQKLKDAEKAVEMDPDDVNKNTLQARQQTVSALEDKLADFKRRMADAVSRKKMDTKPTDPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWTDRIREFMEKECPFIKPEMKPGTPAQEAEFLKRNKIYFMQRQDVLDKNHVADIDKLIDYAASGDPTSPDNIESPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLAQALIDQKVKEISNQEPLKI

SEQ ID NO: 460 - protein, 433 aa, Artificial Sequence
  derived and/or modified protein sequence (wt) from PUUV(PUUV/Croatia_Gerovo/Mg938/2008)__KC676609.1__N
MSDLTDIQEDITRHEQQLVVARQKLKDAEKAVEMDPDDVNKNTLQARQQTVSALEDKLADFKRRMADAVSRKKMDTKPTDPTGIEPDDHLKERSSLRYGNVLDVNAIDIEEPSGQTADWYTIGVYVMGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWSERVRDFMEKECPFIKPEIKPGTPQQEAEFLKRNKVYFMQRQDVLDKNHVADIDKLIDYAASGDPTSPDNIESPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLAQALIDQKVKEISNQEPLKI

SEQ ID NO: 461 - protein, 433 aa, Artificial Sequence
  derived and/or modified protein sequence (wt) from PUUV(PUUV/Croatia_Gerovo/Mg979/2008)__KC676613.1__N
MSDLTDIQEDITRHEQQLVVARQKLKDAEKAVEMDPDDVNKNTLQARQQTVSALEDKLADFKRRMADAVSRKKMDTKPTDPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWSERVRDFMEKECPFIKPEIKPGTPPQEAEFLKRNKVYFMQRQDVLDKNHVADIDKLIDYAASGDPTSPDNIESPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLAQALIDQKVKEISNQEPLKI

SEQ ID NO: 462 - protein, 433 aa, Artificial Sequence
  derived and/or modified protein sequence (wt) from PUUV(PUUV/Konnevesi/Mg_M114B/2005)__JQ319171.1__N
MSDLTDIQEDITRHEQQLVVARQKLKDAERAVEVDPDDVNKNTLQARQQTVSALEDKLADYKRRMADAVSRKKMDTKPTDPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWPERIREFMEKECPFIKPEVKPGTPAQEIEMLKRNKIYFMQRQDVLDKNHVADIDKLIDYAASGDPTSPDNIDSPNAPWVFACAPDRCPPTCIYVAGMAELGAFFSILQDMRNTIMASKTVGTAEEKLKKKSSFYQSYLRRTQSMGIQLDQRIILLFMLEWGKEMVDHFHFGDDMDPELRGLAQALIDQKVKEISNQEPLKI

SEQ ID NO: 463 - protein, 433 aa, Artificial Sequence
  derived and/or modified protein sequence (wt) from PUUV(PUUV/Konnevesi/Mg_M94A/2005)__JQ319163.2__N
MSDLTDIQEDITRHEQQLVVARQKLKDAERAVEVDPDDVNKNTLQARQQTVSALEDKLADYKRRMADAVSRKKMDTKPTDPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWPERIKEFMEKECPFIKPEVKPGTPAQEIEMLKRNKIYFMQRQDVLDKNHVADIDKLIDYAASGDPTSPDNIDSPNAPWVFACAPDRCPPTCIYVAGMAELGAFFSILQDMRNTIMASKTVGTAEEEVKKKSSFYQSYLRRTQSMGIQLDQRIILLFMLEWGKEMVDHFHLGDDMDPELRGLAQAMIDQKVKEISNQEPLKI

SEQ ID NO: 464 - protein, 433 aa, Artificial Sequence
  derived and/or modified protein sequence (wt) from PUUV(PUUV/Konnevesi/Mg_O14B/2005)__JQ319166.1__N
MSDLTDIQEDITRHEQQLVVARQKLKDAERAVEVDPDDVNKNTLQARQQTVSALEDKLADYKRRMADAVSRKKMDTKPTDPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWPERIREFMEKECPFIKPEVKPGTPAQEIEMLKRNKIYFMQRQDVLDKNHVADIDKLIDYAASGDPTSPDNIDSPNAPWVFACAPDRCPPTCIYVAGMAELGAFFSILQDMRNTIMASKTVGTAEEKLKKKSSFYQSYLRRTQSMGIQLDQRIILLFMLEWGKEMVDHFHLGDDMDPELRGLAQALIDQKVKEISNQEPLKI

SEQ ID NO: 465 - protein, 433 aa, Artificial Sequence
  derived and/or modified protein sequence (wt) from PUUV(PUUV/Konnevesi/Mg_O22B/2005)__JQ319168.2__N
MSDLTDIQEDITRHEQQLVVARQKLKDAERAVEVDPDDVNKNTLQARQQTVSALEDKLADYKRRMADAVSRKKMDTKPTDPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWPERIREFMEKECPFIKPEVKPGTPAQEIEMLKRNKIYFMQRQDVLDKNHVADIDKLIDYAASGDPTSPENIDSPNAPWVFACAPDRCPPTCIYVAGMAELGAFFSILQDMRNTIMASKTVGTAEEKLKKKSSFYQSYLRRTQSMGIQLDQRIILLFMLEWGKEMVDHFHLGDDMDPELRGHAQALIDQKVKEISNQEPLKI

SEQ ID NO: 466 - protein, 433 aa, Artificial Sequence
  derived and/or modified protein sequence (wt) from PUUV(PUUV/Konnevesi/Mg_O57A/2005)__JQ319161.2__N
MSDLTDIQEDITRHEQQLVVARQKLKDAERAVEVDPDDVNKNTLQARQQTVSALEDKLADYKRRMADAVSRKKMDTKPTDPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTRIQVRNIMSPVMGVIGFSFFVKDWPERIKEFMEKECSFIKPEVKPGTPAQEIEMLKRNKIYFMQRQDVLDKNHVADIDKLIDYAASGDPTSPDNIDSPNAPWVFACAPDRCPPTCIYVAGMAELGAFFSILQDMRNTIMASKTVGTAEEEVKKKSSFYQSYLRRTQSMGIQLDQRIILLFMLEWGKEMVDHFHLGDDMDPELRGLAQALIDQNVKEISNQEPLKI

SEQ ID NO: 467 - protein, 433 aa, Artificial Sequence
  derived and/or modified protein sequence (wt) from PUUV(PUUV/Konnevesi/Mg_O6B/2005)__JQ319164.1__N
MSDLTDIQEDITRHEQQLVVARQKLKDAERAVEVDPDDVNKNTLQARQQTVSALEDKLADYKRRMADAVSRKKMDTKPTDPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRAIVCGLFPTQIQVRNIMSPVMGVIGFSFFVKDWPERIREFMGKECPFIKPEVKPGTPAQEIEMLKRNKIYFMQRQDVLDKNHVADIDKLIDYAASGDPTSPDNIDSPNAPWVFACAPDRCPPTCIYVAGMAELGAFFSILQDMRNTIMASKTVGTAEEKLKKKSSFYQSYLRRTQSMGIQLDQRIILLFMLEWGKEMVDHFHLGDDMDPELRGLAQALIDQKVKEISNQEPLKI

SEQ ID NO: 468 - protein, 433 aa, Artificial Sequence
  derived and/or modified protein sequence (wt) from PUUV(PUUV/Konnevesi/Mg_O74B/2005)__JQ319170.1__N
MSDLTDIQEDITRHEQQLVVARQKLKDAERAVEVDPDDVNKNTLQARQQTVSALEDKLADYKRRMADAVSRKKMDTKPTDPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWPERIREFMEKECPFIKPEVKPGTPAQEIEMLKRNKIYFMQRQDVLDKNHVADIDKLIDYAASGDPTSPDNIDSPNAPWVFACAPDRCPPTCIYVAGMAELGAFFSILQDMRNTIMASKTVGTVEEKLKKKSSFYQSYLRRTQSMGIQLDQRIILLFMLEWGKEMVDHFHLGDDMDPELRGLAQALIDQKVKEISNQEPLKI

SEQ ID NO: 469 - protein, 433 aa, Artificial Sequence
  derived and/or modified protein sequence (wt) from PUUV(PUUV/Konnevesi/Mg_O78A/2005)__JQ319162.2__N
MSDLTDIQEDITRHEQQLVVARQKLKDAEKAVEVDPDDVNKNTLQARQQTVSALEDKLADYKRRMADAVSRKKMDTKPTDPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWPERIREFMEKECPFIKPEVKPGTPAQEIEMLKRNKIYFMQRQDVLDKNHVADIDKLIDYAASGDPTSPDNIDSPNAPWVLACGPERCPPTCIYVAGMAELGAFFSILQDMRNTIMASKTVGSDEVKLKKKSFFYQYYLRRTHSMGIQLDQRIILLCMLEWGIEMVDHFHLGDDMDPELRGLAQAMIDQKVKEISNQEPLII

SEQ ID NO: 470 - protein, 433 aa, Artificial Sequence
  derived and/or modified protein sequence (wt) from PUUV(PUUV/Mg23/HungaryTR17/00)__FN377822.1__N
MSDLTDIQEDITRHEQQLVVARQKLKDAEKAVEMDPDDVNKNTLQARQQTVSALEDKLADFKRRMADAVSRKKMDTKPTDPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWSERVREFMEKECPFIKPEIKPGTPPQEAEFLKRNKVYFMQRQDVLDKNHVADIDKLIDYAASGDPTSPDNIESPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLAQALIDQKVKEISNQEPLKI

SEQ ID NO: 471 - protein, 433 aa, Artificial Sequence
  derived and/or modified protein sequence (wt) from PUUV(PUUV/Mg9/HungaryTR17/00)__FN377821.1__N
MSDLADIQEDITRHEQQLVVARQKLKDAEKAVEMDPDDVNKNTLQARQQTVSALEDKLADFKRRMADAVSRKKMDTKPTDPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWSERVREFMEKECPFIKPEIKPGTPPQEAEFLKRNKVYFMQRQDVLDKNHVADIDKLIDYAASGDPTSPDNIESPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLAQALIDQKVKEISNQEPLKI

SEQ ID NO: 472 - protein, 433 aa, Artificial Sequence
  derived and/or modified protein sequence (wt) from PUUV(PUUV/NL/Mg1012/2010)__KU314900.1__N
MSDLTDIQEDITRHEQQLVVARQKLKDAEKAVEMDPDDVNKNTLQARQQTVSALEDKLADYKRRMADAVSRKKMDTKPTDPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWPDRIREFMEKECPFIKPEVKPGTPAQEAEFLKRNKVYFMQRQDVLDKNHVADIDKLIDYAASGDPTSPDNIESPNAPWVFACAPDRCPPTCIYVAGMAELGAFFSILQDMRNTIMASKTVGAAEEKLKKKSSFYQSYLRRTQSMGIQLDQRIILLYMLEWGKEMVDHFHLGDDMDPELRGLAQALIDQKVKEISNQEPLKI

SEQ ID NO: 473 - protein, 433 aa, Artificial Sequence
  derived and/or modified protein sequence (wt) from PUUV(PUUV/NL/Mg1439/2011)__KU314901.1__N
MSDLTDIQEDITRHEQQLVVARQKLKDAEKAVEMDPDDVNKNTLQARQQTVSALEDKLADYKRRMADAVSRKKMDTKPTDPTGIEPDDHLKERSSLRYGNVLDVNAIDIEEPSGQTADWYTIGVYVIGFTLPIILKALYMLSTRGRQTVKENKGARIRFKDDTSFEDINGIRRPKHLYVSMPTAQSTMKAEELTPGRFRTIVCGLFPTQIQVRNIMSPVMGVIGFSFFVKDWPDRIREFMERECPFIKPEVKPGTPAQEAEFLKRNKVYFMQRQDVLDKNHVADIDELIDYAASGDPTSPDNIESPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLAQALIDQKVKEISNQEPLKI

SEQ ID NO: 474 - protein, 433 aa, Artificial Sequence
  derived and/or modified protein sequence (wt) from PUUV(PUUV/NL/Mg2/2008)__KU314902.1__N
MSDLTDIQEDITRHEQQLVVARQKLKDAEKAVEMDPDDVNKTTLQARQQTVSALEDKLADFKRQMADAVSRKKMDTKPADPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWADRIREFMEKECPFIKPDVKPGTPAQEAEFLKRNKIYFMQRQEVLDKNHVADIDKLIDYAASGDPTSPDNIESPNSPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLAQALIDQKVEEISNQEPLKI

SEQ ID NO: 475 - protein, 433 aa, Artificial Sequence
  derived and/or modified protein sequence (wt) from PUUV(PUUV/NL/Mg25/2007)__KU314897.1__N
MSDLTDIQEDITRHEQQLVVARQKLKDAEKAVEMDPDDVNKNTLQARQQTVSALEDKLADYKRRMADAVSRKKMDTKPTDPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWPDRIREFMEKECPFIKPEVKPGTPAQEAEFLKRNKVYFMQRQDVLDKNHVADIDKLIDYAASGDPTSPDNIESPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLAQALIDQKVKEISNQEPLKI

SEQ ID NO: 476 - protein, 433 aa, Artificial Sequence
  derived and/or modified protein sequence (wt) from PUUV(PUUV/NL/Mg31/2007)__KU314896.1__N
MSDLTDIQEDITRHEQQLVVARQKLKDAEKAVEMDPDDVNKNTLQARQQTVSALEDKLADYKRRMADAVSRKKMDTKPTDPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWPDRIREFMEKECPFIKPEVKPGTPAQEAEFLKRNKVYFMQRQDVPDKNHVADIDKLIDYAASGDPTSPDNIESPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLAQALIDQKVKEISNQEPLKI

SEQ ID NO: 477 - protein, 433 aa, Artificial Sequence
  derived and/or modified protein sequence (wt) from PUUV(PUUV/NL/Mg502/2008)__KU314904.1__N
MSDLTDIQEDITRHEQQLVVARQKLKDAEKAVEMDPDDVNKNTLQARQQTVSALEDKLADFKRQMADAVSRKKMDTKPADPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWADRIREFMEKECPFIKPDVKPGTPAQEAEFLKRNKIYFMQRQEVLDKNHVADIDKLIDYAASGDPTSPDNIESPDSPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLAQALIDQKVKEISNQEPLKI

SEQ ID NO: 478 - protein, 433 aa, Artificial Sequence
  derived and/or modified protein sequence (wt) from PUUV(PUUV/NL/Mg591/2008)__KU314905.1__N
MSDLTDIQEDITRHEQQLVVARQKLKDAEKAVEMDPDDVNKNTLQARQQTVSALEDKLADFKRQMADAVSRKKMDTKPTDPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWADRIREFMEKECPFIKPDVKPGTPAQEAEFLKRNKIYFMQRQEVLDKNHVADIDKLIDYAASGDPTSPDNIESPNSPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRSLAQALIDQKVKEISNQEPLKI

SEQ ID NO: 479 - protein, 433 aa, Artificial Sequence
  derived and/or modified protein sequence (wt) from PUUV(Samara_49/CG/2005)__AB433843.2__N
MSDLTDIQEEITRHEQQLVVARQKLKDAERAVEVDPDDVNKNTLQARQQTVSALEDKLADYKRRMADAVSRKKMDTKPTDPTGIEPDDHLKERSSLRYGNVLDVNAIDIEEPSGQTADWYTIGVYVIGFTIPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWPERIREFMERECPFIKPEVKPGTPAQEVEFLKRNRVYFMTRQDVLDKNHVADIDKLIDYAASGDPTSPDDIESPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLAQSLIDQKVKEISNQEPLKI

SEQ ID NO: 480 - protein, 433 aa, Artificial Sequence
  derived and/or modified protein sequence (wt) from PUUV(Thuin/33Cg/96)__AJ277030.1__N
MSDLTDIQEDITRHEQQLVVARQKLKDAEKAVEMDPDDVNKNTLQARQQTVSALEDKLADFKRQMADAVSRKKMDTKPTDPTGIEPDDHLKERSSLRYGNVLDVNAIDIEEPSGQTADWYTIGVYVIGFTLPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWADRIREFMEKECPFIKPEVKPGTPVQEAEFLKRNKIYFMQRQEVLDKNHVADIDKLIDYAASGDPTSPDNIEAPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLAQALIDQKVKEISNQEPLKI

SEQ ID NO: 481 - protein, 433 aa, Artificial Sequence
  derived and/or modified protein sequence (wt) from PUUV(Udmurtia/338Cg/92)__Z30708.1__N
MSDLTDIQEEITRHEQQLVVARQKLKDAERAVEVDPDDVNKNTLQARQQTVSALEDKLADYKRRMADSVSRKKMDTKPTDPTGIEPDDHLKERSSPRYGNVLDVNAIDIEEPSGQTADWYTIGVYVIGFTIPIILKALYMLSTRGRQTIKENKGTRIRFKDDTSFEDINGIRRPKHLYVSMPTAQSTMKAEELTPGRFRTIVCGLFPTQIQVRNIMSPVMGVIGFSFFVKDWPERIRDFMEKECPFIKPEVKPGTPAQEIEFLKRNRVYFMTRQDVLDKNHVADIDKLIDYAASGDPTSPDDIESPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLAQSLIDQKVKEISNQEPLKI

SEQ ID NO: 482 - protein, 433 aa, Artificial Sequence
  derived and/or modified protein sequence (wt) from PUUV(Udmurtia/444Cg/88)__Z30706.1__N
MSDLTDIQEEITRHEQQLVVARQKLKDAERAVEVDPDDVNKNTLQARQQTVSALEDKLADYKRRMADAVSRKKMDTKPTDPTGIEPDDHLKERSSLRYGNVLDVNAIDIEEPSGQTADWYTIGVYVIGFTIPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWPERIRDFMEKECPFIKPEVKPGTPAQEIEFLKRNRVYFMTRQDVLDKNHVADIDKLIDYAASGDPTSPDDIESPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRGLAQSLIDQKVKEISNQEPLKI

SEQ ID NO: 483 - protein, 433 aa, Artificial Sequence
  derived and/or modified protein sequence (wt) from PUUV(Udmurtia/894Cg/91)__Z21497.1__N
MSDLTDIQEEITRHEQQLVVARQKLKDAERAVEVDPDDVNKNTLQARQQTVSALEDKLADYKRRMADAVSRKKMDTKPTDPTGIEPDDHLKERSSLRYGNVLDVNAIDIEEPSGQTADWYTIGVYVIGFTIPIILKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWPERIRDFMEKECPFIKPEVKPGTPAQEIEFLKRNRVYFMTRQDVLDKNHVADIDKLIDYAASGDPTSPDDIESPNAPWVFACAPDRCPPTCIYVVGMAELGAFFSILQDMRNTIMASKTVGTAEEKLKKKSSFYQSYLRRTQSMGIQLDQRIILLYMLEWGKEMVDHFHLGDDMDPELRGLAQSLIDQKVKEISNQEPLKI

SEQ ID NO: 484 - protein, 433 aa, Artificial Sequence
  derived and/or modified protein sequence (wt) from PUUV(Fusong-Cr-247)__EF442087.1__N
MSDLKDIQEDIARHEQQLVVARQKLRDAEKAVEMDPDDVNNNTLQARQQTVSALEDKIADFKRRMADIVSRKKMDTKPADPTGIEPDDHLKERSSLRYGNVLDVNAIDIEEPSGQTADWYTIGVYIIGFTLPIILKALYMLSTRGRQTVKENKGTRIRFKDDTSFEDVNGIRRPKHLYVSMPTAQSTMKAEELTPGRFRTIVCGLFPTQIQVRNTMSPVMGVIGFSFFAKDWPDRIKEFMEKECPFIKPEVKPGTPAKEVEILKRNKIYFMQRQDVLDKNHVPDIDKLIDYAASGDPTSPENIDSPNAPWVFACAPDRCPPTCIYVAGMAELGAFFSILQDMRNTIMASKTVGTAEEKLKKKSSFYQSYLRRTQSMGIQLDQRIILLYMLEWGKEMVDHFHLGDDMDPELRSLAQALIDQKVKEISNQEPLKI

SEQ ID NO: 485 - protein, 433 aa, Artificial Sequence
  derived and/or modified protein sequence (wt) from MUV(11-4)__JX046484.1__N
MSDLKEIQEDIARHEQQLVVARQKLRDAEKAVEVDPDDVNKNTLQARQQTVSALEDKLADFKRQMADFVSRKKMDTKPTDPTGIEPDDHLKERSSLRYGNVLDVNAIDIEEPSGQTADWYTIGVYIIGFTLPIVLKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWADRIKEFMEKECPFIKPEPKPGTPASEVEFLKRNKIYFMSRQDVLDKNHVPDIDKLIDYAASGDPTSPDNIEDPNAPWVFSCAPDRCPPTCLYVAGMAELGAFFSILQDMRNTIMASKTVGTAEEKLKKKSSFYQSYLRRTQSMGIQLDQRIILLYMLEWGKEMVDHFHLGDDMDPELRTLAQALIDQKVKEISNQEPLKI

SEQ ID NO: 486 - protein, 433 aa, Artificial Sequence
  derived and/or modified protein sequence (wt) from MUV(00-18)__DQ138128.1__N
MSDLKEIQEDIARHEQQLVVARQKLRDAEKAVEVDPDDVNKNTLQARQQTVSALEDKLADFKRQMADFVSRKKMDTKPTDPTGIEPDDHLKERSSLRYGNVLDVNAIDIEEPSGQTADWYTIGVYVIGFTLPIVLKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWVERIKEFMEKECPFIKPEPKPGTPASEVEFLKRNKIYFMNRQDVLDKNHVPDIDKLIDYAASGDPTSPDNIEDPNAPWVFSCAPDRCPPTCLYVAGMAELGAFFSILQDMRNTIMASKTVGTAEEKLKKKSSFYQSYLRRTQSMGIQLDQRIILLYMLEWGKEMVDHFHLGDDMDPELRTLAQALIDQKVKEISNQEPLKI

SEQ ID NO: 487 - protein, 433 aa, Artificial Sequence
  derived and/or modified protein sequence (wt) from MUV(11-1)__JX028273.1__N
MSDLKEIQEDIARHEQQLVVARQKLRDAEKAVEVDPDDVNKNTLQARQQTVSALEDKLADFKRQMADFVSRKKMDTKPTDPTGIEPDDHLKERSSLRYGNVLDVNAIDIEEPSGQTADWYTIGVYIIGFTLPIVLKALYMLSTRGRQTVKENKGTRIRFKDDTSFEDINGIRRPKHLYVSMPTAQSTMKAEELTPGRFRTIVCGLFPTQIQVRNIMSPVMGVIGFSFFVKDWADRIKEFMEKECPFIKPEPKPGTPASEIEFLKRNKIYFMSRQDVLDKNHVPDIDKLIDYAASGDPTSPDNIEDPNAPWVFSCAPDRCPPTCLYVAGMAELGAFFSILQDMRNTIMASKTVGTAEEKLKKKSSFYQSYLRRTQSMGIQLDQRIILLYMLEWGKEMVDHFHLGDDMDPELRTLAQALIDQKVKEISNQEPLKI

SEQ ID NO: 488 - protein, 433 aa, Artificial Sequence
  derived and/or modified protein sequence (wt) from MUV(96-1)__DQ138133.1__N
MSDLKEIQEDIARHEQQLVVARQKLRDAEKAVEVDPDDVNKNTLQARQQTVSALEDKLADFKRQMADFVSRKKMDTKPTDPTGIEPDDHLKERSSLRYGNVLDVNAIDIEEPSGQTADWYTIGVYVIGFTLPIVLKALYMLSTRGRQTVKENKGTRIRFKDDTSFEDINGIRRPKHLYVSMPTAQSTMKAEELTPGRFRTIVCGLFPTQIQVRNIMSPVMGVIRFSFLVKDWSEKIKEFMEKECPFIKPEPKPGTPASEIEFLKRNKIYFMNRQDVLDKNHVPDIDKLIDYAASGDPTSPDNIEAPNAPWVFSCAPDRCPPTCLYVAGMAELGAFFSILQDMRNTIMASKTVGTAEEKLKKKSSFYQSYLRRTQSMGIQLDQRIILLYMLEWGKEMVDHFHLGDDMDPELRTLAQALIDQKVKEISNQEPLKI

SEQ ID NO: 489 - protein, 433 aa, Artificial Sequence
  derived and/or modified protein sequence (wt) from MUV(99-28)__DQ138142.1__N
MSDLKEIQEDIARHEQQLVVARQKLRDAEKAVEVDPDDVNKNTLQARQQTVSALEDKLADFKRQMADFVSRKKMDTKPTDPTGIEPDDHLKERSSLRYGNVLDVNAIDIEEPSGQTADWYTIGVYVIGFTLPIVLKALYMLSTRGRQTVKENKGTRIRFKDDTSFEDINGIRSPKHLYVSMPTAQSTMKAEELTPGRFRTIVCGLFPTQIQVRNIMSPVMGVIGFSFFVKDWVERIKEFMEKECPFIKPEPKPGTPASEVEFLKRNKIYFMNRQDVLDKNHVPDIDKLIDYAASGDPTSPDNIEDPNAPWVFSCAPDRCPPTCLYVAGMAELGAFFSILQDMRNTIMASKTVGTAEEKLKKKSSFYQSYLRRTQSMGIQLDQRIILLYMLEWGKEMVDHFHLGDDMDPELRTLAQALIDQKVKEISNQEPLKI

SEQ ID NO: 490 - protein, 429 aa, Artificial Sequence
  derived and/or modified protein sequence (wt) from SANGV(SA14)__NC_034526.1__N
MATLEEIQKEINIHEGQLIIAKQKVKDAEKQYEKDPDDLNKRALSDREGIAHSIQSKIDELRRQLADRVAAGRNLGQERDPTGVEPGDHLREKSMLSYGNVIDLNHLDIDEPTGQTADWLSIVIYLTSFVVPILLKALYMLTTRGRQTTKDNKGMRIRFKDDSSFEDVNGIRKPKHLFLSMPNAQSSMKAEEITPGRFRTAVCGLYPAQIKARNMVSPVMSVIGFITLARDWTERIENWLDQPCKFMSEPSQTSLQKGPATNRDYLNQRQASLAQMETKEAQAVRQQAVDAGCNLVDHIDSPSSIWVFAGAPDRCPPTCLFISGMAELGAFFSILQDMRNTIMASKTVGTSEEKLRKKSSFYQSYLRRTQSMGIQLDQRIIIMFMVEWGKEAVDGFHLGDDMDPELRSFAQALIDQKVKEISNQEPLKI

SEQ ID NO: 491 - protein, 429 aa, Artificial Sequence
  derived and/or modified protein sequence (wt) from SANGV(SA22)__JQ082303.1__N
MATLEEIQKEINIHEGQLIIAKQKVKDAEKQYEKDPDDLNKRALSDREGIAHSIQSKIDELRRQLADRVAAGRNLGQERDPTGVEPGDHLREKSMLSYGNVIDLNHLDIDEPTGQTADWLSIVIYLTSFVVPILLKALYMLTTRGRQTTKDNKGMRIRFKDDSSFEDVNGIRKPKHLFLSMPNAQSSMKAEEITPGRFRTAVCGLYPAQIKARNMVSPVMSVIGFITLARDWTERIENWLDQPCKFMSEPSQTSLQKGPATNRDYLNQRQASLAQMETKEAQAVRQQAVDAGCNLVDHIDSPSSIWVFAGAPDRCPPTCLFISGMAELGAFFSILQDMRNTIMASKTVGTSEEKLRKKSSFYQSYLRRTQSMGIQLDQRIIIMFMVEWGKEVVDGFHLGDDMDPELRSFAQALIDQKVKEISNQEPLKI

SEQ ID NO: 492 - protein, 429 aa, Artificial Sequence
  derived and/or modified protein sequence (wt) from SEOV(L99)__AF288299.1__N
MATMEEIQREISAHEGQLVIARQKVKDAEKQYEKDPDDLNKRTLHDRESVAASIQSKIDELKRQLADRIAAGKNIGQDRDPTGVEPGDHLKERSALSYGNTLDLNSLDIDEPTGQTADWLTIIVYLTSFVVPIILKALYMLTTRGRQTSKDNKGMRIRFKDDSSYEDVNGIRKPKHLYVSMPNAQSSMKAEEITPGRFRTAVCGLYPAQIKARNMVSPVMSVVGFLALAKDWTSRIEEWLGAPCKFMAESPIAGSLSGNPVNRDYIRQRQGALAGMEPKEFQALRQHAKDAGCTLVEHIESPSSIWVFAGAPDRCPPTCLFVGGMAELGAFFSILQDMRNTIMASKTVGTADEKLRKKSSFYQSYLRRTQSMGIQLDQRIIVMFMVAWGKEAVYNFHLGDDMDPELRSLAQILIDQKVKEISNQEPMKL

SEQ ID NO: 493 - protein, 429 aa, Artificial Sequence
  derived and/or modified protein sequence (wt) from SEOV(SG42/2011)__KY807171.1__N
MATMEEIQREISAHEGQLVIARQKVKDAEKQYEKDPDDLNKRALHDRESVAASIQSKIDELKRQLADRIAAGKNIGQDRDPTGVEPGDHLKERSALSYGNTLDLNSLDIDEPTGQTADWSTIIVYLTSFVVPIILKALYMLTTRGRQTSKDNKGMRIRFKDDSSYEDVNGIRKPKHLYVSMPNAQSSMKAEEITPGRFRTAVCGLYPAQIKARNMVSPVMSVVGFLALAKDWSSRIEEWLGAPCKFMAESPIAGSLSGNPVNRDYIRQRQGALAGMEPKEFQALRQHSKDAGCTLVEHIESPSSIWVFAGAPDRCPPTCLFVGGMAELGAFFSILQDMRNTIMASKTVGTADEKLRKKSSFYQSYLRRTQSMGIQLDQRIIVMFMVAWGKEAVDNFHLGDDMDPELRSLAQILIDQKVKEISNQEPMKL

SEQ ID NO: 494 - protein, 429 aa, Artificial Sequence
  derived and/or modified protein sequence (wt) from SEOV(XJ2/2011)__KY807169.1__N
MATMEEIQREISAHEGQLVIARQKVKDAEKQYEKDPDDLNKRALHDRESVAASIQSKIDELKRQLADRIAAGKNIGQDRDPTGVEPGDHLKERSALSYGNTLDLNSLDIDEPTGQTADWLTIIVYLTSFVVPIILKALYMLTTRSRQTSKDNKGMRIRFKDDSSYEDVNGIRKPKHLYVSMPNAQSSMRAEEITPGRFRTAVCGLYPAQIKARNMVSPVMSVVGFLALAKDWTSRIEEWLGAPCKFMAESPIAGSLSGNPVNRDYIRQRQGALAGWEPKEFQALRQHSKDAGCTLVEHIESPSSIWVFAGAPDRCPPTCLFVGGMAELGAFFSILQDMRNTIMASKTVGTADEKLRKKSSFYQSYLRRTQSMGIQLDQRIIVMFMVAWGKEAVDNFHLGDDMDPELRSLAQILIDQKVKEISNQEPMKL

SEQ ID NO: 495 - protein, 429 aa, Artificial Sequence
  derived and/or modified protein sequence (wt) from SEOV(XJ5/2011)__KY807170.1__N
MATMEEIQREISAHEGQLVIARQKVKDAEKQYEKDPDDLNKRALHDRESVAASIQSKIDELKRQLADRIAAGKNIGQDRDPTGVEPGDHLKERSALSYGNTLDLNSLDIDEPTGQTADWLTIIVYLTSFVVPIILKALYMLTTRGRQTSKDNKGMRIRFKDDSSYEDVNGIRKPKHLYVSMPNAQSSMKAEEITPGRFRTAVCGLYPAQIKARNMVSPVMSVVGFLALAKDWTSRIEEWLGAPCKFMAESPIAGSLSGNPVNRDYIRQRQGALAGMEPKEFQALRQHPKDAGCTLVEHIESPSSIWVFAGAPDRCPPTCLFVGGMAELGAFFSILQDMRNTIMASKTVSTADEKLRKKSSFYQSYLRRTQSMGIQLDQRIIVMFMVAWGKEAVDNFHLGDDMDPELRSLAQILIDQKVKEISNQEPMKL

SEQ ID NO: 496 - protein, 429 aa, Artificial Sequence
  derived and/or modified protein sequence (wt) from SEOV(10-134)__JF693882.2__N
MATMEEIQREISAHEGQLVIARQKVKDAEKQYEKDPDDLNKRALHDRESVAASIQSKIDELKRQLADRIAAGKNIGQDRDPTGVEPGDHLKERSALSYGNTLDLNSLDIDEPTGQTADWLTIIVYLTSFVLPIILKALYMLTTRGRQTSKDNKGMRIRFKDDSSYEDVNGIRKPKHLYVSMPNAQSSMKAEEITPGRFRTAVCGLYPAQIKARNMVSPVMSVVGFLALAKDWTSRIEEWLGAPCKFMAESPIAGSLSGNPVNRDYIRQRQGALAGMEPKEFQALRQHSKDAGCTLVEHIESPSSIWVFAGAPDRCPPTCLFVGGMAELGAFFSILQDMRNTIMASKTVGTADEKLRKKSSFYQSYLRRTQSMGIQLDQRIIVMFMVAWGKEAVDNFHLGDDMDPELRSLAQILIDQKVKEISNQEPMKL

SEQ ID NO: 497 - protein, 429 aa, Artificial Sequence
  derived and/or modified protein sequence (wt) from SEOV(DPRK08)__JX853575.1__N
MATMEEIQREISAHEGQLVIARQKVKDAEKQYEKDPDDLNKRALHDRESVAASIQSKIDELKRQLADRIAAGKNIGQDRDPTGVEPGDHLKERSALSYGNTLDLNSLDIDEPTGQTADWLTIIVYLTSFVVPIILKALYMLTTRGRQTSKDNKGMRIRFKDDSSYEDVNGIRKPKHLYVSMPNAQSSMKAEEITPGRFRTAVCGLYPAQIKARNMVSPVMSVVGFLALAKDWTSRIEEWLGAPCKFMAESPIAGSLSGNPVNRDYIRQRQGALAGMEPKEFQALRQHAKDAGCTLVEHIESPSSIWVFAGAPDRCPPTCLFVGGMAELGAFFSILQDMRNTIMASKTVGTADEKLRKKSSFYQSYLRRTQSMGIQLDQRIIVMFMVAWGKEAVDNFHLGDDMDPELRSLAQILIDQKVKEISNQEPMKL

SEQ ID NO: 498 - protein, 429 aa, Artificial Sequence
  derived and/or modified protein sequence (wt) from SEOV(Fj372/2013)__KP645198.1__N
MATMEEIQREISAHEGQLVIARQKVKDAEKQYEKDPDDLNKRALHDRESVAASIQSKIDELKRQLADRIAAGKNIGQDRDPTGVEPGDHLKERSALSYGNTLDLNSLDIDEPTGQTADWLTIIVYLTSFVVPIILKALYMLTTRGRQTSKDNKGMRIRFKDDSSYEDVNGIRKPKHLYVSMPNAQSSMKAEEITPGRFRTAVCGLYPAQIKARNMVSPVMSVVGFLALAKDWTSRIEEWLGAPCKFMAESPIAGSLSGSPVNRDYIRQRQGALAGMEPKEFQALRQHAKDAGCTLVEHIESPSSIWVFAGAPDRCPPTCLFVGGMAELGAFFSILQDMRNTIMASKTVGTADEKLRKKSSFYQSYLRRTQSMGIQLDQRIIVMFMVAWGKEAVDNFHLGDDMDPELRSLAQILIDQKVKEISNQEPMKL

SEQ ID NO: 499 - protein, 429 aa, Artificial Sequence
  derived and/or modified protein sequence (wt) from SEOV(HeB38)__JN377553.1__N
MATMEEIQREISAHEGQLVIARQKVKDAEKQYEKDPDDLNKRALHDRESVAASIQSKIDELKRQLADRIAAGKNIGQDRDPTGVEPGDHLKERSALSYGNTLDLNSLDIDEPTGQTADWLTIIVYLTSFVVPIILKALYMLTTRGRQTSKDNKGMKIRFKDDSSYEDVNGIRKPKHLYVSMPNAQSSMKAEEITPGRFRTAVCGLYPAQIKARNMVSPVMSVVGFLALAKDWTSRIEEWLGAPCKFMAESPIAGSLSGNPVNRDYIRQRQGALAGMEPKEFQALRQHSKDAGCTLVEHIESPSSIWVFAGAPDRCPPTCLFVGGMAELGAFFSILQDMRNTIMASKTVGTADEKLRKKSPFYQSYLRRTQSMGIQLDQRIIVMFMVAWGKEAVDNFHLGDDMDPELRGLAQILIDQKVKEISNQEPMKL

SEQ ID NO: 500 - protein, 429 aa, Artificial Sequence
  derived and/or modified protein sequence (wt) from SEOV(JiangxiXinjianRn-07-2011)__KP859511.1__N
MATMEEIQREISAHEGQLVIARQKVKDAEKQYEKDPDDLNKRALHDRESVAASIQSKIDELKRQLADRIAAGKNIGQDRDPTGVEPGDHLKERSALSYGNTLDLNSLDIDEPTGQTADWLTIIVYLTSFVVPIILKALYMLTTRGRQTSKDNKGMRIRFKDDSSYEDVNGIRKPKHLYVSMPNAQSSMKAEEITPGRFRTAVCGLYPAQIKARNMVSPVMSVVGFLALAKDWTSRIEEWLGAPCKFMAESPIAGSLSGNPVNRDYIRQRQGALAGMEPKEFQALRQHSKDAGCTLVEHIESPSSIWVFAGAPDRCPPTCLFVGGMAELGAFFSILQDMRNTIMASKTVGTADEKLRKKSSFYQSYLRRTQSMGIQLDQRIIVMFMVAWGKEAVDNFHLGDDMDPELRSLAQILIDQKVKEISNQEPMKL

SEQ ID NO: 501 - protein, 429 aa, Artificial Sequence
  derived and/or modified protein sequence (wt) from SEOV(JiangxiXinjianRn-09-2011)__KP859512.1__N
MATMEEIQREISAHEGQLVIARQKVKDAEKQYEKDPDDLNKRALHDRESVAASIQSKIDELKRQLADRIAAGKNIGQDRDPTGVEPGDHLKERSALSYGNTLDLNSLDIDEPTGQTADWLTIIVYLTSFVVPIILKALYMLTTRGRQTSKDNKGMRIRFKDDSSYEDVNGIRKPKHLYVSMPNAQFSMKAEEITPGRFRTAVCGLYPAQIKARNMVSPVMSVVGFLALAKDWTSRIEEWLGAPCKFMAESPIAGSLSGNPVNRDYIRQRQGALAGMEPKEFQALRQHSKDAGCTLVEHIESPSSIWVFAGAPDRCPPTCLFVGGMAELGAFFSILQDMRNTIMASKTVGTADEKLRKKSSFYQSYLRRTQSMGIQLDQRIIVMFMVAWGKEAVDNFHLGDDMDPELRSLAQILIDQKVKEISNQEPMKL

SEQ ID NO: 502 - protein, 429 aa, Artificial Sequence
  derived and/or modified protein sequence (wt) from SEOV(Singapore/06(RN41))__GQ274944.1__N
MATMEEIQREISAHEGQLVIARQKVKDAEKQYEKDPDDLNKRALHDRESVAASIQSKIDELKRQLADRIAAGKNIGQDRDPTGVEPGDHLKERSALSYGNTLDLNSLDIDEPTGQTADWLTIIVYLTSFVVPIILKALYMLTTRGRQTSKDNKGMRIRFKDDSSYEDVNGIRKPKHLYVSMPNAQSSMKAEEITPGRFRTAVCGLYPAQIKARNMVSPVMSVVGFLALAKDWTSRIEEWLGAPCKFMAESPIAGSLSGNPVNRDYIRQRQGALAGMEPKEFQALRQHSKDAGCTLVEHIESPSSIWVFAGAPDRCPPTCLFVGGMAELGAFFSILQDMRNTIMASKTVGTADEKLRKKSSFYQSYLRRTQSMGIQLDQRIIVMFMVAWGKEAVDNFHLGDDMDPELRGLAQILIDQKVKEISNQEPMKL

SEQ ID NO: 503 - protein, 429 aa, Artificial Sequence
  derived and/or modified protein sequence (wt) from SEOV(YaluRiver12)__HQ611980.1__N
MATMEEIQREISAHEGQLVIARQKVKDAEKQYEKDPGDLNKRALHDRESVAASIQSKIDELKRQLADRIAAGKNIGQDRDPTGVEPGDHLKERSALSYGNTLDLNSLDIDEPTGQTADWLTIIVYLTSFVVPIILKALYMLTTRGRQTSKDSKGMRIRFKDDSSYEDVNGIRKPKHLYVSMPNAQSSMKTEEITPGRFRTAVCGLYPAQIKARNMVSPVMSVVGFLALAKDWTSRIEEWLGAPCKFMAESPIAGSLSENPVNRDYIRQRQGALAGMEPKEFQALRQHAKDAGCTLVEHIESPSSIWVFAGAPDRCPPTCLFVGGMAELGAFFSILQDMRNTIMASKTVGTADEKLRKKSSFYQSYLRRTQSMGIQLDQRIIVMFMVAWGKEAVDNFHLGDDMDPELRSLAQILIDQKVKEISNQEPMKL

SEQ ID NO: 504 - protein, 429 aa, Artificial Sequence
  derived and/or modified protein sequence (wt) from SEOV(14D12)__AB618124.1__N
MATMEEIQKEISAHEGQLVIARQKVKDAEKQYEKDPDDLNKRALHDRESVAASIQSKIDELKRQLADRIAAGKNIGQDRDPTGVEPGDHLKERSALSYGNTLDLNSLDIDEPTGQTADWLTIIVYLTSFVVPIILKALYMLTTRGRQTSKDNKGMRIRFKDDSSYEDVNGIRKPKHLYVSMPNAQSSMKAEEITPGRFRTAVCGLYPAQIKARNMVSPVMSVVGFLALAKDWTSRIEEWLGAPCKFMAESPIAGSLSGNPVNRDYIRQRQGALAGMEPKEFQALRQHSKDAGCTLVEHIESPSSIWVFAGAPDRCPPTCLFVGGMAELGAFFSILQDMRNTIMASKTVGTADEKLRKKSSFYQSYLRRTQSMGIQLDQRIIVMFMVAWGKEAVDNFHLGDDMDPELRSLAQILIDQKVKEISNQEPMKL

SEQ ID NO: 505 - protein, 426 aa, Artificial Sequence
  derived and/or modified protein sequence (wt) from SEOV(19CSG)__AB618114.1__N
MEEIQREISAHEGQLVIARQKVKDAEKQYEKDPDDLNKRALHDRESVAASIQSKIDELKRQLADRIAAGKNIGQDRDPTGVEPGDHLKERSALSYGNTLDLNSLDIDEPTGQTADWLTIIVYLTSFVVPIILKALYMLTTRGRQTSKDNKGMRIRFKDDSSYEDVNGIRKPKHLYVSMPNAQSSMKAEEITPGRFRTAVCGLYPAQIKARNMVSPVMSVVGFLALAKDWTSRIEEWLGAPCKFMAESPIAGSLSGNPVNRDYIRQRQGALAGMEPKEFQALRQHSKDAGCTLVEHIESPSSIWVFAGAPDRCPPTCLFVGGMAELGAFFSILQDMRNTIMASKTVGTADEKLRKKSSFYQSYLRRTQSMGIQLDQRIIVMFMVAWGKEAVDNFHLGDDMDPELRSLAQILIDQKVKEISNQEPMKL

SEQ ID NO: 506 - protein, 429 aa, Artificial Sequence
  derived and/or modified protein sequence (wt) from SEOV(93HBX12)__EF192308.1__N
MATMEEIQREISAHEGQLVIARQKVKDAEKQYEKDPDDLNKRALHDRESVAASIQSKIDELKRQLADRIAAGKNIGQDRDPTGVEPGDHLKERSALSYGNTLDLNSLDIDEPTGQTADWLTIIVYLTSFVVPIILKALYMLTTRGRQTSKDNKGMRIRFKDDSSYEDVNGIGKPKHLYVSMPNAQSSMKAEEITPGRFRTAVCGLYPAQIKARNMVSPVMSVVGFLALAKDWTSRIEEWLGAPCKFMAESPIAGSLSGNPVNRDYIRQRQGALAGMEPKEFQALRQHSKDAGCTLVEHIESPSSIWVFAGAPDRCPPTCLFVGGMAELGAFFSILQDMRNTIMASKTVGTADEKLRKKSSFYQSYLRRTQSMGIQLDQRIIVMFMVAWGKEAVDNFHLGDDMDPELRGLAQILIDQKVKEISNQEPMKL

SEQ ID NO: 507 - protein, 429 aa, Artificial Sequence
  derived and/or modified protein sequence (wt) from SEOV(Cherwell)__KC626089.1__N
MATMEEIQREISAHEGQLVIARQKVKDAEKQYEKDPDDLNKRALHDRESVAASIQSKIDELKRQLADRIAAGKNIGQDRDPTGVEPGDHLKERSALSYGNTLDLNSLDIDEPTGQTADWLTIIVYLTSFVVPIILKALYMLTTRGRQTSKDNKGMRIRFKDDSSYEDVNGIRKPKHLYVSMPNAQSSMKAEEITPGRFRTAVCGLYPAQIKARNMVSPVMSVVGFLALAKDWTSRIEEWLGAPCKFIAESPIAGSLSGNPVNRDYIRQRQGALAGMEPKEFQALRQHSKDAGCTLVEHIESPSSIWVFAGAPDRCPPTCLFVGGMAELGAFFSILQDMRNTIMASKTVGTADEKLRKKSSFYQSYLRRTQSMGIQLDQRIIVMFMVAWGKEAVDNFHLGDDMDPELRSLAQILIDQKVKEISNQEPMKL

SEQ ID NO: 508 - protein, 429 aa, Artificial Sequence
  derived and/or modified protein sequence (wt) from SEOV(CixiRf23)__FJ803201.1__N
MATMEEIQREISAHEGQLVIARQKVKDAEKQYEKDPDDLNKRALHDRESVAASIQSKIDELKRQLADRIAAGKNIGQDRDPTGVEPGDHLKERSALSYGNTLDLNSLDIDEPTGQTADWLTIIVYLTSFVVPIILKALYMLTTRGRQTSKDNKGMRIRFKDDSSYEDVNGIRKPKHLYVSMPNAQSSMKAEEITPGRFRTAVCGLYPAQIKARNMVSPVMSVVGFLALAKDWTSRIEEWLGAPCKFMAESPIAGSLSGNPVNRDYIRQRQGALAGMEPKEFQALRQHAKDAGRTLVEHIESPSSIWVFAGAPDRCPPTCLFVGGMAELGAFFSILQDMRNTIMASKTVGTADEKLRKKSSFYQSYLRRTQSMGIQLDQRIIVMFMVAWGKEAVDNFHLGDDMDPELRSLAQILIDQKVKEISNQEPMKL

SEQ ID NO: 509 - protein, 429 aa, Artificial Sequence
  derived and/or modified protein sequence (wt) from SEOV(CixiRf56)__FJ803202.1__N
MATMEEIQREISAHEGQLVIARQKVKDAEKQYEKDPDDLNKRALHDRESVAASIQSKIDELKRQLADRIAAGKNIGQDRDPTGVEPGDHLKERSALSYGNTLDLNSLDIDEPTGQTADWLTIIVYLTSFVVPIILKALYMLTTRGRQTSKDNKGMRIRFKDDSSYEDVNGIRKPKHLYVSMPNAQSSMKAEEITPGRFRTAVCGLYPAQIKARNMVSPVMSVVGFLALAKDWTSRIEEWLGAPCKFMAESPIAGSLSGNPVNRDYIRQGQGALAGMEPKEFQALRQHAKDAGCTLVEHIESPSSIWVFAGAPDRCPPTCLFVGGMAELGAFFSILQDMRNTIMASKTVGTADEKLRKKSSFYQSYLRRTQSMGIQLDQRIIVMFMVAWGKEAVDNFPLVHDMDPKLRSLSQILIDQKVNEISNQEPMKL

SEQ ID NO: 510 - protein, 429 aa, Artificial Sequence
  derived and/or modified protein sequence (wt) from SEOV(CixiRn21)__FJ803205.1__N
MATMEEIQREISAHEGQLVIARQKVKDAEKQYEKDPDDLNKRALHDRESVAASIQSKIDELKRQLADRIAAGKNIGQDRDPTGVEPGDHLKERSALSYGNTLDLNSLDIDEPTGQTADWLTIIVYLTSFVVPIILKALYMLTTRGRQTSKDNKGMRIRFKDDSSYEDVNGIRKPKHLYVSMPNAQSSMKAEEITPGRFRTAVCGLYPAQIKARNMVSPVMSVVGFLALAKDWTSRIEEWLGAPCKFMAESPIAGSLSGNPVNRDYIRQRQGALAGMEPKEFQALRQHSKDAGCTLVEHIESPSSIWVFAGAPDRCPPTCLFVGGMDELGAFFSILQDMRNTIMASKTVGTADEKLRKKSSFYQSYLRRTQSMGIQLDHRIIVMFMVAWGKEAVDNFHLGDDMDPELRTLAQILIDQKVKEISNQEPMKL

SEQ ID NO: 511 - protein, 429 aa, Artificial Sequence
  derived and/or modified protein sequence (wt) from SEOV(CixiRn76)__FJ803206.1__N
MATMEEIQREISAHEGQLVIARQKVKDAEKQYEKDPDDLNKRALHDRESVAASIQSKIDELKRQLADRIAAGKNIGQDRDPTGVEPGDHLKERSALSYGNTLDLNSLDIDEPTGQTADWLTIIVYLTSFVVPIILKALYMLTTRGRQTSKDNKGMRIRFKDDSSYEDVNGIRKPKHLYVSSQNAQSSMKAEEITPGRFRTAVCGLYPAQIKARNMVSPVMSVVGFLALAKDWTSRIEEWLGAPCKFMAESPIAGSLSGNPVNRDYIRQGQGALAGMEPKEFQALRQHAKDAGCTLVEHIESPSSIWVFAGARDRCPPTCLFVGGMAELGAFFSILQDMRNTIMASKTVGTADEKLRKKSSFYQSYLRRTQSMGIQLDQRIIVMFMVAWGKEAVDNFHLGDDMDPELRSLAQILIDQKVKEISNQEPMKL

SEQ ID NO: 512 - protein, 429 aa, Artificial Sequence
  derived and/or modified protein sequence (wt) from SEOV(CUI)__GQ279395.1__N
MATMEELQREISAHEGQLVIARQKVKDAEKQYEKDPDDLNKRALHDRESVAASIQSKIDELKRQLADRIAAGKNIGQDRDPTGVEPGDHLKERSALSYGNTLDLNSLDIDEPTGQTADWLTIIVYLTSFVVPIILKALYMLTTRGRQTSKDNKGMRIRFKDDSSYEDVNGIRKPKHLYVSMPNAQSSMKAEEITPGRFRTAVCGLYPAQIKARNMLSPVMSVVGFLALAKDWTSRIEEWLGAPCKFMAESPIAGSLSGNPVNRDYIRQRQGALAGMEPKEFQALRQHSKDAGCTLVEHIESPSSIWVFAGAPDRCPPTCLFVGGMAELGAFFSILQDMRNTIMASKTVGTADKKLRKKSSFYQSYLRRTQSMGIQLDQRIIVMFMFAWGKEAVDNFHLGDDMDPELRGLAQILIDQKVKEISNQEPMKL

SEQ ID NO: 513 - protein, 429 aa, Artificial Sequence
  derived and/or modified protein sequence (wt) from SEOV(FeixianRn1)__GU592942.1__N
MATMEEIQREISAHEGQLVIARQKVKDAEKQYEKDPDDLNKRALHDRESVAASIQSKIDELKRQLADRIAAGKNIGQDRDPTGVEPGDHLKERSALSYGNTLDLNSLDIDEPTGQTADWLTIIVYLTSFVVPIILKALYMLTTRGRQTSKDNKGMRIRFKDDSSYEDVNGIRKPKHLYVSMPNAQSSMKAEEITPGRFRTAVCGLYPAQIKARNMVSPVMSVVGFLALAKDWTSRIEEWLGAPCKFMAESPITGSLSGNPVNRDYIRQRQGALAGMEPKEFQALRQHAKDAGCTLVEHIESPSSIWVFAGAPDRCPPTCLFVGGMAELGAFFSILQDMRNTIMASKTVGTADEKLRKKSSFYQSYLRRTQSMGIQLDQRIIVMFMVAWGKEAVDNFHLGDDMDPELRSLAQILIDQKVKEISNQEPMKL

SEQ ID NO: 514 - protein, 429 aa, Artificial Sequence
  derived and/or modified protein sequence (wt) from SEOV(GanyuRn66)__GU592932.1__N
MATMEEIQREISAHEGQLVIARQKVKDAEKQYEKDPDDLNKRALHDRESVAASIQSKIDELKRQLADRIAAGKNIGQDRDPTGVEPGDHLKERSALSYGNTLDLNSLDIDEPTGQTADWLTIIVYLTSFVVPIILKALYMLTTRGRQTSKDNKGMRIRFKDDSSYEDVNGIRKPKHLYVSMPNAQSSMKAEEITPGRFRTAVCGLYPAQIKARNMVSPVMSVVGFLALAKDWTSRIEEWLGAPCKFTAESPIAGSLSGNPVNRDYIRQRQGALAGMEPKEFQALRQHAKDAGCTLVEHIESPSSIWVFAGAPDRCPPTCLFVGGMAELGAFFSILQDMRNTIMASKTVGTADEKLRKKSSFYQSYLRRTQSMGIQLDQRIIVMFMVAWGKEAVDNFHLGDDMDPELRSLAQILIDQKVKEISNQEPMKL

SEQ ID NO: 515 - protein, 429 aa, Artificial Sequence
  derived and/or modified protein sequence (wt) from SEOV(Gongzhuling108)__KF745947.1__N
MATMEEIQREISAHEGQLVIARQKVKDAEKQYEKDPDDLNKSALHDRESVAASIQSKIDELKRQLADRIAAGKNIGQDRDPTGVEPGDHLKERSALSYGNTLDLNSLDIDEPTGQTADWLTILVYLTSFVVPIILKALYMLTTRGRQTSKDNKGMRIRFKDDGSYEDVNGIRKPKHLYVPMPNAQSSMKAEEITPGRFRTAVCGLYPAQIKPRNMVSPVMSVVGFLALAKDWTSRIEEWLGAPCKFMAESPIAGSLSGNPVNRDYIRQRQGALAGMEPKEFQALRQHAKDAGCTLVEHIESPSSIRVFAGAPARCPPTCLFVGGMAELGAFFSILQDMRNTIMASKTVGTADEKLRKKSSFYQSYLRRSQSMGIQLDQRIIVMFMVASGKEAVDNFHLGDDMDPELRSLVQILIDQKVKEISNQEPMKL

SEQ ID NO: 516 - protein, 429 aa, Artificial Sequence
  derived and/or modified protein sequence (wt) from SEOV(Gongzhuling147)__KF745948.1__N
MATMEEIQREISAHEGQLVIARQIVKDAEKQYEKDPADLNKRALHDRESVAASIQSKIDELKRHLADRIAAGKNIGQDRDPTGVEPGDHLKERSALSYGNTLDLNSLDIDEPTGQTADWLTIIVYLTSFVVPIILKALYILTTSGRQTSKDNKGMRIRFKDDSSYEDVNGIRMPKHLYVPMPNAQSSMKAEDITPGRFRTAVCGLYPAQIKARNMVSPLMSVVGFLALPKDWTSRIDEWLGAPCKFMAESPIAGSLSGNPVNRDHIRQRQGALAGMDPKEFQAVRQHAKDAGCTLVEHIESPSSIWVFAGAPDRCPPTCLFVGGMAELGAFFTILQDMRNTIMPSKTVGTADEKLRKKSSFYQSYLRRTQSMGIQLDQRIIVIFMVAWAKEAVDNFHLGDDMDPELRSLAQILIDQKVKEISNQVPMKL

SEQ ID NO: 517 - protein, 429 aa, Artificial Sequence
  derived and/or modified protein sequence (wt) from SEOV(Gongzhuling415)__KF745949.1__N
MATMEEIQREISAHEGQLVIARQMVKDAEKQYEKDLADLNKRALHDRESVAASIQSKIDELKRQLADRIAAGKNIEQDRDPTGVEPGDHLKERSALSYGNTLDLNSLDIDEPTGQTADWLTIIVYLTSFVVPIILKALYILTTRGRQTSKDNKGMTIRFKDDSSYEDVNGIRMPKHLYVPMPNAQSSMKAEDITPGRFRTAVCGLYPAQIKARNMVSPLMSVVGFLALPKDWTSRIDEWLGAPCKFMAESPIAGSLSGNPVNRDHIRQRQGALAGMDPKEFQAVRQHAKDAGCTLVEHIESPSSIWVFAGAPDRCLPTCLFVGGMAELGAFFTILQDMRNTIMASKTVGTADEKLGKKSSFYQSYLRRTQSMGIQLDQRIIVMFMVAWAKEAVDNIHLGDDMDPELRSLAQILIDQKVKEISNQVPMKL

SEQ ID NO: 518 - protein, 429 aa, Artificial Sequence
  derived and/or modified protein sequence (wt) from SEOV(Gongzhuling42)__KF745942.1__N
MATMEEIQREISAHEGQLVIARQKVKDAQKQYEKDPDDLNKRALHDRESVAASIQLKIDELKRQLADRIAAGKNIGQDRDPTGVEPGDHLKERSALSYGNTLDLNSLDIDEPTGQTADWLTIIVYLTSFVVPIILKALYMLTTRGRQTSKDNKGMRIRFKDDSSYEDVKGIRKPKHLYVPMPNAQSSMKAEEITPGRCRTAVCGLYPAQIKARNMVSPVMSAVGILALAKDWTSRIEEWLGTPCKFMAESPIAGSLSGNPVNRDHIRQRQGALAGMEPKEFQGLRQHAKDAGCTLVEHIESPSSIWVFAGAPDRCPPTCLFVGGMAELGAFFAILQDMRNTIMASKTVGTADEKLRKKSSFYQSYLRRTQSMGIQLDQRIIVMFMVAWAKEAVDNFHLGDDMDPELRSLAQILMDQKVKEISNQEPMKL

SEQ ID NO: 519 - protein, 429 aa, Artificial Sequence
  derived and/or modified protein sequence (wt) from SEOV(Gongzhuling45)__KF745943.1__N
MATMEEIQREISAHEGQLVIARQMVKDAEKQYEKDPADLNKRALHDRESVAASIQSKIDELKRQLADRIAAGKNIGQDRDPTGVEPGDHLKERSALSYRNTLDLNSLDIDEPTGQTADWLTIIVYLTSFVVPIILKALYILTTRGRQTSKDNKGMRIRFKDDSSYEDVNGIRMPKHLYLPMPNAQSSMKAEDITPGRFRTAVCGLYPAQIKARNMVSPLMSVVGFLALPKDWTSRIDEWLGAPCKFMAESPIAGSLSGNPVNRDHIRQRQGALAGMDPKEFQAVRQHAKDAGCTLVEHIESPSSIWVFAGAPDRCPPTCLFVGGMAELGAFFTILQDMRNTIMASKTVGTADEKLRKKSSFYQSYLRRTQSMGIQLDQRIIVMFMVAWAKEAVDNFHLGDDMDPELRSLAQILIDHKVKEISNQVPMKL

SEQ ID NO: 520 - protein, 429 aa, Artificial Sequence
  derived and/or modified protein sequence (wt) from SEOV(Gongzhuling58)__KF745944.1__N
MATMEEIQREISAHEGQLVIARQMVKDAEKQYEKDPADLNKRALHDRESVAASIQSKIDELKRQLADRIAAGKNIGQDRDPTGVEPGDHLKERSALSYGNTLDLNSLDIDEPTGQTADWLTIIVYLTSFVVPIILKALYILTTRGRQTSKDNKGMRIRFKDDSSYEDVNGIRMPKHLYVPMPNAQSSMKAEDITPGRFRTAVCGLYPAQIKARNMVSPLMSVVGFLALPKDWTSRIDEWLGAPCKFMAESPIAGSLSGNPVNRDHIRQRQGALAGMDPKEFQAVRQHAKDAGCTLVEHIESPSSIWVFAGAPDRCPPTCLFVGGMAELGAFFTILQDMRNTIMASKTVGTADEKLRKKSSFYQSYLRRTQSMGIQLDQRIIVMFMVAWAKEAVDNFHLGDDMDPELRSLAQILIDQKVKEISNQVPMKL

SEQ ID NO: 521 - protein, 429 aa, Artificial Sequence
  derived and/or modified protein sequence (wt) from SEOV(Gongzhuling85)__KF745945.1__N
MATMEEIQREISAHEGQLVIARQMVKDAEKQYEKDPADLIKRALHDRESVAASIQSKIDELKRQLADRIAAGKNIGQDRDPTGLEPGDHLKERSALSYGNTLDLNSLDIDEPTGQTADWLTVIVYLTSFVVPIILKALYILTTRGRQTSKDNKGMRIRFKDVSSYEDVNGIRMPKHLYVPMPNAQSSMKAEDITPGRFRTAVCGLYPAQIKARNMVSPLMSVVGFLALPKDWTSRIDEWLGAPCKFMAESPIAGSLSGNPVNRDHIRQRQGALAGMDPKEFQAVRQHAKDAGCTLVEHIESPSSIWVFAGAPDRCPPTCLFVRGMAELGAFFTILQDMRNTIMASKTVGTADEKLRKKSSFYQSYLRRTQSMGIQLDQRIIVMFMVAWAKEAVDNFHLGDDMHPELRSLAQILIDQKVKEISNQVPMKL

SEQ ID NO: 522 - protein, 429 aa, Artificial Sequence
  derived and/or modified protein sequence (wt) from SEOV(Gongzhuling97)__KF745946.1__N
MATMEEIQREISAHEGQLVIARQMVKDAEKQYEKDPADLNKRALHDRESVAASIQSKIDDLKRQLADRIAAGKNIGQDRDPTGVEPGDHLKERSALSYGNTLDLNSLDIDEPTGQTADWLTIIVYLTSFVVPIILKALYMLTTRGRQTSKDNKGMRIRFKDDSSYEDVNGIRMPKHLYVRMPNAQSSMKAEDITPGRFRTAVCGLYPAQIKARNMVSPLMSVVGFLALPKDWTSRIDEWLGAPCKFMAESPIAGSLSGNPVNRDHIRQRQGALAGMDPKEFQAVRQHAKDAGCTLVEHIESPSSIWVFAGAPDRCPPTCLFVGGMAELGAFFTILQDMRITIMASKTVGTADEKLRKKSSFYQSYLRRTQSMGIQLDQRLIVMFMVAWAKEAVDNFHLGDDMDPELRSLAQILIDQKVKQISNQVPMKL

SEQ ID NO: 523 - protein, 429 aa, Artificial Sequence
  derived and/or modified protein sequence (wt) from SEOV(Gou3)__AB027522.1__N
MATMEEIQREISAHEGQLVIARQKVKDAEKQYEKDPDDLNKRALHDRESVAASIQSKIDELKRQLADRIAAGKNIGQDRDPTGVEPGDHLKERSALSYGNTLDLNSLDIDEPTGQTADWLTIIVYLTSFVVPIILKALYMLTTRGRQTSKDNKGMRIRFKDDSSYEDVNGIRKPKHLYVSMPNAQSSMKAEEITPGSFRTAVCGLYPATIKARNMVSPVMSVVGFLALAKDWTSRIEDWLGAPCKFMAESPIAGSLSGNPVNRDYIRQRQGALAGMEPKEFQALRQHSKDAGCTMVEQIESPSSIWVFAGAPDRCPPTCLFVGGMAELGAFFSILQDMRNTIMASKTVGTADEKLRKKSSFYQSYLRRTQSMGIQLDQRIIVMFMVAWGKEAVDNFHLGDDMDPELRSLAQILIDQKVKEISNQEPMKL

SEQ ID NO: 524 - protein, 429 aa, Artificial Sequence
  derived and/or modified protein sequence (wt) from SEOV(Hb8610)__AF288643.1__N
MATMEEIQREISAHEGQLVIARQKVKDAEKQYEKDPDDLNKRALHDRESVAASIQSKIDELKRQLADRIAAGKSIGQDRDPTGVEPGDHLKERSALSYGNTLDLNSLDIDEPTGQTADWLTIIVYLTSFVVPIILKALYMLTTRGRQTSKDNKGMRIRFKDDSSYEDVNGIRKPKHLYVSMPNAQSSMKAEEITPGRFRTAVCGLYPAQIKARNMVSPVMSVVGFLALAKDWTSRIEEWLGAPCKFMAESPIAGSLSGNPVNRDYIRQRQGALAGMEPKEFQALRQHAKDAGCTLVEHIESPSSIWVFAGAPDRCPPTCLFVGGMAELGAFFSILQDMRNTIMASKTVGTADEKLRKKSSFYQSYLRRTQSMGIQLDQRIIVMFMVAWGKKAVDNFHLGDDMDPELRSLAQILIDQKVKEISNQEPMKL

SEQ ID NO: 525 - protein, 429 aa, Artificial Sequence
  derived and/or modified protein sequence (wt) from SEOV(HuBJ16)__GQ279380.1__N
MATMEEIQREISAHEGQLVIARQKVKNAEKQYEKDPDDLNKRALHDRESVAASIQSKIDELKRQLADRIAAGKNIGQDRDPTGVEPGDHLKERSALSYGNTLDLNSLDIDEPTGQTADWLTIIVYLTSFVVPIILKALYMLTTRGRQTSKDNKGMRIRFKDDSSYEDVNGIRKPKHLYVSMPNAQSSMKAEEITPGRFRTAVCGLYPAQIKARNMVSPVMSVVGFLALAKDWTSRIEEWLGAPCKFMAESPIAGSLSGTPVNRDYIRQRQGALAGMEPKEFQALRQHAKDAGCTLVEHIESPSSIWVFAGAPDRCPPTCLFVGGMAELGAFFSILQDMRNTIMASKTVGTADEKLRKKSSFYQSYLRRTQSMGIQLDQRIIVMFMVAWGKEAVDNFHLGDDMDPELRSLAQILIDQKVKEISNQEPMKL

SEQ ID NO: 526 - protein, 429 aa, Artificial Sequence
  derived and/or modified protein sequence (wt) from SEOV(HuBJ22)__GQ279379.1__N
MATMEEIQREISAHEGQLVIARQKVKDAEKQYEKDPDDLNKRALHDRESVAASIQSKIDELKRQLADRIAAGKNIGQDRDPTGVEPGDHLKERSALSYGNTLDLNSLDIDEPTGQTADWLTIIVYLTSFVVPIILKALYMLTTRGRQTSKDNKGMRIRFKDDSSYEDVNGIRKPKHLYVSMPNAQSSMKAEEITPGRFRTAVCGLYPAQIKARNMVSPVMSVVGFLALAKDWTSRIEEWLGAPCKFMAESPIAGSLSGTPVNRDYIRQRQGALAGMEPKEFQALRQHAKDAGCTLVEHIESPSSIWVFAGAPDRCPPTCLFVGGMAELGAFFSILQDMRNTIMASKTVGTADEKLRKKSSFYQSYLRRTQSMGIQLDQRIIVMFMVAWGKEAVDNFHLGDDMDPELRSLAQILIDQKVKEISNQEPMKL

SEQ ID NO: 527 - protein, 429 aa, Artificial Sequence
  derived and/or modified protein sequence (wt) from SEOV(HuBJ3)__GQ279391.1__N
MATMEEIQREISAHEGQLVIARQKVKDAEKQYEKDPDDLNKRALHDRESVAASIQSKIDELKRQLADRIAAGKNIGQDRDPTGVEPGDHLKERSALSYGNTLDLNSLDIDEPTGQTADWLTIIVYLTSFVVPIILKALYMLTTRGRQTSKVNKGMRIRFKDDSSYEDVNGIRKPKHLYVSMPNAQSSMKAEEITPGRFRTAVCGLYPAQIKARNMVSPVMSVVGFLALAKDWTSRIEEWLGAPCRFMAESPIAGSLSGNPVNRDYIRQRQGALAGMEPKEFQALRQHAKDAGCTLVEHIESPSSIWVFAGAPEGCPPTCLFVGGMAELGAFFSILQDMRNTIMASKTVGTADEKLRKKSSFYQSYLRRTQSMGIQLDQRIIVMFMVAWGKEAVDNFHLGDDMDPELRSLAQILIDQKVKEISNQEPMKL

SEQ ID NO: 528 - protein, 429 aa, Artificial Sequence
  derived and/or modified protein sequence (wt) from SEOV(K24-e7)__AF288653.1__N
MATMEEIQREISAHEGQLVIARQKVKDAEKQYEKDPDDFNKRALHDRESVAASIQSKIDELKRQLADRIAAGKNIGQDRDPTGVEPGDHLKERSALSYGNTLDLNSLDIDEPTGQTADWLTIIVYLTSFVVPIILKALYMLTTRGRQTSKDNKGMRIRFKDDSSYEDVNGIRKPKHLYVSMPNAQSSMKAEEITPGRFRTAVCGLYPAQIKARNMVSPVMSVVGFLALAKDWTSRIEEWLGAPCKFMAESPIAGSLSGNPVNRDYIRQRQGALAGMEPKEFQALRQHAKDAGCTLVEHIESPSSIWVFAGAPDRCPPTCLFVGGMAELGAFFSILQDMRNTIMASKTVGTADEKLRKKSSFYQSYLRRTQSMGIQLDQRIIVMFMVAWGKEAVDNFHLGDDMDPELRSLAQILIDQKVKEISNQEPMKL

SEQ ID NO: 529 - protein, 429 aa, Artificial Sequence
  derived and/or modified protein sequence (wt) from SEOV(K24-v2)__AF288655.1__N
MATMEEIQREISAHEGQLVIARQKVKDAEKQYEKDPDDFNKRALHDRESVAASIQSKIDELKRQLADRIAAGKNIGQDRDPTGVEPGDHLKERSALSYGNTLDLNSLDIDEPTGQTADWLTIIVYLTSFVVPIILKALYMLTTRGRQTSKDNKGMRIRFKDDSSYEDVNGIRKPKHLYVSMPNAQSSMKAEEITPGRFRTAVCGLYPAQIKARNMVSPVMSVVGFLALAKDWTSRIEEWLGAPCKFMAESPIAGSLSGNPVNRDYIRQRQGALAGMEPKEFQALRQHAKDAGCTLVEHIESPSSIWVFAGAPDRCPPTCLFVGGMAELGAFFSILQDMRNTIMASKTVGTADEKLRKKSSFYQSYLRHTQSMGIQLDQRIIVMFMVAWGKEAVDNFHLGDDMDPELRSLAQILIDQKVKEISNQEPMKL

SEQ ID NO: 530 - protein, 429 aa, Artificial Sequence
  derived and/or modified protein sequence (wt) from SEOV(OuhaiRf35)__FJ803208.1__N
MATMEEIQREISAHEGQLVIARQKVKDAEKQYEKDPDDLNKRALHDRESVAASIQSKIDELKRQLADRIAAGKNIGQDRDPTGVEPGDHLKERSALSYGNTLDLNSLDIDEPTGQTADWLTIIVYLTSFVVPIILKALYMLTTRGRQTSKDNKGMRIRFKDDSSYEDVNGIRKPKHLYVSMPNAQSSMKAEEITPGRFRTAVCGLYPAQIKARNMVSPVMSVVGFLALAKDWTSRIEEWLGAPCKFMAESPIAGSLSGNPVNRDYIRQRQGALAGMEPKEFQALRQHAKDAGCTLVEHIESPSSIWVFAGARDRCPPTCLFVGGMAELGAFFSILQDMRNTIMASKTVGTADEKLRKKSSFYQSYLRRTQSMGIQLDQRIIVMFMVAWGKEAVDNFHLGDDMDPELRSLAQILIDQKVKEISNQEPMKL

SEQ ID NO: 531 - protein, 429 aa, Artificial Sequence
  derived and/or modified protein sequence (wt) from SEOV(OuhaiRn146)__FJ803210.1__N
MATMEEIQREISAHEGQLVIARQKVKDAEKQYEKDPDDLNKRALHDRESVAASIQSKIDELKRQLADRIAAGKNIGQDRDPTGVEPGDHLKERSALSYGNTLDLNSLDIDEPTGQTADWLTIIVYLTSFVVPIILKALYMLTTRGRQTSKDNKGMRIRFKDDSSYEDVNGIRKPKHLYVSMPNAQSSMKAEEITPGRFRTAVCGLYPAQIKARNMVSPVMSVVGFLALAKDWTSRIEEWLGAPCKFMAESPIAGSLSGNPVNRDYIRQGQGALAGMEPKEFQALRQHAKDAGCTLVEHIESPSSIWVFAGARDRCPPTCLFVGGMAELGAFFSILQDMRNTIMASKTVGTADEKLRKKSSFYQSYLRRTQSMGIQLDQRIIVMFMVAWGKEAVDNFHLGDDMDPELRSLAQILIDQKVKEISNQEPMKL

SEQ ID NO: 532 - protein, 429 aa, Artificial Sequence
  derived and/or modified protein sequence (wt) from SEOV(Pf26)__AY006465.1__N
MATMEEIQREISAHEGQLVIARQKVKDAEKQYEKDPDDLNKRALHDRESVAASVQSKIDELKRQLADRIAAGKNIGQDRDPTGVEPGDHLKERSALSYGNTLDLNSLDIDEPTGQTADWLTIIVYLTSFVVPIILKALYMLTTRGRQTSKDNKGMRIRFKDDSSYEDVNGIRKPKHLYVSMPNAQSSMKAEEITPGRFRTAVCGLYPAQIKPRNMVSPVISVVGFLALAKDWTSRIEEWLGAPCKFMAESPIAGSLSGNPVNRDYIRQRQGALAGMEPKEFQALRQHAKDAGCTLVEHIESPSSIWVFAGAPDRCPPTCLFVGGMAELGAFFSILQDMRNTIMASKTVGTADEKLRKKSSFYQSYLRRTQSMGIQLDQRIIVMFMVAWGKEAVDNFHLGDDMDPELRSLAQILIDQKVKEISNQEPMKL

SEQ ID NO: 533 - protein, 429 aa, Artificial Sequence
  derived and/or modified protein sequence (wt) from SEOV(Rn-CP7)__GQ279382.1__N
MATMEEIQREISAHEGQLVIARQKVKDAEKQYEKDPDDLNKRALHDRESVAASIQSKIDELKRQLADRIAAGKNIGQDRDPTGVEPGDHLKERSALSYGNTLDLNSLDIDEPTGQTADWLTIIVYLTSFVVPIILKALYMLTTRGRQTSKDNKGMRIRFKDDSSYEDVNGIRKPKHLYVSMPNAQSSMKAEEITPGRFRTAVCGLYPAQIKARSMVSPVMSVVGFLALAKDWTSRIEEWLGAPCKFMAESPIAGSLSGNPVNRDYIRQRQGALAGMEPKEFQALRQHAKDAGCTLVEHIESPSSIWVFAGAPDRCPPTCLFVGGMAELGAFFSILQDMRNTIMASKTVGTADEKLRKKSSFYQSYLRRTQSMGIQLDQRIIVMFMVAWGKEAVDNFHLGDDMDPELRSLAQILIDQKVKEISNQEPMKL

SEQ ID NO: 534 - protein, 429 aa, Artificial Sequence
  derived and/or modified protein sequence (wt) from SEOV(Rn-DC8)__GQ279386.1__N
MATMEEIQREISAHEGQLVIARQKVKDAEKQYEKDPDDLNKRALHDRESVAASIQSKIDELKRQLADRIAAGKNIGQDRDPTGVEPGDHLKERSALSYGNTLDLNSLDIDEPTGQTADWLTIIVYLTSFVVPIILKALYMLTARGRQTSKDNKGMRIRFKDDSSYEDVNGIRKPKHLYVSMPNAQSSMKAEEITPGRFRTAVCGLYPAQIKARSMVSPVMSVVGFLALAKDWTSRIEEWLGAPCKFMAESPIAGSLSGNPVNRDYIRQRQGALAGMEPKEFQALRQHAKDAGCTLVEHIESPSSIWVFAGAPDRCPPTCLFVGGMAELGAFFSILQDMRNTIMASKTVGTADEKLRKKSSFYQSYLRRTQSMGIQLDQRIIVMFMVAWGKEAVDNFHLGDDMDPELRSLAQILIDQKVKEISNQEPMKL

SEQ ID NO: 535 - protein, 429 aa, Artificial Sequence
  derived and/or modified protein sequence (wt) from SEOV(Rn-M11)__GQ279383.1__N
MATMEEIQREISAHEGQLVIARQKVKNAEKQYEKDPDDLNKRALHDRESVAASIQSKIDELKRQLADRIAAGKNIGQDRDPTGVEPGDHLKERSALSYGNTLDLNSLDIDEPTGQTADWLTIIVYLTSFVVPIILKALYMLTTRGRQTSKDNKGMRIRFKDDSSYEDVNGIRKPKHLYVSMPNAQSSMKAEEITPGRFRTAVCGLYPAQIKARSMVSPVMSVVGFLALAKDWTSRIEEWLGAPCKFMAESPIAGSLSGNPVNRDYIRQRRGALAGMEPKEFQALRQHAKDAGCTLVEHIESPSSIWVFAGAPDRCPPTCLFVGGMAELGAFFSILQDMRNTIMASKTVGTADEKLRKKSSFYQSYLRRTQSMGIQLDQRIIVMFMVAWGKEAVDNFHLGDDMDPELRSLAQILIDQKVKEISNQEPMKL

SEQ ID NO: 536 - protein, 429 aa, Artificial Sequence
  derived and/or modified protein sequence (wt) from SEOV(RuianRf74)__FJ803213.1__N
MATMEEIQREISAHEGQLVIARQKVKDAEKQYEKDPDDLNKRALHDRESVAASIQSKIDELKRQLADRIAAGKNIGQDRDPTGVEPGDHLKERSALSYGNTLDLNSLDIDEPTGQTADWLTIIVYLTSFVVPIILKALYMLTTRGRQTSKDNKGMRIRFKDDSSYEDVNGIRKPKHLYVSMPNAQSSMKAEEITPGRFRMAVCGLYPAQIKARNMVSPVMSVVGFLALAKDWTSRIEEWLGAPCKFMAESPIAGSLSGNPVNRDYIRQRQGALAGMEPKEFQALRQHAKDAGCTLVEHIESPSSIWVFAGAPDRCPPTCLFVGGMAELGAFFSILQDMRNTIMASKTVGTADEKLRKKSSFYQSYLRRTQSMGIQLDQRIIVMFMVAWGKEAVDNFHLGDDIDPELRSLAQILIDQKVKEISNQEPMKL

SEQ ID NO: 537 - protein, 429 aa, Artificial Sequence
  derived and/or modified protein sequence (wt) from SEOV(RuianRn23)__FJ803214.1__N
MATMEEIQREISAHEGQLVIARQKVKDAEKQYEKDPDDLNKRALHDRESVAASIQSKIDELKRQLADRIAAGKNIGQDRDPTGVEPGDHLKERSALSYGNTLDLNSLDIDEPTGQTADWLTIIVYLTSFVVPIILKALYMLTTRGRQTSKDNKGMRIRFKDDSSYEDVNGIRKPKHLYVSMPNAQSSMKAEEITPGRFRTAVCGLYPAQIKARNMVSPVMSVVGFLALAKDWTSRIEEWLGAPCKFMAESPIAGSLSGNPVNRDYIRQRQGALAGMEPKEFQALRQHAKDAGCTLVEHIESPSSIWVFAGAPDRCPPTCLFVGGMAELGAFFSILQDMRNTIKASKTVGTADEKLRKKSSFYQSYLRRTQSMGIQLDQRIIVMFMVAWGKEAVDNFHLGDDMDPELRSLAQILIDQKVKEISNQEPMKL

SEQ ID NO: 538 - protein, 429 aa, Artificial Sequence
  derived and/or modified protein sequence (wt) from SEOV(RuianRn33)__FJ803215.1__N
MATMEEIQREISAHEGQLVIARQKVKDAEKQYEKDPDDLNKRALHDRESVAASIQSKIDELKRQLADRIAAGKNIGQDRDPTGVEPGDHLKERSALSYGNTLDLNSLDIDEPTGQTADWLTIIVYLTSFVVPIILKALYMLTTRGRQTSKDNKGMRIRFKDDSSYEDVNGIRKPKHLYVSMPNAQSSMKAEEITPGRFRTAVCGLYPAQIKARNMVSPVMSVVGFLALAKDWTSRIEEWLGAPCKFMAESPIAGSLSGNPVNRDYIRQRQGALAGMEPKEFQALRQHAKDAGCTLVEHIESPSSIWVFAGAPDRCPPTCLFVGGMAELGAFFSILQDMRNTIMASKTVGTADEKLRKKSSFYQSYLRRTQSMGIQLDQRIIVMFMVARGKEAMYNLHLRDDMTPQLLLLVQILLDHQVKEISNQELMKL

SEQ ID NO: 539 - protein, 429 aa, Artificial Sequence
  derived and/or modified protein sequence (wt) from SEOV(SC106)__GU361893.1__N
MATMEEIQREISAHEGQLVIARQKVKDAEKQYEKDPDDLNKRALHDRESVAASIQSKIDELKRQLADRIAAGKNIGQDRDPTGVEPGDHLKERSALSYGNTLDLNSLDIDEPTGQTADWLTIIVYLTSFVVPIILKALYMLTTRGRQTSKDNKGMRIRFKDDSSYEDVNGIRKPKHLYVPMPNAQSSMKAEEITPGRFRTAVCGLYPAQIKARNMVSPVMSVVGFLALAKDWTSRIEEWLGAPCKFMAESPIAGSLSGNPVNRDYIRQRQGALAGMEPKEFQALRQHAKDAGCTLVEHIESPSSIWVFAGAPDRCPPTCLFVGGMAELGAFFSILQDMRNTIMASKTVGTADEKLRKKSSFYQSYLRRTQSMGIQLDQRIIVMFMVAWGKEAVDNFHLGDDMDPELRSLAQILIDQKVKEISNQEPMKL

SEQ ID NO: 540 - protein, 429 aa, Artificial Sequence
  derived and/or modified protein sequence (wt) from SEOV(SEO/Belgium/Rn895/2005)__JQ898106.1__N
MATMEEIQREISAHEGQLVIARQKVKDAEKQYEKDPDDLNKRALHDRESVAASIQSKIDELKRQLADRIAAGKNIGQDRDPTGVEPGDHLKERSALSYGNTLDLNSLDIDEPTGQTADWLTIIVYLTSFVVPIILKALYMLTTRGRQTSKDNKGMRIRFKDDSSYEDVNGIRKPKHLYVSMPNAQSSMKAEEITPGRFRTAVCGLYPAQIKARNMVSPVMSVVGFLALAKDWTSRIEEWLGAPCKFMADSPIAGSLSGNPVNRDYIRQRQGALAGMEPKEFQALRQHSKDAGCTLVEHIESPSSIWVFAGAPDRCPPTCLFVGGMAELGAFFSILQDMRNTIMASKTVGTADEKLRKKSSFYQSYLRRTQSMGIQLDQRIIVMFMVAWGKEAVDNFHLGDDMDPELRSLAQILIDQKVKEISNQEPMKL

SEQ ID NO: 541 - protein, 429 aa, Artificial Sequence
  derived and/or modified protein sequence (wt) from SEOV(Taonan420)__KF745951.1__N
MATMEEIQREISAHEGQLVIARQNVKDAEKQYEKDPDDLNKRALHDRESVAASIQSKIDELKRQPADRIAAGKNIGQDRDPTGVEPGDHLKERSALSYGNTLDLNRLDIDEPTGQRADWLTIIVYLTSFVVRIILKALYMFSTRGRQTSKDNKGLRIRFKDDSSYEDFNGIRKPKHLYVPMPNAQSSMKAEEITPGRFRTAVCGLYPAQIKARNMVSPVMSVVGFLALAKDWTSRIEEWLGAPCKFMAESPIAGSLSGNPVNRDYIRQRQGALAAMEPKEFQALRQHAKDPGCTLVEHIESPSSIWVSAGAPDRCPPTCLFVGGMAELGAFFSIFQDMRNTIMPSKTVGTADEKLRKKSLFYQSYLRRTQSMGIQLDQRIIVMFMVAWGKEAVDNFHLPDDMDPELRSLAQILIVQKVKEISNQEPMKL

SEQ ID NO: 542 - protein, 429 aa, Artificial Sequence
  derived and/or modified protein sequence (wt) from SEOV(Taonan52)__KF745950.1__N
MATMEEIQREISAHEGQLVTARQKVKDAEKQYEKDPDDLNKRALHDRESVAASIQSKIDEVKRQLADRIAAGKNIGQDRDPTGVEPGDHPKERSALSYGNTLDLNSLDIDEPTGQTADWLTIIVYLTSFVVPIILKALYMSTTRGRQTSKDNRGMRIRFQDDSSYEDVNGIRKPKHLYVPMPNAQSSMKAEEVTPGRFRTAVCGLYPAQIKARNMVRPVMSVVGFLALAKAWTSRIEEWLGAPCKFMAESPIAGSLSGNPVYRDYIRQRQGALAGMEPKEFQALRQHAKDAGCTLVELIESPSSISVFAGAPDRCPRTCLFVGGMAELGANFSMLQDMSNTIMASKTVGTADEKLRKKSSFYQSYLRRTQSMGIQLDQRIIVMFMVASGKEAVDYFHLGDDMDPELRSLAPILIDQKVKEISNQEPMKL

SEQ ID NO: 543 - protein, 429 aa, Artificial Sequence
  derived and/or modified protein sequence (wt) from SEOV(WuhanMm24)__JQ665911.1__N
MATMEEIQREISAHEGQLVIARQKVKDAEKQYEKDPDDLNKRALHDRESAAASIQSKIDELKRQLADRIAAGKNIGQDRDPTGVEPGDHLKERSALSYGNTLDLNSLDIDEPTGQTADWLTIIVYLTSFVVPIILKALYMLTTRGRQTSKDNKGMRIRFKDDSSYEDVNGIRKPKHLYVSMPNAQSSMKAEEITPGRFRTAVCGLYPAQIKARNMVSPVMSVVGFLALAKDWTSRIEEWLGAPCKFMAESPIAGSLSGNPVNRDYIRQRQGALAGMEPKEFQALRQHSKDAGCTLVEHIESPSSIWVFAGAPDRCPPTCLFVGGMAGLGAFFSILQDMRNTIMASKTVGTADEKLRKKSSFYQSYLRRTQSMGIQLDQRIIVMFMVAWGKEAVDNFHLGDDMDPELRSLAQILIDQKVKEISNQEPMKL

SEQ ID NO: 544 - protein, 429 aa, Artificial Sequence
  derived and/or modified protein sequence (wt) from SEOV(WuhanRf02)__JQ665912.1__N
MATMEEIQREISAHEGQLVIARQKVKDAEKQYEKDPDDLNKRALHDRESVAASIQSKIDELKRQLADRIAAGKNIGQDRDPTGVEPGDHLEERSALSYGNTLDLNSLDIDEPTGQTADWLTIIVYLTSFVVPIILKALYMLTTRGRQTSKDNKGMRIRFKDDSSYEDVNGIRKPKHLYVSMPNAQSSMKAEEITPGRFRTAVCGLYPAQIKARDMVSPVMSVVGFLALAKDWTSRIEEWLGAPCKFMAESPIAGSLSGNPVNRDYIRQRQGALAGMEPKEFQALRQHSKDAGCTLVEHIESPSSIWVFAGARDRCPPTCLFVGGMAELGAFFSILQDMRNTIMASKTVGTADEKLRKKSSFYQSYLRRTQSMGIQLDQRIIVMFMVAWGKEAVDNFHLGDDMDPELRSLAQILIDQKVKEISNQEPMKL

SEQ ID NO: 545 - protein, 429 aa, Artificial Sequence
  derived and/or modified protein sequence (wt) from SEOV(WuhanRf07)__JQ665913.1__N
MATMEEIQREISAHEGQLVIARQKVKDAEKQYEKDPDDLNKRALHDRESVAASIQSKIDELKRQLADRIAAGKNIGQDRDPTGVEPGDHLKERSALSYGNTLDLNSLDIDEPTGQTADWLTIIVYLTSFVVPIILKALYMLTTRGRQTSKDNKGMRIRFKDDSSYEDVNGIRKPKHLYVSMPNAQSSMKAEEITPGRFRTAVCGLYPAQIKARNMVSPVMSVVGFLALAKDWTSRIEEWLGAPCKFMAESPIAGSLSGNPVNRDYIRQRQGALAGMEPKEFQALRQHSKDAGCTLVEHIESPSSIWVFAGARDRCPPTCLFVGGMAELGAFFSILQDMRNTIMASKTVGTADEKLRKKSSFYQSYLRRTQSMGIQLDQRIIVMFMVAWGKEAVDNFHLGDDMDPELRSLAQILIDQKVKEISNQEPMKL

SEQ ID NO: 546 - protein, 429 aa, Artificial Sequence
  derived and/or modified protein sequence (wt) from SEOV(ZJ5)__FJ753400.1__N
MATMEEIQREISAHEGQLVIARQKVKDAEKQYEKDPDDLNKRALHDRESVAASIQSKIDELKRQLADRIAAGKNIGQDRDPTGVEPGDHLKERSALSYGNTLDLNSLDIDEPTGQTADWLTIIVYLTSFVVPIILKALYMLTTRGRQTSKDNKGMRIRFKDDSSYEDVNGIRKPKHLYVSMPNAQSSMKAEEITPGRFRTAVCGLYPAQIKARNMVSPVMSVVGFLALAKDWTSRIEEWLGAPCKFMAESPIAGSLSGNLVNRDYIRQRQGALAGMEPKEFQALRQHSKDAGCTLVEHIESPSSIWVFAGAPDRCPPTCLFVGGMAELGAFFSILQDMRNTIMASKTVGTADEKLRKKSSFYQSYLRRTQSMGIQLDQRIIVMFIVAWGKEAVDNFHLGDDLDPELRSLAQILIDQKVKEISNQEPMKL

SEQ ID NO: 547 - protein, 429 aa, Artificial Sequence
  derived and/or modified protein sequence (wt) from SEOV(ZT10)__AY766368.1__N
MALCEEIQREISAHEGQLVIARQKVKDAEKQYEKDPDDFNKRALHDRESVAASIQSKIDELKRQLADRIAAGKNIGQDRDPTGVEPGDHLKERSALSYGNTLDLNSLDIDEPTGQTADWLTIIVYLTSFVVPIILKALYMLTTRGRQTSKDNKGMRIRFKDDSSYEDVNGIRKPKHLYVSMPNAQSSMKAEEITPGRFRTAVCGLYPAQIKARNMVSPVMSVVGFLALAKDWTSRIEEWLGAPCKFMAESPIAGSLSGNPVNRDYIRQRQGALAGMEPKEFQALRQHAKDAGCTLVEHIESPSSIWVFAGAPDRCPPTCLFVGGMAELGAFFSGLADMRNTIMASKTEGTADEKLRKKSSFYQSYLRRQQSMGIQLDQRIIVMFMVAWGKEAVDNFHLGDDMDPELRSLAQILIDQKVKEISNQEPMKL

SEQ ID NO: 548 - protein, 429 aa, Artificial Sequence
  derived and/or modified protein sequence (wt) from SEOV(ZT71)__AY750171.1__N
MATMEEIQREISAHEGQLVIARQKVKDAEKQYEKDPDDFNKRALHDRESVAASIQSKIDELKRQLADRIAAGKNIGQDRDPTGVEPGDHLKERSALSYGNTLDLNSLDIDEPTGQTADWLTIIVYLTSFVVPIILKALYMLTTRGRQTSKDNKGMRIRFKDDSSYEDVNGIRKPKHLYVSMPNAQSSMKAEEITPGRFRTAVCGLYPAQIKARNMVSPVMSVVGFLALAKDWTSRIEEWLGAPCKFMAESPIAGSLSGNPVNRDYIRQRQGALAGMEPKEFQALRQHAKDAGCTLVEHIESPSSIWVFAGAPDRCPPTCLFVGGMAELGAFFSILQDMRNTIMASKTEGTADEKLRKKSSFYQSYLRRQQSMGIQLDQRIIVMFMVAWGKEAVDNFHLGDDMDPELRSLAQILIDQKVKEISNQEPMKL

SEQ ID NO: 549 - protein, 429 aa, Artificial Sequence
  derived and/or modified protein sequence (wt) from SEOV(zy27)__AF406965.1__N
MATMEEIQREISAHEGQLVIARQKVKDAEKQYEKDPDDSNKRALHDRESVAASIQSKIDELKRQLADRIAAGKNIGQDRDPTGVEPGDHLKERSAPSYGNTLDLNSLDIDEPTGQTADWLTIIVYLTSFVVPIILKALYMLTTRGRQTSKDNKGMRIRFKDDSSYEDVNGIRKPKHLYVSMPNAQSSMKAEEITPERFRTAVCGLYPAQIKARNMVSPVMSVVGFLALAKDWTSRIEEWLGAPCKFMAESPIAGSLSGNPVNRDHIRQRQGALAGMEPKEFQALRQHAKDAGCTLVEHIESPSSIWVFAGAPDRCPPTCLFVGGMAELGAFFSILQDMRNTIMASKTVGTADEKLRKKSSFYQSYLRRTQSMGIQLDQRIIVMFMVAWGKEAVDNFHLGDDMDPELRSLAQILIDQKVKEISNQEPMKL

SEQ ID NO: 550 - protein, 429 aa, Artificial Sequence
  derived and/or modified protein sequence (wt) from SEOV(DN2)__KX289954.1__N
MATMEEIQREISAHEGQLVIARQKAKDAEKQYEKDPDDLNKRALHDRGSVAASIQSKIDELKRQLADRIAAGKNIGQDRDPTGVEPGDHLKERSALSYGNTLDLNSLDIDEPTGQTADWLTIIVYLTSFVVPIILKALYMLTTRGRQTSKDNKGMRIRFKDDSSYEDVNGIRKPKHLYVSMPNAQSSMKAEEITPGRFRTAVCGLYPAQIKARNMVSPVMSVVGFLALAKDWTSRIEEWLGEPCKFMAESPIAGSLSGNPVNRDYIRQRQGALAGMEPKEFQALRQHSKDAGCTLVEHIESPSSIWVFAGAPDRCPPTCLFVGGMAELGVFFSILQDMRNTIMASKTVGTADEKLRKKSSFYQSYLRRTQSMGIQLDQRIIVMFMVAWGKEAVDNFHLGDDMDPELRSLAQILIDQKVKEISNQEPMKL

SEQ ID NO: 551 - protein, 429 aa, Artificial Sequence
  derived and/or modified protein sequence (wt) from SEOV(IR162)__KX079476.1__N
MATMEEIQREISAHEGQLVIARQKVKDAEKQYEKDPDDLNKRALHDRESVAASIQSKIDELKRQLADRIAAGKNIGQDRDPTGVEPGDHLKERSALSYGNTLDLNSLDIDEPTGQTADWLTIIVYLTSFVVPIILKALYMLTTRGRQTSKDNKGMRIRFKDDSSYEDVNGIRKPKHLYVSMPNAQSSMKAEEITPGRFRTAVCGLYPAQIKARNMVSPVMSVVGFLALAKDWTSRIEEWLDTPCKFMVESPIAGSLSGNPVNRDYIRQRQGALAGMEPKEFQALRQHSKDAGCTLVEHIESPSSIWVFAGAPDRCPPTCLFVGGMAELGAFFSILQDMRNTIMASKTVGTADEKLRKKSSFYQSYLRRTQSMGIQLDQRIIVMFMVAWGKEAVDNFHLGDDMDPELRSLAQILIDQKVKEISNQEPMKL

SEQ ID NO: 552 - protein, 429 aa, Artificial Sequence
  derived and/or modified protein sequence (wt) from SEOV(Gou3)__AF184988.1__N
MATMEEIQREISAHEGQLVIARRKVKDAEKQYEKDPDDLNKRALHDRESVAASIQSKIDELKRQLADRIAAGKNIGQDRDPTGVEPGDHLKERSALSYGNTLDLNSLDIDEPTGQTADWLTIIVYLTSFVVPIILKALYMLTTRGRQTSKDNKGMRIRFKDDSSYEDVNGIRKPKHLYVSMPNAQSSMKAEEITPGRFRTAVCGLYPAQIKARNMVSPVMSVVGFLALAKDWTSRIEDWLGAPCKFMAESPIAGSLSGNPVNRDYIRQRQGALAGMEPKEFQALRQHSKDAGCTLVEHIESPSSIWVFAGAPDRCPPTCLFVGGMAELGAFFFILQDMRNTIMASKTVGTADEKLRKKSSFYQSYLRRTQSMGIQLDQRIIVMFMVAWGKEAVDNFHLGDDMDPELRSLAQILIDQKVKEISNQEPMKL

SEQ ID NO: 553 - protein, 429 aa, Artificial Sequence
  derived and/or modified protein sequence (wt) from SEOV(Gou3-v9)__AF288651.1__N
MATKEEIQREISAHEGQLVIARQKVKDAEKQYEKDPDVLNKRALHDRESVAASIQSKIDELKRQLADRIAAGKSIGQDRDPTGVEPGDHLKERSALSYGNTLDLNSLDIDEPTGQTADWLTIIVYLTSFVVPIILKALYMLTTRGRQTSKDNRGMRIRFKDDSSYEDVNGIRKPKHLYVSMPNAQSSMKAEEITPGRFRTAVCGLYPAQIKARNMVSPVMSVVGFLALAKDWTSRIEDWLGAPCKFMAESPIAGSLSGNPVNRDYIRQRQGALAGMEPKEFQALRQHSKDAGCTLVEHIESPSSIWVFAGAPDRCPPTCLFVGGMAELGAFFSILQDMRNTIMASKTVGTADEKLRKKSSFYQSYLRRTQSMGIQLDQRIIVMFMVAWGKEAVDNFHLGDDMDPELRSLAQILIDQKVKEISNQEPMKL

SEQ ID NO: 554 - protein, 429 aa, Artificial Sequence
  derived and/or modified protein sequence (wt) from SEOV(IR461)__AF329388.1__N
MATMEEIQREISAHEGQLVIARQKVKDAEKQYEKDPDDLNKRALHDRESVAASIQSKIDELKRQLADRIAAGKNIGQDRDPTGVEPGDHLKERSALSYGNTLDLNSLDIDEPTGQTADWLTIIVYLTSFVVPIILKALYMLTTRGRQTSKDNKGIRIRFKDDSSYENVNGIRKPKHLYVSMPNAQSSMKAEEITPGRFRTAVCGLYPAQIKAGNMVSPVMSVVGFLALAKDWTSRIEEWLDTPCKFMVESPIAGSLSGNPVNRDYIRQRQGALAGMEPKEFQALRQHSKDAGCTLVEHIESPSSIWVFAGAPDRCPPTCLFVGGMAELGAFFSILQDMRNTIMASKTVGTADEKLRKKSSFYQSYLRRTQSMGIQLDQRIIVMFMVAWGKEAVDNFHLGDDMDPELRSLAQILIDQKVKEISNQEPMKL

SEQ ID NO: 555 - protein, 429 aa, Artificial Sequence
  derived and/or modified protein sequence (wt) from SEOV(JUN5-14)__DQ217791.1__N
MATMEEFQREISAHEGQLVIARQKVKDAEKQYEKDPDDLNKRALHDRESVAASIQSKIDELKRQLADRIAAGKNIGQDRDPTGVEPGDHLKERSALSYGNTLDLNSLDIDEPTGQTADWLTIIVYLTSFVVPIILKALYMLTTRGRQTSKDNKGMRIRFKDDSSYEDVNGIRKPKHLYVSMPNAQSSMKAEEITPGRFRTAVCGLYPAQIKARNMVSPVMSVVGFLALAKDWTSRIEEWLGAPCKFMAESPIAGSLSGNPVNRDYIRQRQGALAGMEPKEFQALRQHAKDAGCTLVEHIESPSSIWVFAGAPDRCPPTCLFVGGMAELGAFFSILQDMRNTIMASKTVGTADEKLRKKSSFYQSYLRRTQSMGIQLDQRIIVMFMVAWGKEAVDNFHLGDDMDPELRSLAQILIDQKVKEISNQEPMKL

SEQ ID NO: 556 - protein, 429 aa, Artificial Sequence
  derived and/or modified protein sequence (wt) from SEOV(L99)__AF488708.1__N
MATMEEIQREISAHEGQLVIARQKVKDAEKQYEKDPDDLNKRTLHDRESVAASIQSKIDELKRQLADRIAAGKNIGQDRDPTGVEPGDHLKERSALSYGNTLDLNSLDIDEPTGQTADWLTIIVYLTSFVVPIILKALYMLTTRGRQTSKDNKGMRIRFKDDSSYEDVNGIRKPKHLYVSMPNAQSSMKAEEITPGRFRTAVCGLYPAQIKARNMVSPVMSVVGFLALAKDWTSRIEEWLGAPCKFMAESPIAGSLSGNPVNRDYIRQRQGALAGMEPKEFQALRQHAKDAGCTLVEHIESPSSIWVFAGAPDRCPPTCLFVGGMAELGAFFSILQDMRNTIMASKTVGTADEKLRKKSSFYQSYLRRTQSMGIQLDQRIIVMFMVAWGKEAVDNFHLGDDMDPELRSLAQILIDQKVKEISNQEPMKL

SEQ ID NO: 557 - protein, 429 aa, Artificial Sequence
  derived and/or modified protein sequence (wt) from SEOV(R22)__AF488707.1__N
MATMEEIQREISAHEGQLVIARQKVKDAEKQYEKDPDDLNKRALHDRESVAASIQSKIDELKRQLADRIAAGKNIGQDRDPTGVEPGDHLKERSALSYGNTLDLNSLDIDEPTGQTADWLTIIVYLTSFVVPIILKALYMLTTRGRQTSKDNKGMRIRFKDDSSYEDVNGIRKPKHLYVSMPNAQSSMKAEEITPGRFRTAVCGLYPAQIKARNMVSPVMSVVGFLALAKDWTSRIEEWLGAPCKFMAESPIAGSLSGNPVNRDYIRQRQGALAGMEPKEFQALRQHAKDAGCTLVEHIESPSSIWVFAGAPDRCPPTCLFVGRMAELGAFFSILQDMKNTIMASKTVGTADEKLRKKSSFYQSYLRRTQSMGIQLDQRIIVMFMVAWGKEAVDNFHLGDDMDPELRSLAQILIDQKVKEISNQEPMKL

SEQ ID NO: 558 - protein, 429 aa, Artificial Sequence
  derived and/or modified protein sequence (wt) from SEOV(TURCKHEIM/Hu/FRA/2016/2016.00044)__KX064270.1__N
MATMEEIQREISAHEGQLVIARQKVKDAEKQYEKDPDDLNKRALHDRESVAASIQSKIDELKRQLADRIAAGKNIGQDRDPTGVEPGDHLKERSALSYGNTLDLNSLDIDEPTGQTADWLTIIVYLTSFVVPIILKALYMLTTRGRQTSKDNKGMRIRFKDDSSYEDVNGIRKPKHLYVSMPNAQSSMKAEEITPGRFRTAVCGLYPAQIKARNMVSPVMSVVGFLALAKDWTSRIEEWLDAPCKFIAESPIAGSLSGNPVNRDYIRQRQGALAGMEPKEFQALRQHSKDAGCTLVEHIESPSSIWVFAGAPDRCPPTCLFVGGMAELGAFFSILQDMRNTIMASKTVGTADEKLRKKSSFYQSYLRRTQSMGIQLDQRIIVMFMVAWGKEAVDNFHLGDDMDPELRSLAQILIDQKVKEISNQEPMKL

SEQ ID NO: 559 - protein, 429 aa, Artificial Sequence
  derived and/or modified protein sequence (wt) from SEOV(Z37)__AF187082.1__N
MATMEEIQREISAHEGQLVIARQKVKDAEKQYEKDPDDFNKRALHDRESVAASIQSKIDELKRQLADRIAAGKNIGQDRDPTGVEPGDHLKERSALSYGNTLDLNSLDIDEPTGQTADWLTIIVYLTSFVVPIILKALYMLTTRGRQTSKDNKGMRIRFKDDSSYEDVNGIRKPKHLYVSMPNAQSSMKAEEITPGRFRTAVCGLYPAQIKARNMVSPVMSVVGFLALAKDWTSRIEEWLGAPCKFMAESPIAGSLSGNPVNRDYIRQRQGALAGMEPKEFQALRQHAKDAGCTLVEHIESPSSIWVFAGAPDRCPPTCLFVGGMAELGAFFSILQDMRNTIMASKTVGTADEKLRKKSSFYQSYLRRTQSMGIQLDQRIIGMFMVAWGKEAVDNFHLGDDMDPELRSLAQILIDQKVKEISNQEPMKL

SEQ ID NO: 560 - protein, 429 aa, Artificial Sequence
  derived and/or modified protein sequence (wt) from SEOV(Tchoupitoulas (TCH))__AF329389.1__N
MATMEEIQREISAHEGQLVIARQKVKDAEKQYEKDPDDFYKRALHDRESVAASIQSKIDELKRQLADRIAAGKNIGQDRDPTGVEPGDHLKERSALSYGNTLDLNSLDIDEPTGQTADWLTIIVYLTSFVVPIILKALYMLTTRGRQTSKDNKGMRIRFKDDSSYEDVNGIRKPKHLYVSMPNAQSSMKAEEITPGRFRTAVCGLYPAQIKARNMVSPVMSVVGFLALAKDWTSRIEEWLGAPCKFMAESPIAGSLSGNPVNRDYIRQRQGALAGMEPKEFQALRQHSKDAGCTLVEHIESPSSIWVFAGAPDRCPPTCLFVGGMAELGAFFSILQDMRNTIMASKTVGTADEKLRKKSSFYQSYLRRTQSMGIQLDQRIIVMFMVAWGKEAVDNFHLGDDMDPELRSLAQILIDQKVKEISNQEPMKL

SEQ ID NO: 561 - protein, 429 aa, Artificial Sequence
  derived and/or modified protein sequence (wt) from SEOV__M34881.1__N
MATMEEIQREISAHEGQLVIARQKVKDAEKQYEKDPDDLNKRALHDRESVAASIQSKIDELKRQLADRLQQGRTSGQDRDPTGVEPGDHLKERSALSYGNTLDLNSLDIDEPTGQTADWLTIIVYLTSFVVPIILKALYMLTTRGRQTSKDNKGMRIRFKDDSSYEDVNGIRKPKHLYVSMPNAQSSMKAEEITPGRFRTAVCGLYPAQIKARNMVSPVMSVVGFLALAKDWTSRIEEWLGAPCKFMAESLIAGSLSGNPVNRDYIRQRQGALAGMEPKEFQALRQHSKDAGCTLVEHIESPSSIWVFAGAPDRCPPTCLFVGGMAELGAFFSILQDMRNTIMASKTVGTADEKLRKKSSFYQSYLRRTQSMGIQLDQRIIVMFMVAWGKEAVDNFHLGDDMDPELRSLAQILIDQKVKEISNQEPMKL

SEQ ID NO: 562 - protein, 428 aa, Artificial Sequence
  derived and/or modified protein sequence (wt) from SNV(H10)__NC_005216.1__N
MSTLKEVQDNITLHEQQLVTARQKLKDAERAVELDPDDVNKSTLQSRRAAVSALETKLGELKRELADLIAAQKLASKPVDPTGIEPDDHLKEKSSLRYGNVLDVNSIDLEEPSGQTADWKSIGLYILSFALPIILKALYMLSTRGRQTIKENKGTRIRFKDDSSYEEVNGIRKPRHLYVSMPTAQSTMKADEITPGRFRTIACGLFPAQVKARNIISPVMGVIGFSFFVKDWMERIDDFLAARCPFLPEQKDPRDAALATNRAYFITRQLQVDESKVSDIEDLIADARAESATIFADIATPHSVWVFACAPDRCPPTALYVAGMPELGAFFAILQDMRNTIMASKSVGTSEEKLKKKSAFYQSYLRRTQSMGIQLDQKIIILYMSHWGREAVNHFHLGDDMDPELRELAQTLVDIKVREISNQEPLKL

SEQ ID NO: 563 - protein, 428 aa, Artificial Sequence
  derived and/or modified protein sequence (wt) from SNV(2)__JQ690282.1__N
MSTLKEVQDNITLHEQQLVTARQKLKDAERAVELDPDDVNKSTLQSRRAAVSALETKLGELKRELADLIAAQKLASKPVDPTGIEPDDHLKEKSSLRYGNVLDVNSIDLEEPSGQTADWKSIGLYILSFALPIILKALYMLSTRGRQTIKENKGTRIRFKDDSSYEEVNGIRKPRHLYVSMPTAQSTMKADEITPGRFRTIACGLFPAQVKARNIISPVMGVIGFSFFVKDWMERIDDFLAARCPFLPEQKDPRDAALATNRAYFITRQMQVDESKVSDIEDLIADARAESATIFADIATPHSVWVFACAPDRCPPTALYVAGMPELGAFFAILQDMRNTIMASKSVGTSEEKLKKKSAFYQSYLRRTQSMGIQLDQKIIILYMSHWGREAVNHFHLGDDMDPELRELAQTLVDIKVREISNQEPLKL

SEQ ID NO: 564 - protein, 428 aa, Artificial Sequence
  derived and/or modified protein sequence (wt) from SNV(3)__JQ690278.1__N
MSTLKEVQDNITLHEQQLVTARQKLKDAERAVELDPDDVNKSTLQSRRAAVSALETKLGELKRELADLIAAQKLASKPVDPTGIEPDDHLKEKSSLRYGNVLDVNSIDLEEPSGQTADWKSIGLYILSFALPIILKALYMLSTRGRQTIKENKGTRIRFKDDSSYEEVNGIRKPRHLYVSMPTAQSTMKADEITPGRFRTIACGLFPAQVKARNIISPVMGVIGFSFFVKDWMERIDDFLAARCPFLPEQKDPRDAALATNRAYFITRQLQVDESKVSDIEDLIADARAESATIFADIATPHSVWVFACAPDRCPPTALYVAGMPELGAFFAILQDMRNTIMASKSVGTSEEKLKKKSAFYQSYLRRTQSMGIQPDQKIIILYMSHWGREAVNHFHLGDDMDPELRELAQTLVDIKVREISNQEPLKL

SEQ ID NO: 565 - protein, 428 aa, Artificial Sequence
  derived and/or modified protein sequence (wt) from SNV(CC107/POR)__KT885046.1__N
MSTLKEVQDNITLHEQQLVTTRQKLKDAERAVELDPDDVNKSTLQSRRAAVSALETKLGELKRELADLIAAQKLASKPVDPTGIEPDDHLKEKSSLRYGNVLDVNSIDLEEPSGQTADWKSIGLYILSFALPIILKALYMLSTRGRQTIKENKGTRIRFKDDSSYEEVNGIRKPRHLYVSMPTAQSTMKADEITPGRFRTIACGLFPAQVKARNIISPVMGVIGFSFFVKDWMERIDEFLAARCPFLPEQKDPRDAALATNRAYFITRQMQVDESKVSDIEDLIADARAESATIFADIATPHSVWVFACAPDRCPPTALYVAGMPELGAFFAILQDMRNTIMASKSVGTSEEKLKKKSAFYQSYLRRTQSMGIQLDQKIIILYMSHWGREAVNHFHLGDDMDPELRELAQTLVDIKVREISNQEPLKL

SEQ ID NO: 566 - protein, 428 aa, Artificial Sequence
  derived and/or modified protein sequence (wt) from HPS(Convict Creek 107)__L33683.1__N
MSTLKEVQDNITLHEQQLVTTRQKLKDAERAVELDPDDVNKSTLQSRRAAVSALETKLGELKRELADLIAAQKLASKPVDPTGIEPDDHLKEKSSLRYGNVLDVNSIDLEEPSGQTADWKSIGLYILSFALPIILKALYMLSTRGRQTIKENKGTRIRFKDDSSYEEVNGIRKPRHLYVSMPTAQSTMKADEITPGRFRTIACGLFPAQVKARNIISPVMGVIGFSFFVKDWMERIDEFLAARCPFLPEQKDPRDAALATNRAYFITRQMQVDESKVSDIEDLIADARAESATIFADIATPHSVWVFACAPDRCPPTALYVAGMPELGAFFGILQDMRNTIMASKSVGTSEEKLKKKSAFYQSYLRRTQSMGIQLDQKIIILYMSHWGREAVNHFHLGDDMDPELRELAQTLVDIKVREISNQEPLKL

SEQ ID NO: 567 - protein, 428 aa, Artificial Sequence
  derived and/or modified protein sequence (wt) from HPS(Convict Creek 74)__L33816.1__N
MSTLKEVQDNITLHEQQLVTSRQKLKDAERAVELDPDDVNKSTLQSRRAAVSALETKLGELKRELADHIAAQKLASKPVDPTGIEPDDHLKEKSSLRYGNVLDVNSIDLEEPNGQTADWKSIGLYILSFALPIILKALYMLSTRGRQTIKENKGTRIRFKDDSSYEEVNGIRKPRHLYVSMPTAQSTMKADEITPGRFRTIACGLFPAQVKARNIISPVMGVIGFSFFVKDWMERIDEFLAARCPFLPEQKDPRDAALATNRAYFITRQLQVDESKVSDIEDLIADARAESATIFADIATPHSVWVFACAPDRCPPTALYVAGMPELGAFFGILQDMRNTIMASKSVGTSEEKLKKKSAFYQSYLRRTQSMGIQLDQKIIILYMSHWGREAVNHFHLGDDMDPELRELAQTLVDIKVREISNQEPLKL

SEQ ID NO: 568 - protein, 428 aa, Artificial Sequence
  derived and/or modified protein sequence (wt) from HPS(H-NY1)__U47135.1__N
MSTLKEVQDNITLHEQQLVTARQKLKDAEKAVEVDPDDVNKSTLQGRRAAVSALETKLGELKRQLADLIAAQKLASKPIDPTGIEPDDHLKEKSSLRYGNVLDVNSIDLEEPSGQTADWKAIGMYILSFAIPIILKALYMLSTRGRQTVKENKGTRIRFKDDSSYEEVNGIRKPRHLYVSMPTAQSTMKADEITPGRFRTIACGLFPAQVKARNIISPVMGVIGFNFFVKDWMDRIDDFLAERCPFLPEPRDPKDAALGTNRAYFITRQAQVDESKVVDIEELIVDARAESATLFTDIATPHSVWVFACAPDRCPPTALYVAGMPELGAFFAILQDMRNTIMASKSVGTAEEKLKKKSAFYQSYLRRTQSMGIQLDQKIIILYMIHWGKEAVNHFHLGDDMDPELRELAQALVDAKVKEISNQEPLKL

SEQ ID NO: 569 - protein, 429 aa, Artificial Sequence
  derived and/or modified protein sequence (wt) from THAIV(Nakhon Ratchasima/Bi0017/2004)__AM397664.1__N
MATMEELQREINAHEGQLVVARQKVKDAEKQYEKDPDDLNRRALHDRESVAASIQSKIDELKRQLADRIASGRTIGQDRDPTGVEPGDHLRERSMLSYGNVLDLNNLDIEEPTGQTADWLTIIVYLTSFVIPIILKALYMLTTRGRQTTKDNKGMRIRFKDDSSYEDVNGIRKPKHLYISMPNAQSSMKAEEITPGRFRTAVCGLYPAQVKARNMVSPVMSVIGFMALAKDWTDRIQDWLGAPCKFLPDLSTQSLHASPPTNADYIAQRQGLLAGMETKESKGIRDHARDAGCTLVDHLDSPSSIWVFAGAPDRCPPTCLFIAGMAELGAFFSILQDMRNTIMASKTVGTSEEKLKKKSSFYQSYLRRTQSMGIQLDQRIIVMFMVAWGKEAVDNFHLGDDMDPELRNLAQLLIDQKVKEISNQEPLKL

SEQ ID NO: 570 - protein, 429 aa, Artificial Sequence
  derived and/or modified protein sequence (wt) from TULV(Tula/Moravia/5302Ma/94)__NC_005227.2__N
MSQLKEIQEEITRHEQQIVIARQKLKDAEKTVEADPDDVNKSTLQSRRAAVSALEDKLADFKRQLADLVSSQKMGEKPVDPTGLEPDDHLKERSSLRYGNVLDVNAIDIDEPSGQTADWFSIGQYITGFALAIILKALYMLSTRGRQTIKENKGTRIRFKDDSSYEEINGIRRPKHLYVSMPTAQSTMKADELTPGRFRTIVCGLFPAQIMHRNIISPVMGVIGFSFFVKDWPEKIEEFLIKPCPFLKKSGPSKEEDFLVSNDAYLLGREKALRESHLAEIDDLIDLAASGDPTPPDSIKSPQAPWVFACRPDRCPPTCIYIAGMAELGAFFSILQDMRNTIMASKTVGTAEEKLKKKSSFYQSYLRRTQSMGIQLDQRIILLFMTEWGSDIVNHFHLGDDMDPELRTLAQSLIDQKVKEISNQEPLKI

SEQ ID NO: 571 - protein, 430 aa, Artificial Sequence
  derived and/or modified protein sequence (wt) from TULV(D17-98)__AF289820.1__N
MSQLKEIQEEITRHEQQIVIARQKLKDAEKTVEADPDDVNKSTLQSRRAAVSALEDKLADFKRQLADLVSSQKMGEKPVDPTGLEPDDHLKERSSLRYGNVLDVNAIDIDEPSGQTADWFSIGQYIIGFALAIVLKALYMLSTRGRQTIKENKGTRIRFKDDSSYEEINGIRRPKHLYVSMPTAQSTMKADELTPGRFRTIVCGLFPAQIMHRNIISPVMGVIGFSFFVKDWPDKIEEFLIKPCPFLKKQGGPNKDEEFLVSYDAYLLGREKALRESHLAEIDDLIDLAASGDPTPPDSIKSPQGPWVFACAPDRCPPTCIYVAGMAELGAFFSILQDMRNTIMASKTVGTAEEKLKKKSSFYQSYLRRTQSMGIQLDQRIILLFMMEWGSDIVNHFHLGDDMDPELRTLAQSLIDQKVKEISNQEPLKI

SEQ ID NO: 572 - protein, 430 aa, Artificial Sequence
  derived and/or modified protein sequence (wt) from TULV(D5-98)__AF289819.1__N
MSQLKEIQEEITRHEQQIVIARQKLKDAEKTVEADPDDVNKSTLQSRRAAVSALEDKLADFKRQLADLVSSQKMGEKPVDPTGLEPDDHLKERSSLRYGNVLDVNAIDIDEPSGQTADWFSIGQYIIGFALAIVLKALYMLSTRGRQTIKENKGTRIRFKDDSSYEEINGIRRPKHLYVSMPTAQSTMKADELTPGRFRTIVCGLFPAQIMHRNIISPVMGVIGFSFFVKDWPDKIEEFLIKPCPFLKKQGGPNKDEEFLVSYDAYLLGREKALRESHLAEIDDLIDLAASGDPTPPDSIKSPQAPWVFACAPDRCPPTCIYVAGMAELGAFFSILQDMRNTIMASKTVGTAEEKLKKKSSFYQSYLRRTQSMGIQLDQRIILLFMMEWGSDIVNHFHLGDDMDPELRTLAQSLIDQKVKEISNQEPLKI

SEQ ID NO: 573 - protein, 430 aa, Artificial Sequence
  derived and/or modified protein sequence (wt) from TULV(D63-98)__AF289821.1__N
MSQLKEIQEEITRHEQQIVIARQKLKDAEKTVEADPDDVNKSTLQSRRAAVSALEDKLADFKRQLADLVSSQKMGEKPVDPTGLEPDDHLKERSSLRYGNVLDVNAIDIDEPSGQTADWFSIGQYIIGFALAIVLKALYMLSTRGRQTIKENKGTRIRFKDDSSYEEINGIRRPKHLYVSMPTAQSTMKADELTPGRFRTIVCGLFPAQIMHRNIISPVMGVIGFSFFVKDWPDKKEEFLIKPCPFLKKQGGPNKDEEFLVSNDAYLLGREKALRESHLAEIDDLIDLAASGDPTPPDSIKSPQGPWVFACAPDRCPPTCIYVAGMAELGAFFSILQDMRNTIMASKTVGTAEEKLKKKSSFYQSYLRRTQSMGIQLDQRIILLFMMEWGSDIVNHFHLGDDMDPELRTLAQSLIDQKVKEISNQEPLKI

SEQ ID NO: 574 - protein, 429 aa, Artificial Sequence
  derived and/or modified protein sequence (wt) from TULV(MG23/Omsk)__AF442621.1__N
MSTLKEIQEEITRHEQQIVIARQKLKDAEKTVEADPDDVNKNTLQSRRAAVSTLEDKLAEFKRQLADLVSSQKMGEKPVDPTGLEPDDHLKERSSLRYGNVLDVNATDIDEPSGQTADWFSIGQYIMGFALAIVLKALYMLSTRGRQTIKENKGTRIKFKDDSSIEEINGIRRPKHLYVSMPTAQSTMKADELTPGRFRTIVCGLFPAQIMHRNIISPVMGVIGFSFFVKDWPDKIEEFLIKPCPFLKKQGSTKEEEFLVSNDAYMLGREKALRESHLAEIDELIDLADSGDPTPPDSIKSPQAPWVFACAPDRCPPTCIYIAGMAELGAFFSILQDMRNTIMASKTVGTAEEKLKKKSSFYQSYLRRTQSMGIQLDQRIILLFMMEWGSDIVNHFHLGDDMDPELRTLAQSLIDQKVKEISNQEPLKI

SEQ ID NO: 575 - protein, 429 aa, Artificial Sequence
  derived and/or modified protein sequence (wt) from TULV(c109-s)__AF164094.1__N
MSQLKEIQEEITRHEQQIVIARQKLKDAEKTVEADPDDVNKSTLQSRRAAVSALEDKLADFKRQLADLVSSQKMGEKPVDPTGLEPDDHLKERSSLRYGNVLDVNAIDIDEPSGQTADWFSIGQYITGFALAIILKALYMLSTRGRQTIKENKGTRIRFKDDSSYEEINGIRRPKHLYVSMPTAQSTMKADELTPGRFRTIVCGLFPAQIMHRNIISPVMGVIGFSFFVKDWPEKIEEFLIKPCPFLKKSGPSKEEDFLVSNDAYLLGREKALRESHLAEIDDLIDLAASGDPTPPDSIKSPQAPWVFACAPDRCPPTCIYIAGMAELGAFFSILQDMRNTIMASKTVGTSEEKLKKKSSFYQSYLRRTQSMGIQLDQRIILLFMTEWGSDIVNHFHLGDDMDPELRTLAQSLIDQKVKEISNQEPLKI

SEQ ID NO: 576 - protein, 429 aa, Artificial Sequence
  derived and/or modified protein sequence (wt) from TULV(CHEVRU/Hu/FRA/2015/15.00453)__KT946591.1__N
MSQLKEIQEEITRHEQQIVIARQKLKDAEKTVEADPDDVNKSTLQSRQAAVSALEDKLADFKRKLADLVSSQKMGEKPVDPTGLEPDDHLKERSSLRYGNVLDVNAIDIDEPSGQTADWFSIGQYVMGFALAIILKALYMLSTRGRQTIKENKGTRIRFKDDSSYEEINGIRRPKHLYVSMPTAQSTMKADELTPGRFRTIVCGLFPAQIMHRNIISPVMGVIGFSFFVKDWPEKIEEFLIKPCPFLKKSGPSKEEDFLVSNDAYLLGREKALRDSHLAEIDDLIDLAESGDPTPPDSIKSPQAPWVFACAPDRCPPTCIYIAGMAELGAFFSILQDMRNTIMASKTVGTAEEKLKKKSSFYQSYLRRTQSMGIQLDQRIILLFMIEWGSDIVNHFHLGDDMDPELRTLAQSLIDQKVKEISNQEPLKI

SEQ ID NO: 577 - protein, 429 aa, Artificial Sequence
  derived and/or modified protein sequence (wt) from TULV(g20-s)__AF164093.1__N
MSQLKEIQEEITRHEQQIVIARQKLKDAEKTVEADPDDVNKSTLQSRQAAVSALEDKLADFKRKLADLVSSQKMGEKPVDPTGLEPDDHLKERSSLRYGNVLDVNAIDIDEPSGQTADWFSIGQYVMGFALAIILKALYMLSTRGRQTIKENKGTRIRFKDDSSYEEINGIRRPKHLYVSMPTAQSTMKADELTPGRFRTIVCGLFPAQIMHRNIISPVMGVIGFSFFVKDWPEKIEEFLIKPCPFLKKSGPSKEEDFLVSNDAYLLGREKALRDSHLAEIDDLIDLAESGDPTPPDSIKSPQAPWVFACAPDRCPPTCIYIAGMAELGAFFSILQDMRNTIMASKTVGTAEEKLKKKSSFYQSYLRRTQSMGIQLDQRIILLFMTEWGSDIVNHFHLGDDMDPELRTLAQSLIDQKVKEISNQEPLKI

SEQ ID NO: 578 - protein, 430 aa, Artificial Sequence
  derived and/or modified protein sequence (wt) from TULV(Sennickerode Sen05/174)__EU439948.1__N
MSQLKEIQEEITRHEQQIVIARQKLKDAEKTVEADPDDVNKSTLQSRRAAVSALEDKLADFKRQLADLVSSQKMGEKPVDPTGLEPDDHLKERSSLRYGNVLDVNAIDIDEPSGQTADWFSIGQYIIGFALAIVLKALYMLSTRGRQTIKENKGTRIRFKDDSSFEEINGIRRPKHLYVSMPTAQSTMKADELTPGRFRTIVCGLFPAQIMHRNIISPVMGVIGFSFFVKDWPDKIEEFLIKPCPFLKKQGGPNKDEDFLVSNDAYFLGREKALRESHLNEIDDLIELAASGDPTPPDSIKSPQAPWVFACAPDRCPPTCIYVAGMAELGAFFSILQDMRNTIMASKTVGTAEEKLKKKSSFYQSYLRRTQSMGIQLDQRIILLFMMEWGSDIVNHFHLGDDMDPELRTLAQSLIDQKVKEISNQEPLKI

SEQ ID NO: 579 - protein, 430 aa, Artificial Sequence
  derived and/or modified protein sequence (wt) from TULV(Sennickerode Sen05/175)__EU439949.1__N
MSQLKEIQEEITRHEQQIVIARQKLKDAEKTVEADPDDVNKSTLQSRRAAVSALEDKLADFKRQLADLVSSQKMGEKPVDPTGLEPDDHLKERSSLRYGNVLDVNAIDIDEPSGQTADWFSIGQYIIGFALAIVLKALYMLSTRGRQTIKENKGTRIRFKDDSSFEEINGIRRPKHLYVSMPTAQSTMKADELTPGRFRTIVCGLFPAQIMHRNIISPVMGVIGFSFFVKDWPDKIEEFLIKPCPFLKKQGGPNKDEDFLVSNDAYFLGREKALRESHLNEIDDLIELAASGDPTPPDSIKSPQAPWVFACAPDRCPPTCIYVAGMAELGAFFSILQDMRKSIMASKTVGTAEEKLKKKSSFYQSYLRRTQSMGIQLDQRIILLFMMEWGSDIVNHFHLGDDMDPELRTLAQSLIDQKVKEISNQEPLKI

SEQ ID NO: 580 - protein, 430 aa, Artificial Sequence
  derived and/or modified protein sequence (wt) from TULV(TUL/Karatal/Ma322/2003)__AM945877.1__N
MSQLKEIQEEITRHEQQIVIARQKLKDAEKTVEADPDDVNKNTLQSRRAAVSALEDKLAEFKRQLADLVSSQKMGEKPVDPTGLEPDDHLKERSSLRYGNVLDVNAIDIDEPSGQTADWFSIGQYVMGFALAIVLKALYMLSTRGRQTIKENKGTRIRFKDDSSFEEINGIRRPKHLYVSMPTAQSTMKADELTPGRFRTIVCGLFPAQIMHRNIISPVMGVIGFSFFVKDWPEKIEEFLIKPCPFLKKQGSSGKEEEFLVSNDAYLIGREKTLQESHLTEIDDLIDLADSGDPTPPDSIKSPQAPWVFACAPDRCPPTCIYIAGMAELGAFFSILQDMRNTIMASKTVGTAEEKLKKKSSFYQSYLRRTQSMGIQLDQRIILLFMMEWGSDIVNHFHLGDDMDPELRTLAQSLIDQKVKEISNQEPLKI

SEQ ID NO: 581 - protein, 430 aa, Artificial Sequence
  derived and/or modified protein sequence (wt) from TULV(Tula/Kosice144/Ma/95)__Y13979.1__N
MSQLKEIQEEITRHEQQIVIARQKLKDAEKTVEADPDDVNKSTLQSRRAAVSALEDKLADFKRQLADLVSSQKMGEKPVDPTGLEPDDHLKERSSLRYGNVLDVNAIDIDEPSGQTADWFSIGQYIIGFALAIVLKALYMLSTRGRQTIKENKGTRIRFKDDSSFEEINGIRRPKHLYVSMPTAQSTMKADELTPGRFRTIVCGLFPAQIMHRNIISPVMGVIGFSFFVKDWPEKIEEFLIKPCPFLKKQGAPGKEEDFLVSNDAYLLGREKALRESHLAEIDDLIDLAASGDPTPPDSIKSPQAPWVFACAPDRCPPTCIYIAGMAELGAFFSILQDMRNTIMASKTVGTAEEKLKKKSSFYQSYLRRTQSMGIQLDQRIILLFMTEWGSDIVNHFHLGDDMDPELRTLAQSLIDQKVKEISNQEPLKI

SEQ ID NO: 582 - protein, 430 aa, Artificial Sequence
  derived and/or modified protein sequence (wt) from TULV(Tula/Kosice667/Ma/95)__Y13980.1__N
MSQLKEIQEEITRHEQQIVIARQKLKDAEKTVEADPDDVNKSTLQSRRAAVSALEDKLADFKRQLADLVSSQKMGEKPVDPTGLEPDDHLKERSSLRYGNVLDVNAIDIDEPSGQTADWFSIGQYIIGFALAIVLKALYMLSTRGRQTIKENKGTRIRFKDDSSFEEINGIRRPKHLYVSMPTAQSTMKADELTPGRFRTIVCGLFPAQIMHRNIISPVMGVIGFSFFVKDWPEKIEEFLIKPCPFLKKQGAPGKEEDFLVSNDAYLLGREKALRESHLAEIDDLIDLAASGDPTPPDSIKSPQAPWVFACAPDRCPPTCIYIAGMAELGAFFSILQDMRDTIMASKTVGTAEEKLKKKSSFYQSYLRRTQSMGIQLDQRIILLFMTEWGSDIVNHFHLGDDMDPELRTLAQSLIDQKVKEISNQEPLKI

SEQ ID NO: 583 - protein, 429 aa, Artificial Sequence
  derived and/or modified protein sequence (wt) from TULV(Tula/Koziky/5247Ma/94)__AJ223600.1__N
MSQLKEIQEEITRHEQQIVIARQKLKDAEKTVEADPDDVNKSTLQSRRAAVSALEDKLADFKRQLADLVSSQKMGEKPVDPTGLEPDDHLKERSSLRYGNVLDVNAIDIDEPSGQTADWFSIGQYITGFALAIILKALYMLSTRGRQTIKENKGTRIRFKDDSSYEEINGIRRPKHLYVSMPTAQSTMKADELTPGRFRTIVCGLFPAQIMHRNIISPVMGVIGFSFFVKDWPEKIEEFLIKPCPFLKKNGPSKEEDFLVSNDAYLLGREKALRESHLAEIDDLIDLAASEDPTPPDSIKSPQAPWVFACRPDRCPPTCIYIAGMAELGAFFSILQDMRNTIMASKTVGTAEEKLKKKSSFYQSYLRRTQSMGIQLDQRIILLFMTEWGSDIVNHFHLGDDMSPELRTLAQSLIDQKVKEISNQEPLKI

SEQ ID NO: 584 - protein, 429 aa, Artificial Sequence
  derived and/or modified protein sequence (wt) from TULV(Tula/Moravia/5302v/95)__Z69991.1__N
MSQLKEIQEEITRHEQQIVIARQKLKDVEKTVEADPDDVNKSTLQSRRAAVSALEDKLADFKRQLADLVSSQKMGEKPVDPTGLEPDDHLKERSSLRYGNVLDVNAIDIDEPSGQTADWFSIGQYITGFALAIILKALYMLSTRGRQTIKENKGTRIRFKDDSSYEEINGIRRPKHLYVSMPTAQSTMKADELTPGRFRTIVCGLFPAQIMYRNIISPVMGVIGFSFFVKDWPEKIEEFLIKPCPFLKKSGPSKEEDFLVSNDAYLLGREKALRESHLAEIDDLIDLAASGDPTPPDSIKSPQAPWVFACRPDRCPPTCIYIAGMAELGAFFSILQDMRNTIMASKTVGTAEEKLKKKSSFYQSYLRRTQSMGIQLDQRIILLFMTEWGSDIVNHFHLGDDMDPELRTLAQSLIDQKVKEISNQEPLKI

SEQ ID NO: 585 - protein, 430 aa, Artificial Sequence
  derived and/or modified protein sequence (wt) from TULV__AF017659.1__N
MSQLKEIQEEITRHEQQIVIARQKLKDAEKTVEADPDDVNKSTLQSRRAAVSALEDKLADFKRQLADLVSSQKMGEKPVDPTGLEPDDHLKERSSLRYGNVLDVNAIDIDEPSGQTADWFSIGQYIIGFALAIVLKALYMLSTRGRQTIKENKGTRIRFKDDSSFEEINGIRRPKHLYVSMPTAQSTMKADELTPGRFRTIVCGLFPAQIMHRNIISPVMGVIGFSFFVKDWPEKIEEFLIKPCPFLKKQGAPGKEEDFLVSNDAYLLGREKALRESHLAEIDDLIDLAASGDPTPPDSIKSPQAPWVFACAPDRCPPTCIYVAGMAELGAFFSILQDMRNTIMASKTVGTAEEKLKKKSSFYQSYLRRTQSMGIQLDQRIILLFMTEWGSDIVNHFHLGDDMDPELRTLAQSLIDQKVKEISNQEPLKI

SEQ ID NO: 586 - protein, 430 aa, Artificial Sequence
  derived and/or modified protein sequence (wt) from TULV(Lodz-1)__AF063892.1__N
MTELKEIQEEITRHEQQIVIARQKLKDAEKTVEADPDDVNKSTLQSRRAAVSALEDKLADFKRQLADLVSSQKMGEKPVDPTGLEPDDHLKERSSLRYGNVLDVNAIDIDEPSGQTADWFSIGQYIMGFALAIVLKALYMLSTRGRQTIKENKGTRIRFKDDSSYEEINGIRRPKHLYVSMPTAQSTMKADELTPGRFRTIVCGLFPAQIMHRNIISPVMGVIGFSFFVKDWPDKIEEFLIKPCPFLKKQGGPNKDEEFLVSNDAYLLGREKALRESHLAEIDDLIDLAASGDPTPPDSIKSPQAPWVFACAPDRCPPTCIYVAGMAELGAFFSILQDMRNTIMASKTVGTAEEKLKKKSSFYQSYLRRTQSMGIQLDQRIILLFMMEWGSDIVNHFHLGDDMDPELRTLAQSLIDQKVKEISNQEPLKI

SEQ ID NO: 587 - protein, 430 aa, Artificial Sequence
  derived and/or modified protein sequence (wt) from TULV(Lodz-2)__AF063897.1__N
MTELKEIQEEITRHEQQIVIARQKLKDAEKTVEADPDDVNKSTLQSRWAAVSALEDKLADFKRQLADLVSSQKMGEKPVDPTGLEPDDHLKERSSLRYGNVLDVNAIDIDEPSGQTADWFSIGQYIMGFALAIVLKALYMLSTRGRQTIKENKGTRIRFKDDSSYEEINGIRRPKHLYVSMPTAQSTMKADELTPGRFRTIVCGLFPAQIMHRNIISPVMGVIGFSFFVKDWPDKIEEFLIKPCPFLKKQGGPNKDEEFLVSNDAYLLGREKALRESHLAEIDDLIDLAASGDPTPPDSIKSPQAPWVFACAPDRCPPTCIYVAGMAELGAFFSILQDMRNTIMASKTVGTAEEKLKKKSSFYQSYLRRTQSMGIQLDQRIILLFMMEWGSDIVNHFHLGDDMDPELRTLAQSLIDQKVKEISNQEPLKI

SEQ ID NO: 588 - protein, 482 aa, Artificial Sequence
  derived and/or modified protein sequence (wt) from CCHFV(IbAr10200)__NC_005302.1/U88410.1__N
MENKIEVNNKDEMNRWFEEFKKGNGLVDTFTNSYSFCESVPNLDRFVFQMASATDDAQKDSIYASALVEATKFCAPIYECAWVSSTGIVKKGLEWFEKNAGTIKSWDESYTELKVDVPKIEQLTGYQQAALKWRKDIGFRVNANTAALSNKVLAEYKVPGEIVMSVKEMLSDMIRRRNLILNRGGDENPRGPVSHEHVDWCREFVKGKYIMAFNPPWGDINKSGRSGIALVATGLAKLAETEGKGIFDEAKKTVEALNGYLDKHKDEVDRASADSMITNLLKHIAKAQELYKNSSALRAQSAQIDTAFSSYYWLYKAGVTPETFPTVSQFLFELGKQPRGTKKMKKALLSTPMKWGKKLYELFADDSFQQNRIYMHPAVLTAGRISEMGVCFGTIPVANPDDAAQGSGHTKSILNLRTNTETNNPCAKTIVKLFEVQKTGFNIQDMDIVASEHLLHQSLVGKQSPFQNAYNVKGNATSANII

SEQ ID NO: 589 - protein, 482 aa, Artificial Sequence
  derived and/or modified protein sequence (wt) from CCHFV(Turkey-Kelkit06)__GQ337053.1__N
MENKIEVNSKDEMNKWFEEFKKGNGLMDTFTNSYSFCENVPNLDKFVFQMASATDDAQKDSIYASALVEATKFCAPIYECAWVSSTGIVKKGLEWFEKDSGTIKSWDENYAELKVDVPKIEQLANYQQAALKWRKDIGFRVNANTAALSNKVLAEYKVPGEIVMSVKEMLSDMIRRRNLILNRGGDENPRGPVSREHVEWCREFVKGKYIMAFNPPWGDINKSGRSGIALVATGLAKLAETEGKGVFDEAKKTVEALNGYLDKHRDEVDKASADSMITNLPKHIAKAQELYKNSSALRAQGAQIDTPFSSFYWLYKAGVTPETFPTISQFLFELGEQPRGTKKMKKALLSTPMKWGKKLYELFADDSFQQNRIYMHPAVLTAGRISEMGVCFGTIPVANPDDAAQGSGHTKSILNLRTSTETNNPCAKTIVKLFEIQETGFNIQDMDIVASEHLLHQSIVGKQSPFQNAYNVKGNATSANII

SEQ ID NO: 590 - protein, 482 aa, Artificial Sequence
  derived and/or modified protein sequence (wt) from CCHFV(Baghdad 12)__AJ538196.1__N
MENKIEVNSKDEMNKWFEEFKKGNGLVDTYTNSYSFCESVPNLDRFVFQMAGATDDAQKDSIYASALVEATKFCAPIYECAWASSTGIVKKGLEWFEKNTGTIKSWDESYTELKVEVPKIEQLFNYQQAALKWRKDIGFRVNANTAALSNKVLAEYKVPGEIVMSVKEMLSDMIRRRNLILNRGGDENPRGPVSREHVEWCREFVKGKYIMAFNPPWGDINKSGRSGIALVATGLAKLAETEGKGVFDEAKKTVEALNGYLDKHKDEVDKASADNMVTNLLKHVAKAQELYKNSSALRAQGAQIDTVFSSYYWLYKAGVTPETFPTVSQFLFELGKHPRGTKKMKKALLSTPMKWGKKLYELFADDSFQQNRIYMHPAVLTAGRISEMGVCFGTIPVANPDDAALGSGHTKSILNLRTNTETNNPCARTIVKLFEIQKTGFNIQHMDIVASEHLLHQSLVGKQSPFQNAYNVKGNATSANII

SEQ ID NO: 591 - protein, 482 aa, Artificial Sequence
  derived and/or modified protein sequence (wt) from CCHFV(SR3)__AJ538198.1__N
MENKIEVNSKDEMNKWFEEFKKGNGLVDTFTNSYSFCESVPNLDRFVFQMASATDDAQKDSIYASALVEATKFCAPIYECAWASSTGIVKKGLEWFEKNAGTIKSWDESYTELKVEVPKIEQLSNYQQAALKWRKDIGFRVNANTAALSNKVLAEYKVPGEIVMSVKEMLSDMIRRRNLILNRGGDENPRGPVSREHVEWCREFVKGKYIMAFNPPWGDINKSGRSGIALVATGLAKLAETEGKGVFDEAKKTVEALNGYLDKHKDEVDKASADSMITNLLKHIAKAQELYKNSSALRAQGAQIDTVFSSYYWLYKAGVTPDTFPAVSQFLFELGKQPRGTKKMKKALLSTPMKWGKKLYELFADDSFQQNRIYMHPAVLTAGRISEMGVCFGTIPVANPDDAALGSGHTKSILNLRTNTETNNPCAKTIVKLFEIQKTGFNIQDMDIVASEHLLHQSLVGKQSPFQNAYNVKGNATSANII

SEQ ID NO: 592 - protein, 482 aa, Artificial Sequence
  derived and/or modified protein sequence (wt) from CCHFV(Gaib)__KX013446.1__N
MENKIEVNNKDEMNKWFEEFKKGNGLVDTFTNSYSFCESVPNLDRFVFQMASATDDAQKDSIYASALVEATKFCAPIYECAWVSSTGIVKKGLEWFEKNAGTIKSWDESYTELKVEVPKIEQLANYQQAALKWRKDIGFRVNANTAALSHKVLAEYKVPGEIVMSVKEMLSDMIRRRNLILNRGGDENPRGPVSREHVEWCREFVKGKYIMAFNPPWGDINKSGRSGIALVATGLAKLAETEGKGVFDEAKKTVEALNGYLDKHKDEVDKASADNMITNLLKHIAKAQELYKNSSALRAQGAQIDTAFSSYYWLYKAGVTPETFPTVSQFLFELGKQPRGTKKMKKALLSTPMKWGKKLYELFADDSFQQNRIYMHPAVLTAGRISEMGVCFGTIPVANPDDAAQGSGHTKSILNLRTNTETNNPCAKTIVKLFEIQKTGFNIQDMDIVASEHLLHQSLVGKQSPFQNAYNVKGNATSANII

SEQ ID NO: 593 - protein, 482 aa, Artificial Sequence
  derived and/or modified protein sequence (wt) from CCHFV(Hodzha)__KX013449.1__N
MENKIEVNNKDEMNKWFEEFKKGNGLVDTFTNSYSFCESVPNLDRFVFQMASATDDAQKDSIYASALVEATKFCAPIYECAWVSSTGIVKKGLEWFEKNAGTIKSWDESYTELKVEVPKIEQLANYQQAALKWRKDIGFCVNANTAALSQKVLSEYKVPGEIVMSVKEMLSDMIRRRNLILNRGGDENPRGPVSREHVEWCREFVKGKYIMAFNPPWGDINKSGRSGIALVATGLAKLAETEGKGVFDEAKKTVEALNGYLDKHKDEVDKASADNMTTNLLKHIAKAQELYKNSSALRAQGAQIDTAFSSYYWLYKAGVTPETFPTVSQFLFELGKQPRGTKKMKKALLSTPMKWGKKLYELFADDSFQQNRIYMHPAVLTTGRISEMGVCFGTVPVADPDDAAQGSGHTKSILNLRTNTETNNPCAKTIVKLFEIQKTGFNIQDMDIVASEHLLHQSLVGKQSPFQNAYNVKGNATSANII

SEQ ID NO: 594 - protein, 482 aa, Artificial Sequence
  derived and/or modified protein sequence (wt) from CCHFV(IbAn7620)__KX013452.1__N
MENKIEVNNKDEMNRWFEEFKKENGLVDTFTNSHSFCESVPNLDKFVFQMASATDDAQKDSIYAAALVEATKFCAPIYECAWVSSTGIVKKGLEWFEKNAGTIKSWDESYTELKVEVPKIEQLSNYQQAALKWRKDIGFRVNANTATLSHKVLAEYKVPGEIVMSVKEMLSDMIRRRNLILNRGGDENPRGPVSREHVEWCREFVKGKYIMAFNPPWGDINKSGRSGIALVATGLAKLAEAEGKGVFDEAKKTVEALNGYLDKHKDEVDKSSADSMITNLLKHIAKAQELYKNSSALRAQGAQIDTAFSSYYWLYKAGVTPETFPTVSQFLFELGKQPRGTKKMKKALLSTPMKWGKKLYELFADDSFQQNRIYMHPAVLTAGRISEMGVCFGTIPVANPDDAALGSGHTKSILNLRTSTEANNPCAKTIVKLFEIQKKGFVIKDMDIVASEHLLHQSLVGKQSPFQNAYNVKGNATSANII

SEQ ID NO: 595 - protein, 482 aa, Artificial Sequence
  derived and/or modified protein sequence (wt) from CCHFV(K128_76)__KX013455.1__N
MENKIEVNNKDEMNKWFEEFKKGNGLVDTFTNSYSFCESVPSLDRFVFQMASATDDAQKDSIYASALVEATKFCAPIYECAWVSSTGIVKKGLEWFEKNAGTIKSWDESYTELKVEVPKIEQLANYQQAALKWRKDIGFRVNANTAALSHKVLAEYKVPGEIVMSVKEMLSDMIRRRNLILNRGGDENPRGPVSREHVEWCREFVKGKYIMAFNPPWGDINKSGRSGIALVATGLAKLAETEGKGVFDEAKKTVEALNGYLDKHKDEVDKASADNMITNLLKHIAKAQELYKNSSALRAQGAQIDTAFSSYYWLYKAGVTPETFPTVSQFLFELGKQPRGTKKMKKALLSTPMKWGKKLYELFADDSFQQNRIYMHPAVLTAGRISEMGVCFGTIPVANPDDAAQGSGHTKSILNLRTNTETNNPCAKTIVKLFEIQKTGFNIQDMDIVASEHLLHQSLVGKQSPFQNAYNVKGNATSANII

SEQ ID NO: 596 - protein, 482 aa, Artificial Sequence
  derived and/or modified protein sequence (wt) from CCHFV(K168_125)__KX013461.1__N
MENKIEVNNKDEMNKWFEEFKKGNGLVDTFTNSYSFCESVPNLDRFVFQMASATDDAQKDSIYASALVEATKFCAPIYECAWVSSTGIVKKGLEWFEKNAGTIKSWDESYTELKVEVPKIEQLANYQQAALKWRKDIGFRVNANTAALSHKVLAEYKVPGDIVMSVKEMLSDMIRRRNLILNRGGDENPRGPVSREHVEWCREFVKGKYIMAFNPPWGDINKSGRSGIALVATGLAKLAETEGKGVFDEAKKTVEALNGYLDKHKDEVDKASADNMITNLLKHIAKAQELYKNSSALRAQGAQIDTAFSSYYWLYKAGVTSETFPTVSQFLFELGKQPRGTKKMKKALLSTPMKWGKKLYELFADDSFQQNRIYMHPAVLTAGRISEMGVCFGTIPVANPDDAAQGSGHTKSILNLRTNTETNNPCAKTIVKLFEIQKTGFNIQDMDIVASEHLLHQSLVGKQSPFQNAYNVKGNATSANII

SEQ ID NO: 597 - protein, 482 aa, Artificial Sequence
  derived and/or modified protein sequence (wt) from CCHFV(K168_40)__KX013458.1__N
MENKIEVNNKDEMNKWFEEFKKGNGLVDTFTNSYSFCESVPNLDRFVFQMASATDDAQKDSIYASALVEATKFCAPIYECAWVSSTGIVKKGLEWFEKNAGTIKSWDESYTELKVEVPKIEQLANYQQAALKWRKDIGFRVNANTAALSHKVLAEYKVPGDIVMSVKEMLSDMIRRRNLILNRGGDENPRGPVSREHVEWCREFVKGNYIMAFNPPWGDINKSGRSGIALVATGLAKLAETEGKGVFDEAKKTVEALNGYLDKHKDEVDKASADNMITNLLKHIAKAQELYKNSSALRAQGAQIDTAFSSYYWLYKAGVTSETFPTVSQFLFELGKQPRGTKKMKKALLSTPMKWGKKLYELFADDSFQQNRIYMHPAVLTAGRISEMGVCFGTIPVANPDDAAQGSGHTKSILNLRTNTETNNPCAKTIVKLFEIQKTGFNIQDMDIVASEHLLHQSLVGKQSPFQNAYNVKGNATSANII

SEQ ID NO: 598 - protein, 482 aa, Artificial Sequence
  derived and/or modified protein sequence (wt) from CCHFV(K323_27)__KX013473.1__N
MENKIEVNSKDEMNKWFEEFKKGNGLMDTFTNSYSFCENVPNLDKFVFQMASATDDAQKDSIYASALVEATKFCAPIYECAWVSSTGIVKKGLEWFEKNSGTIKSWDENYAELKVDVPKIEQLANYQQAALKWRKDIGFRVNANTAALSNKVLAEYKVPGEIVMSVKEMLSDMIRRRNLILNRGGDENPRGPVSREHVEWCREFVKGKYIMAFNPPWGDINKSGRSGIALVATGLAKLAETEGKGVFDEAKKTVEALNGYLDKHRDEVDKASADSMITNLLKHIAKAQELYKNSSALRAQGAQIDTPFSSFYWLYKAGVTPETFPTISQFLFELGKQPRGTKKMKKALLSTPMKWGKKLYELFADDSFQQNRIYMHPAVLTAGRISEMGVCFGTIPVANPDDAAQGSGHTKSILNLRTSTETNNPCAKTIVKLFEIQKTGFNIQDMDIVASEHLLHQSLVGKQSPFQNAFNVKGNATSANII

SEQ ID NO: 599 - protein, 482 aa, Artificial Sequence
  derived and/or modified protein sequence (wt) from CCHFV(Min)__KX013482.1__N
MENKIEVNSKDEMNKWFEEFKKGNGLMDTFTNSYSFCENVPNLDKFVFQMASATDDAQKDSIYASALVEATKFCAPIYECAWVSSTGIVKKGLEWFEKNSGTIKSWDENYAELKVDVPKIEQLANYQQAALKWRKDIGFRVNANTAALSNKVLAEYKVPGEIVMSVKEMLSDMIRRRNLILNRGGDENPRGPVSREHVEWCREFVKGKYIMAFNPPWGDINKLGRSGIALVATGLAKLAETEGKGVFDEAKKTVEALNGYLDKHRDEVDKASADSMITNLLKHIAKAQELYKNSSALRAQGAQIDTPFSSFYWLYKAGVTPETFPTISQFLFELGKQPRGTKKMKKALLSTPMKWGKKLYELFADDSFQQNRIYMHPAVLTAGRISEMGVCFGTIPVANPDDAAQGSGHTKSILNLRTSTETNNPCAKTIVKLFEIQKTGFNIQDMDIVASEHLLHQSLVGKQSPFQNAYNVKGNATSANII

SEQ ID NO: 600 - protein, 482 aa, Artificial Sequence
  derived and/or modified protein sequence (wt) from CCHFV(Saf)__KX013488.1__N
MENKIEVNSKDEMNKWFEEFKKGNGLMDTFTNSYSFCENVPNLDKFVFQMASATDDAQKDSIYASALVEATKFCAPIYECAWVSSTGIVKKGLEWFEKNSGTIKSWDENYAELKVDVPKIEQLANYQQAALKWRKDIGFRVNANTAALSNKVLAEYKVPGEIVMSVKEMLSDMIRRRNLILNRGGDENPRGPVSREHVEWCREFVKGKYIMAFNPPWGDINKSGRSGIALVATGLAKLAETEGKGVFDEAKKTVEALNGYLDKHRDEVDKASADSMITNLLKHIAKAQELYKNSSALRAQGAQIDTPFSSFYWLYKAGVTPETFPTISQFLFELGKQPRGTKKMKKALLSTPMKWGKKLYELFADDSFQQNRIYMHPAVLTAGRISEMGVCFGTIPVADPDDAAQGSGHTKSILNLRTSTETNNPCARTIVKLFEIQKTGFNIQDMDIVASEHLLHQSLVGKQSPFQNAYNVKGNATSANII

SEQ ID NO: 601 - protein, 482 aa, Artificial Sequence
  derived and/or modified protein sequence (wt) from CCHFV(UCCR4459)__KY484031.1__N
MENKIEVNNKDEMNKWFEEFKKGNGLVDTFTNSYSFCESVPNLDRFVFQMASATDDAQKDSIYASALVEATKFCAPIYECAWVSSTGIVKKGLEWFEKNAGTIKSWDESYTELKVEVPKIEQLAGYQQAALKWRKDIGFRVNANTAALSHKVLAEYKVPGEIVMSVKEMLSDMIRRRNLILNRGGDENPRGPVSREHVEWCREFVKGKYIMAFNPPWGDINKLGRSGIALVATGLAKLAETEGKGVFDEAKKTVEALNGYLDKHKDEVDKASADNMITNLLKHIAKAQELYKNSSALRAQGAQIDTAFSSYYWLYKAGVTPETFPTVSQFLFELGKQPRGTKKMKKALLSTPMKWGKKLYELFADDSFQQNRIYMHPAVLTAGRISEMGVCFGTIPVANPDDAAQGSGHTKSILNLRTNTETNNPCAKTIVKLFEIQKTGFNIQDMDIVASEHLLHQSLVGKQSPFQNAYNVKGNATSANII

SEQ ID NO: 602 - protein, 482 aa, Artificial Sequence
  derived and/or modified protein sequence (wt) from CCHFV(YL16070)__KY354080.1__N
MENKIEVNNKDEMNKWFEEFKKGNGLVDTFTNSYSFCESVPNLDRFVFQMASATDDAQKDSIYASALVEATKFCAPIYECAWVSSTGIVKKGLEWFEKNAGTIKSWDESYTELKVEVPKIEQLADYQQAALKWRKDIGFRVNANTTALSHKVLAEYKVPGEIVMSVKEMLSDMIRRRNLILNRGGDENPRGPVSREHVEWCREFVKGKYIMAFNPPWGDINKSGRSGIALVATGLAKLAETEGKGVFDEAKKTVEALNGYLNKHKDEVDKASADSMITNLLKHIAKAQELYKNSSALRAQGAQIDTAFSSYYWLYKAGVTPETFPTVSQFLFELGKQPRGTKKMKKALLSTPLKWGKRLYELFADDSFQQNRIYMHPAVLTAGRISEMGVCFGTIPVANPDDAAQGSGHTKSILNLRTNTETNNPCAKTIVKLFEIQKTGFNIQDMDIVASEHLLHQSLVGKQSPFQNAYNVKGNATSANII

SEQ ID NO: 603 - protein, 482 aa, Artificial Sequence
  derived and/or modified protein sequence (wt) from CCHFV(66019)__AJ010648.1__N
MENKIEVNNKDEMNRWFEEFKKGNGLVDTFTNSYSFCESVPNLDRFVFQMASATDDAQKDSIYASALVEATKFCAPIYECAWVSSTGIVKKGLEWFEKNAGTIKSWDESYTELKVEVPKIEQLASYQQAALKWRKDIGFRVNANTAALSHKVLAEYKVPGEIVMSVKEMLSDMIRRRNLILNRGGDENPRGPVSREHVEWCREFVKGKYIMAFNPPWGDINKSGRSGIALVATGLAKLAETEGKGVFDEAKKTVEALNGYLDKHKDEVDKASADNMTTNLLKHIAKAQELYKNSSALRAQGAQIDTAFSSYYWLYKAGVTPETFPTVSQFLFELGKQPRGTKKMKKALLSTPMKWGKKLYELFADDSFQQNRIYMHPAVLTAGRISEMGVCFGTIPVADPDDAAQGSGHTKSILNLRTNTETNNPCAKTIVKLFEIQKTGFNIQDMDIVASEHLLHQSLVGKQSPFQNAYNVKGNATSANII

SEQ ID NO: 604 - protein, 482 aa, Artificial Sequence
  derived and/or modified protein sequence (wt) from CCHFV(8402)__AJ010649.1__N
MENKIEVNNKDEMNKWFEEFKKGNGLVDTFTNSYSFCESVPNLERFVFQMASATDDAQKDSIYASALVEATKFCAPIYECAWVSSTGIVKKGLEWFEKNAGTIKSWDESYTELKVEVPKIEQLANYQQAALKWRKDIGFRVNANTAALSHKVLAEYKVPGEIVMSVKEMLSDMIRRRNLILNRGGDENPRGPVSREHVEWCREFVKGKYIMAFNPPWGDINKSGRSGIALVATGLAKLAETEGKGVFDEAKKTVEALNGYLDKHKDEVDKASADNMITNLFKHIAKAQELYKNLSALGAQGAQIDTAFSSYYWLYKAGVTPETFPTVSQFLFELGKQPRGTKKMKKALLSTPMKWGKKLYELFADDSFQQNRIYMHPAVLTAGRISEMGVCFGTIPVANPDDAAQGSGHTKSILNLRTNTETNNPCAKTIVKLFEIQKTGFNIQDMDIVASEHLLHQSLVGKQSPFQNAYNVKGNATSANII

SEQ ID NO: 605 - protein, 482 aa, Artificial Sequence
  derived and/or modified protein sequence (wt) from CCHFV(Bul/HU517)__AY277676.2__N
MENKIEVNSKDEMNKWFEEFKKGNGLMDTFTNSYSFCENVPNLDKFVFQMASATDDAQKDSIYASALVEATKFCAPIYECAWVSSTGIVKKGLEWFEKNSGAIKSWDENYVELKVDVPKIEQLANYQQAALKWRKDIGFRVNANTAALSNKVLAEYKVPGEIVMSVKEMLSDMIRRRNLILNRGSDENPRGPVSHEHVEWCREFVKGKYIMAFNPPWGDINKSGRSGIALVATGLAKLAETEGKGVFDEAKKTVEALNGYLDKHRDEVDKASADSMITNLLKHIAKAQELYKNSSALRAQGAQIDTPFSSFYWLYKAGVTPETFPTISQFLFELGKQPRGTKKMKKALLSTPMKWGKKLYELFADDSFQQNRIYMHPAVLTAGRISEMGVCFGTIPVANPDDAAQGSGHTKSILNLRTSTETNNPCAKTIVKLFEIQKTGFNIQDMDIVASEHLLHQSLVGKQSPFQNAYNVKGNATSANII

SEQ ID NO: 606 - protein, 482 aa, Artificial Sequence
  derived and/or modified protein sequence (wt) from CCHFV(V46/13)__KR011837.1__N
MENKIEVNSKDEMNKWFEEFKKGNGLMDTFTNSYSFCENVPNLDKFVFQMASATDDAQKDSIYASALVEATKFCAPIYECAWVSSTGIVKKGLEWFEKNSGTIKSWDENYAELKVDVPKIEQLANYQQAALKWRKDIGFRVNANTAALSNKVLAEYKVPGEIVMSVKEMLSDMIRRRNLILNRGSDENPRGPVSREHVEWCREFVKGKYIMAFNPPWGDINKSGRSGIALVATGLAKLAETEGKGVFDEAKKAVEALNGYLDKHRDEVVKASADSMITNLLKHIAKAQELYKNSSALRAQGAQIDTPFSSFYWLYKAGVTPETFPTISQFLFELGKQPRGTKKMKKALLSTPMKWGKKLYELFADDSFQQNRIYMHPAVLTAGRISEMGVCFGTIPVANPDDAAQGSGHTKSILNLRTSTETNNPCAKTIVKLFEIQKTGFNIQDMDIVASEHLLHQSLVGKQSPFQNAYNVKGNATSANII

SEQ ID NO: 607 - protein, 482 aa, Artificial Sequence
  derived and/or modified protein sequence (wt) from CCHFV(1231-CR/TI-2015)__KU161587.1__N
MENKIEVNSKDEMNKWFEEFKKGNGLMDTFTNSYSFCENVPNLDKFVFQMASATDDAQKDSIYASALVEATKFCAPIYECAWVSSTGIVKKGLEWFEKNSGTIKSWDENYAELKVDVPKIEQLANYQQAALKWRKDIGFRVNANTAALSNKVLAEYKVPGEIVMSVKEMLSDMIRRRNLILNRGGDENPRGPVSREHVEWCREFVKGKYIMAFNPPWGDINKSGRSGIALVATGLAKLAETEGKGVFDEAKKTVEALNGYLDKHRDEVDKASADSMITNLLKHIAKAQELYKNSSALRAQGAQIDTPFSSFYWLYKAGVTPETFPTISQFLFELGKQPRGTKKMKKALLSTPMKWGKKLYELFADDSFQQNRIYMHPAVLTAGRISEMGVCFGTIPVANPDDAAQGSGHTKSILNLRTSTETNNPCAKTIVKLFEIQKTGFNIQDMDIVASEHLLHQSLVGKQSPFQNAYNVKGNATSANII

SEQ ID NO: 608 - protein, 482 aa, Artificial Sequence
  derived and/or modified protein sequence (wt) from CCHFV(AP92)__U04958.1__N
MENKIEVNSKDDLNKWFEEFKKGNGLVDTFTNSYSFCENVPNLDRFVYQMASATDDAQKDSIYASALVEATKYCAPIYECAWVSSTGIVKKGLEWFEKNTSTIKSWDESYTELKVDIPKIEQLSSYQQAALKWRKDIGFRINANTTALSNKVLAEYKVPGEILVPVKEMLSDMIRRRNIILNRGSDENPRGPVSHEHIEWCREFIKGKYIMAFNPPWGDINKSGRSGIALVATGLAKLAETEGKGVFEEAKKTVEALKDYLDKHRDEVDKTSADNMVTSLLKHIAKAQELYKNSSALRAQGAQIDTPFSSFYWLYKAGVTPETFPTVSQFLFELGKQPRGTKKMKKALLSTPMKWGKKHYELFADDSFQQNRIYMHPAVLTAGRISEMGVCFGTIPVANPDDAAQGSGHTKSILNLRTNTESNNPCARTIVKLFEIQKTGFDIKDMDIVASEHLLHQSLVGKQSPFQNAYNVKGNATSANII

SEQ ID NO: 609 - protein, 482 aa, Artificial Sequence
  derived and/or modified protein sequence (wt) from CCHFV(C68031)__M86625.1__N
MENKIEVNNKDEMNKWFEEFKKGNGLVDTFTNPYSFCESVPNLERFVFQMASATDDAQKDSIYASALVEATKFCAPIYECAWVSSTGIVKKGLEWFEKNAGTIKSWDESYIELKVEVPKIEQLANYQQAALKWRKDIGFRVNANTAALSHKVLAEYKVPGEIVMSVKEMLSDMIRRRNLILNRGGDENPRGPVSREHVEWCREFVKGKYIMAFNPPWGDINKSGRSGIALVATGLAKLAETEGKGVFDEAKKTVEALNGYLDKHKDEVDKASADNMITNLLKHIAKAQELYKNSSALRAQGAQIDTAFSSYYWLYKAGVTPETFPTVSQFLFELGKQPRGTKKMKKALLSTPMKWGKKLYELFADDSFQQNRIYMHPAVLTAGRISEMGVCFGTIPVANPDDAAQGSGHTKSILNLRTNTETNNPCAKTIVKLFEIQKTGFNIQDMDIVASEHLLHQSLVGKQSPFQNAYNVKGNATSANII

SEQ ID NO: 610 - protein, 482 aa, Artificial Sequence
  derived and/or modified protein sequence (wt) from CCHFV(1-CR/HU-2015)__KU161586.1__N
MENKIEVNSKDEMNKWFEEFKKGNGLMDTFTNSYSFCENVPNLDKFVYQMASATDDAQKDSIYASALVEATKFCAPIYECAWVSSTGIVKKGLEWFEKNSGTIKSWDENYAELKVDVPKIEQLANYQQAALKWRKDIGFRVNANTAALSNKVLAEYKVPGEIVMSVKEMLSDMIRRRNLILNRGGDENPRGPVSREHVEWCREFVKGKYIMAFNPPWGDINKSGRSGIALVATGLAKLAETEGKGVFDEAKKTVEALNGYLDKHRDEVDKASADSMTTNLLKHIAKAQELYKNSSALRAQGAQIDTPFSSFYWLYKAGVTPETFPTISQFLFELGKQPRGTKKMKKALLSTPMKWGKKLYELFADDSFQQNRIYMHPAVLTAGRISEMGVCFGTIPVANPDDAAQGSGHTKSILNLRTSTETNNPCAKTIVKLFEIQKTGFNIQDMDIVASEHLLHQSLVGKQSPFQNAYNVKGNATSANII

SEQ ID NO: 611 - protein, 482 aa, Artificial Sequence
  derived and/or modified protein sequence (wt) from CCHFV(36-ST-2014)__KR814838.1__N
MENKIEVNSKDEMNKWFEEFKKGNGLMDTFTNSYSFCENVPNLDKFVFQMASATDDAQKDSIYASALVEATKFCAPIYECAWVSSTGIVKKGLEWFEKNTGTIKSWDDNYAELKVDVPKIEQLANYQQAALKWRKDIGFRVNANTAALSNKVLAEYKVPGEIVMSVKEMLSDMIRRRNLILNRGGDGNPRGPVSHEHVEWCREFVKGKYIMAFNPPWGDINKSGRSGIALVATGLAKLAETEGKGVFDEAKRTVEALNGYLDKHRDEVDKASADSMITNLLKHIAKAQELYKNSSALRAQGAQIDTPFSSFYWLYKAGVTPETFPTISQFLFELGKQPRGTKKMKKALLSTPMKWGKKLYELFADDSFQQNRIYMHPAVLTAGRISEMGVCFGTIPVANPDDAAQGSGHTKSILNLRTSTETNNPCAKTIVKLFEIQKTGFNIQDMDIVASEHLLHQSLVGKQSPFQNAYNVKGNATSANII

SEQ ID NO: 612 - protein, 482 aa, Artificial Sequence
  derived and/or modified protein sequence (wt) from CCHFV(37-ST-2009)__KR814835.1__N
MENKIVVNSKDEMNKWFEEFKKVNGLVDTFTNSYSFCENVPNLDKFVFQMASATDDAQKDSIYASALVEATKFCAPIYECAWVSSTGIVKKGLEWFEKNAGTIKSWDESYTELKVDVPKIEQLASYQQAALKWRKDIGFRVNANTAALSSKVLSEYKVPGEVVMPVKEMLSDMIRRRNLILNRGSDENPRGPVSREHVEWCREFVKGKYIMAFNPPWGDINKSGRSGIALVATGLAKLAETEGKGIFEEARKTVDALKDYLDRHKEEVDKTNADNMVTNLFKHIAKAQELYKNSSALRAQGAQIDTPFSSFYWLYKAGVTPETFPTVSQFLFELGKQPRGTRKMKKALLSTPMKWGKKLYELFADDSFQQNRIYMHPAVLTAGRVSEMGVCFGTIPVDNPDDAAQGSGHTKSILNLRTSAETNNPCARTIVKLFEIQKAGFNIQEMDIVASEHLLHQSLVGKQSPFQNAYNVKGNATSANII

SEQ ID NO: 613 - protein, 482 aa, Artificial Sequence
  derived and/or modified protein sequence (wt) from CCHFV(59-TK-2012)__KR814833.1__N
MENKIVVNSKDEMNKWFEEFKKVNGLVDTFTNSYSFCENVPNLDKFVFQMASATDDAQKDSIYASALVEATKFCAPIYECAWVSSTGIVKKGLEWFEKNTGTIKSWDESYTELKVDVPKIEQLASYQQAALKWRKDIGFRVNANTAALSSKVLSEYKVPGEIVMPVKEMLSDMIRRRNLILNRGSDENPRGPVSREHVEWCREFVKGKYIMAFNPPWGDINKSGRSGIALVATGLAKLAETEGKGIFEEARKTVDALKDYLDRHKEEVDKTNADNMVTNLFKHIAKAQELYKNSSALRAQGAQIDTPFSSFYWLYKAGVTPETFPTVSQFLFELGKQPRGTRKMKKALLSTPMKWGKKLYELFADDSFQQNRIYMHPAVLTAGRISEMGVCFGTIPVDNPDDAAQGSGHTKSILNLRTSAETNNPCAKTIVKLFEIQKAGFNIQEMDIVASEHLLHQSLVGKQSPFQNAYNVKGNATSANII

SEQ ID NO: 614 - protein, 482 aa, Artificial Sequence
  derived and/or modified protein sequence (wt) from CCHFV(73-ST-2013)__KR814836.1__N
MENKIEVNNKDEMNKWFEEFKKGNGLVDTFTNSYSFCESVPNLDKFVFQMASATDDAQKDSIYASALVEATKFCAPIYECAWVSSTGIVKKGLEWFEKNAGTIKSWDESYTELKVDVPKIEQLANYQQAALKWRKDIGFRVNANTAALSNKVLAEYKVPGEIVMSVKEMLSDMIRRRNQILNRGGDENPRGPVSREHVDWCREFVKGKYIMAFNPPWGDINKSGRSGIALVATGLAKLAETEGKGVFDEAKKTVEALNGYLDKHKDEVDRASADSMITNLLKHIAKAQELYKNSSALRAQGAQIDTAFSSYYWLYKAGVTPETFPTVSQFLFELGKQPRGTKKMKKALLSTPMKWGKKLYELFADDSFQQNRIYMHPAVLTAGRISEMGVCFGTIPVANPDDAAQGSGHTKSILNLRTNTETNNPCARTIVKLFEIQKTGFNIQDMDIVASEHLLHQSLVGKQSPFQNAYNVKGNATSANII

SEQ ID NO: 615 - protein, 482 aa, Artificial Sequence
  derived and/or modified protein sequence (wt) from CCHFV(75-ST-2010)__KR814845.1__N
MENKIEVNSKDEMNKWFEEFKKGNGLMDTFTNSYSFCENVPNLDKFVFQMASATDDAQKDSIYASALVEATKFCAPIYECAWVSSTGIVKKGLEWFEKNSGTIKSWDENYAELKVDVPKIEQLANYQQAALKWRKDIGFRVNANTAALSNKVLAEYKVPGEIVMSVKEMLSDMIRRRNLILNRGSDENPRGPVSREHVEWCREFVKGKYIMAFNPPWGDINKSGRSGIALVATGLAKLAETEGKGVFDEAKKTVEALNGYLDKHRDEVDKASADSMITNLLKHIAKAQELYKNSSALRAQGAQIDTPFSSFYWLYKAGVTPETFPTISQFLFELGKQPRGTKKMKKALLSTPMKWGKKLYELFADDSFQQNRIYMHPAVLTAGRISEMGVCFGTIPVANPDDAAQGSGHTKSILNLRTSTETNNPCAKTIVKLFEIQKTGFNIQDMDIVASEHLLHQSLVGKQSPFQNAYNVKGNATSANII

SEQ ID NO: 616 - protein, 482 aa, Artificial Sequence
  derived and/or modified protein sequence (wt) from CCHFV(CHH)__KU707898.1__N
MENKIEVNSKDEMNKWFEEFKKGNGLVDTFTNSYSFCESVPNLDRFVFQMASATDDAQKDSIYASALVEATKFCAPIYECAWASSTGIVKKGLEWFEKNAGTIKSWDESYTELKVEVPKIEQLSNYQQAALKWRKDIGFRVNANTAALSNKVLAEYKVPGEIVMSVKEMLSDMIRRRNLILNRGGDENPRGPVSREHVEWCREFVKGKYIMAFNPPWGDINKSGRSGIALVATGLAKLAETEGKGVFDEAKKTVEALNGYLDKHKDEVDKASADSMITNLLKHIAKAQELYKNSSALRAQGAQIDTVFSSYYWLYKAGVTPDTFPTVSQFLFELGKQPRGTKKMKKALLSTPMKWGKKLYELFADDSFQQNRIYMHPAVLTAGRISEMGVCFGTIPVANPDDAALGSGHTKSILNLRTNTETNNPCAKTIVKLFEIQKTGFNIQDMDIVASEHLLHQSLVGKQSPFQNAYNVKGNATSANII

SEQ ID NO: 617 - protein, 482 aa, Artificial Sequence
  derived and/or modified protein sequence (wt) from CCHFV(CJH)__KU707899.1__N
MENKIEVKNKHEKNKWFEEFKKGNGLVDTFTNSYSFCENVPNLDRFVFQMAGATDDAQKDSIYASALVEATKFCAPIYECAWASSTGIVKKGLEWFEKNAGTIKSWDESYTELKVEVPKIEQLSNYQQAALKWRKDIGFRGNANTAALSNKVLAEYKVPGEIVMSVKEMLSDMIRRRNLILNRGGDENPRGPVSREHVEWCREFVKGKYIMAFNPPWGDINKSGRSGIALVATGLAKLAETEGKGVFDEAKKTVEALNGYLDKHKDEVDKASADSMITNLLKHIAKAQELYKNSSALRAQGAQIDTVFSSYYWLYKAGVTPETFPTVSQFLFELGKQPRGTKKMKKALLSTPMKWGKKLYELFADDSFQQNRIYMHPAVLTAGRISEMGVCFGTIPVANPDDAALGSGHTKSILNLRTNTETNNPCAKTIVKLFEIQKTGFNIQDMDIVASEHLLHQSLVGKQSPFQNAYNVKGNATSANII

SEQ ID NO: 618 - protein, 482 aa, Artificial Sequence
  derived and/or modified protein sequence (wt) from CCHFV(CLT/TI05146)__DQ227496.1__N
MENKIEVNNKDEMNKWFEEFKKGNGLVDTFTNSYSFCESVPNLDRFVFQMASATDDAQKDSIYASALVEATKFCAPIYECAWVSSTGIVKKGLEWFEKNAGTIKSWDESYTELKVEVPKIEQLADYQQAALKWRKDIGFRVNANTTALSHKVLAEYKVPGEIVMSVKEMLSDMIRRRNLILNRGGDENPRGPVSREHVEWCREFVKGKYIMAFNPPWGDINKSGRSGIALVATGLAKLAETEGKGVFDEAKKTVEALNGYLNKHKDEVDKASADSMITNLLKHIAKAQELYKNSSALRAQGAQIDTAFSSYYWLYKAGVTPETFPTVSQFLFELGKQPRGTKKMKKALLSTPLKWGKKLYELFADDSFQQNRIYMHPAVLTAGRISEMGVCFGTIPVANPDDAAQGSGHTKSILNLRTNTETNNPCAKTIVKLFEIQKTGFNIQDMDIVASEHLLHQSLVGKQSPFQNAYNVKGNATSANII

SEQ ID NO: 619 - protein, 482 aa, Artificial Sequence
  derived and/or modified protein sequence (wt) from CCHFV(CYT/TI05099)__DQ227495.1__N
MENKIEVNNKDEMNKWFEEFKKGNGLVDTFTNSYSFCESVPNLDRFVFQMASATDDAQKDSIYASALVEATKFCAPIYECAWVSSTGIVKKGLEWFEKNAGTIKSWDESYTELKVEVPKIEQLADYQQAALKWRKDIGFRVNANTTALSHKVLAEYKVPGEIVMSVKEMLSDMIRRRNLILNRGGDENPRGPVSREHVEWCREFVKGKYIMAFNPPWGDINKSGRSGIALVATGLAKLAETEGKGVFDEAKKTVEALNGYLNKHKDEVDKASADSMITNLLKHIAKAQELYKNSSALRAQGAQIDTAFSSYYWLYKAGVTPETFPTVSQFLFELGKQPRGTKKMKKALLSTPLKWGKKLYELFADDSFQQNRIYMHPAVLTAGRISEMGVCFGTIPVANPDDAAQGSGHTKSIPNLRTNTETNNPCAKTIVKLFEIQKTGFNIQDMDIVASEHLLHQSLVGKQSPFQNAYNVKGNATSANII

SEQ ID NO: 620 - protein, 482 aa, Artificial Sequence
  derived and/or modified protein sequence (wt) from CCHFV(Dubai 616)__JN108025.1__N
MENKIEVNNKDEMNKWFEEFKKGNGLVDTFTNSYSFCESVPNLDRFVFQMAGATDDAQKDSIYASALVEATKFCAPIYECAWVSSTGIVKKGLEWFEKNAGTIKSWDESYTELKVEVPKIEQLANYQQAALKWRKDIGFRVNANTAALSHKVLAEYKVPGEIVMSVKEMLSDMIRRRNLILNRGGDENPRGPVSREHVEWCREFVKGKYIMAFNPPWGDINKSGRSGIALVATGLAKLAETEGKGVFDEAKKTVEALNGYLDKHKDEVDKASADNMITNLLKHIAKAQELYKNSSALRAQGAQIDTAFSSYYWLYKAGVTPETFPTVSQFLFELGKQPRGTKKMKKALLSTPMKWGKKLYELFADDSFQQNRIYMHPAVLTAGRISEMGVCFGTIPVANPDDAAQGSGHTKSILNLRTNTETNNPCAKTIVKLFEIQKTGFNIQDMDIVASEHLLHQSLVGKQSPFQNAYNVKGNATSANII

SEQ ID NO: 621 - protein, 482 aa, Artificial Sequence
  derived and/or modified protein sequence (wt) from CCHFV(GRH)__KU707900.1__N
MENKIEVNSKDEMNKWFEEFKKGNGLVDTFTNSYSFCESVPNLDRFVFQMASATDDAQKDSIYASALVEATKFCAPIYECAWASSTGIVKKGLEWFEKNAGTIKSWDESYTELKVEVPKIEQLSNYQQAALKWRKDIGFRVNANTAALSNKVLAEYKVPGEIVMSVKEMLSDMIRRRNLILNRGGDENPRGPVSREHVEWCREFVKGMYIMAFNPPWGDINKSGRSGIALVATGLAKLAETEGKGVFDEAKKTVEALNGYLDKHKDEVDKASADSMITNLLKHIAKAQELYKNSSALRAQGAQIDTVFSSYYWLYKAGVTPDTFPTVSQFLFELGKQPRGTKKMKKALLSTPMKWGKKLYELFADDSFQQNRIYMHPAVLTAGRISEMGVCFGTIPVANPDDAALGSGHTKSILNLRTNTETNNPCAKTIVKLFEIQKTGFNIQDMDIVASEHLLHQSLVGKQSPFQNAYNVKGNATSANII

SEQ ID NO: 622 - protein, 482 aa, Artificial Sequence
  derived and/or modified protein sequence (wt) from CCHFV(Iran-Gilan69)__KJ027521.1__N
MENKIEVNSKDEMNKWFEEFKKGNGLMDTFTNSYSFCENVPNLDKFVFQMASATDDAQKDSIYASALVEATKFCAPIYECAWVSSTGIVKKGLEWFEKNSGTIKSWDENYAELKVDVPKIEQLASYQQAALKWRKDIGFRVNANTAALSNKVLAEYKVPGEIVMSVKEMLSDMIRRRNLILNRGGDENPRGPVSREHVEWCREFVKGKYIMAFNPPWGDINKSGRSGIALVATGLAKLAETEGKGVFDEAKKTVEALNGYLDKHRDEVDKASADSMITNLLKHIAKAQELYKNSSALRAQGAQIDTPFSSFYWLYKAGVTPETFPTISQFLFELGKQPRGTKKMKKALLSTPMKWGKKLYELFADDSFQQNRIYMHPAVLTAGRISEMGVCFGTIPVANPDDAAQGSGHTKSILNLRTSTETNNPCAKTIVKLFEIQKTGFNIQDMDIVASEHLLHQSLVGKQSPFQNAYNVKGNATSANII

SEQ ID NO: 623 - protein, 482 aa, Artificial Sequence
  derived and/or modified protein sequence (wt) from CCHFV(Iran-Isfahan78)__KJ027522.1__N
MENKIEVNSKDEMNKWFEEFKKGNGLMDTFTNSYSFCENVPNLDKFVFQMASATDDAQKDSIYASALVEATKFCAPIYECAWVSSTGIVKKGLEWFEKNSGTIKSWDENYAELKVDVPKIEQLANYQQAALKWRKDIGFRVNANTAALSNKVLAEYKVPGEIVMSVKEMLSDMIRRRNLILNRGGDENPRGPVSREHVEWCREFVKGKYIMAFNPPWGDINKSGRSGIALVATGLAKLAETEGKGVFDEAKKTVEALNGYLDKHRDEVDKASADSMITNLLKHIAKAQELYKNSSALRAQGAQIDTPFSSFYWLYKAGVTPETFPTVSQFLFELGKQPRGTKKMKKALLSTPMKWGKKLYELFADDSFQQNRIYMHPAVLTAGRISEMGVCFGTIPVANPDDAAQGSGHTKSILNLRTSTETNNPCAKTIVKLFEIQKTGFNIQDMDIVASEHLLHQSLVGKQSPFQNAYNVKGNATSANII

SEQ ID NO: 624 - protein, 482 aa, Artificial Sequence
  derived and/or modified protein sequence (wt) from CCHFV(Iran-KhRazavi72)__KJ485700.1__N
MENKIEVKNKHEKNKWFEEFKKGNGLVDTFPNSYSFCENVPNLDRFVFQMAGATDDAQKDSIYASALVEATKFCAPIYECAWASSTGIVKKGLEWFEKNAGTIKSWDESYTELKVEVPKIEQLSNYQQAALKWRKDIGFRGNANTAALSNKVLAEYKVPGEIVMSVKEMLSDMIRRRNLILNRGGDENPRGPVSREHVEWCREFIKGKYIMAFNPPWGDINKSGRSGIALVATGLAKLAETEGKGVFDEAKKTVEALNGYLDKHKDEVDKASADSMITNLLKHIAKAQELYKNSSALRAQGAQIDTVFSSYYWLYKAGVTPETFPTVSQFLFELGKQPRGTKKMKKALLSTPMKWGKKLYELFADDSFQQNRIYMHPAVLTAGRISEMGVCFGTIPVANPDDAALGSGHTKSILNLRTNTETNNPCAKTIVKLFEIQKTGFNIQDMDIVASEHLLHQSLVGKQSPFQNAYNVKGNATSANII

SEQ ID NO: 625 - protein, 482 aa, Artificial Sequence
  derived and/or modified protein sequence (wt) from CCHFV(Iran-Zahedan19)__KJ676542.1__N
MENKIEVNNKDEMNKWFEEFKKGNGLVDTFTNSYSFCESVPNLDRFVFQMAGATDDAQKDSIYASALVEATKFCAPIYECAWVSSTGIVKKGLEWFEKNAGTIKSWDESYTELKVEVPKIEQLANYQQAALKWRKDIGFRVNANTAALSHKVLAEYKVPGEIVMSVKEMLSDMIRRRNLILNRGGDENPRGPVSREHVEWCREFVKGKYIMAFNPPWGDINKSGRSGIALIATGLAKLAETEGKGVFDEAKKTVEALNGYLDKHKDEVDKASADNMITNLLKHIAKAQELYKNSSALRAQGAQIDTAFSSYYWLYKAGVTPETFPTVSQFLFELGKQPRGTKKMKKALLSTPMRWGKKLYELFADDSFQQNRIYMHPAVLTAGRISEMGVCFGTIPVANPDDAAQGSGHTKSILNLRTNTETNNPCAKTIVKLFEIQKTGFNIQDMDIVASEHLLHQSLVGKQSPFQNAYNVKGNATSANII

SEQ ID NO: 626 - protein, 482 aa, Artificial Sequence
  derived and/or modified protein sequence (wt) from CCHFV(NIV 112143)__JN572089.1__N
MENKIEVNNKDEMNKWFEEFKKGNGLVDTFTNSYSFCESVPNLDRFVFQMASATDDAQKDSIYASALVEATKFCAPIYECAWVSSTGIVKKGLEWFEKNAGTIKSWDESYTELKVEVPKIEQLANYQQAALKWRKDIGFRVNANTAALSHKVLAEYKVPGEIVMSVKEMLSDMIRRRNLILNRGGDENPRGPVSREHVEWCREFVKGKYIMAFNPPWGDINKSGRSGIALIATGLAKLAETEGKGVFDEAKKTVEALNGYLDKHKDEVDKASADNMITNLLKHIAKAQELYKNSSALRAQGAQIDTAFSSYYWLYKAGVTPETFPTVSQFLFELGKQPRGTKKMKKALLSTPMRWGKKLYELFADDSFQQNRIYMHPAVLTAGRISEMGVCFGTIPVANPDDAAQGSGHTKSILNLRTNTETNNPCAKTIVKLFEIQKTGFNIQDMDIVASEHLLHQSLVGKQSPFQNAYNVKGNATSANII

SEQ ID NO: 627 - protein, 482 aa, Artificial Sequence
  derived and/or modified protein sequence (wt) from CCHFV(NIVA 118595)__JN572088.1__N
MENKIEVNNKDEMNKWFEEFKKGNGLVDTFTNSYSFCESVPNLDRFVFQMASATDDAQKDSIYASALVEATKFCAPIYECAWVSSTGIVKKGLEWFEKNAGTIKSWDESYTELKVEVPKIEQLANYQQAALKWRKDIGFRVNANTAALSHKVLAEYKVPGEIVMSVKEMLSDMIRRRNLILNRGGDENPRGPVSREHVEWCREFVKGKYIMAFNPPWGDINKSGRSGIALVATGLAKLAETEGKGVFDEAKKTVEALNGYLDKHKDEVDKASADNMITNLLKHIAKAQELYKNSSALRAQGAQIDTAFSSYYWLYKAGVTPETFPTVSQFLFELGKQPRGTKKMKKALLSTPMRWGKKLYELFADDSFQQNRIYMHPAVLTAGRISEMGVCFGTIPVANPDDAAQGSGHTKSILNLRTNTETNNPCAKTIVKLFEIQKTGFNIQDMDIVASEHLLHQSLVGKQSPFQNAYNVKGNATSANII

SEQ ID NO: 628 - protein, 482 aa, Artificial Sequence
  derived and/or modified protein sequence (wt) from CCHFV(SPU 130/89)__KJ682821.1__N
MENKIEVNNKDEMNKWFEEFKKGNGLVDTFTNSYSFCESVPNLDKFVFQMASATDDAQKDSIYASALVEATKFCAPIYECAWVSSTGIVKRGLEWFEKNAGTIKSWDESYTELKVDVPKIEQLANYQQAALKWRKDIGFRVNANTAALSNKVLAEYKVPGEIVMSVKEMLSDMIRRRNQILNRGGDENPRGPVSREHVDWCREFVKGKYIMAFNPPWGDINKSGRSGIALVATGLAKLAETEGKGVFDEAKKTVEALNGYLDKHKDEVDRASADSMITNLLKHIAKAQELYKNSSALRAQGAQIDTAFSSYYWLYKAGVTPETFPTVSQFLFELGKQPRGTKKMKKALLSTPMKWGKKLYELFADDSFQQNRIYMHPAVLTAGRISEMGVCFGTIPVANPDDAAQGSGHTKSILNLRTNTETNNPCARTIVKLFEIQKTGFNIQDMDIVASEHLLHQSLVGKQSPFQNAYNVKGNATSANIV

SEQ ID NO: 629 - protein, 482 aa, Artificial Sequence
  derived and/or modified protein sequence (wt) from CCHFV(SPU 18/88)__KJ682818.1__N
MENKIEVNNKDEMNKWFEEFKKGNGLVDTFTNSYSFCESVPNLDKFVFQMASATDDAQKDSIYASALVEATKFCAPIYECAWVSSTGIVKRGLEWFEKNAGTIKSWDESYTELKVDVPKIEQLANYQQAALKWRKDIGFRVNANTAALSNKVLAEYKVPGEIVMSVKEMLSDMIRRRNQILNRGGDENPRGPVSREHVDWCREFVKGKYIMAFNPPWGDINKSGRSGIALVATGLAKLAETEGKGVFDEAKKTVEALNGYLDKHKDEVDRASADSMVTNLLKHIAKAQELYKNSSALRAQGAQIDTAFSSYYWLYKAGVTPETFPTVSQFLFELGKQPRGTKKMKKALLSTPMKWGKKLYELFADDSFQQNRIYMHPAVLTAGRISEMGVCFGTIPVANPDDAAQGSGHTKSILNLRTNTETNNPCARTIVKLFEIQKTGFNIQDMDIVASEHLLHQSLVGKQSPFQNAYNVKGNATSANII

SEQ ID NO: 630 - protein, 482 aa, Artificial Sequence
  derived and/or modified protein sequence (wt) from CCHFV(SPU 187/90)__KJ682823.1__N
MENKIEVNNKDEMNKWFEEFKKGNGLVDTFTNSYSFCESVPNLDKFVFQMASATDDAQKDSIYASALVEATKFCAPIYECAWVSSTGIVKRGLEWFEKNAGTIKSWDESYTELKVDVPKIEQLANYQQAALKWRKDIGFRVNANTAALSNKVLAEYKVPGEIVMSVKEMLSDMIRRRNQILNRGGDENPRGPVSREHVDWCREFVKGKYIMAFNPPWGDINKSGRSGIALVATGLAKLAETEGKGVFDEAKKTVEALNGYLDKHKDEVDRASADSMITNLLKHIAKAQELYKNSSALRAQGAQIDTAFSSYYWLYKAGVTPETFPTVSQFLFELGKQPRGTKKMKKALLSTPMKWGKKLYELFADDSFQQNRIYMHPAVLTAGRISEMGVCFGTIPVANPDDAAQGSGHTKSILNLQTNTETNNPCARTIVKLFEIQKTGFNIQDMDIVASEHLLHQSLVGKQSPFQNAYNVKGNATSANII

SEQ ID NO: 631 - protein, 482 aa, Artificial Sequence
  derived and/or modified protein sequence (wt) from CCHFV(SPU 383/87)__KJ682816.1__N
MENKIEVNNKDEMNKWFEEFKKGNGLVDTFTNSYSFCESVPNLDKFVFQMAGATDDAQKDSIYASALVEATKFCAPIYECAWVSSTGIVKRGLEWFEKNAGTIKSWDESYTELKVDVPKIEQLANYQQAALKWRKDIGFRVNANTAALSNKVLAEYKVPGEIVMSVKEMLSDMIRRRNQILNRGGDENPRGPVSREHVDWCREFVKGKYIMAFNPPWGDINKSGRSGIALVATGLAKLAETEGKGVFDEAKKTVEALNGYLDKHKDEVDRASADSMITNLLKHIAKAQELYKNSSALRAQGAQIDTAFSSYYWLYKAGVTPETFPTVSQFLFELGKQPRGTKKMKKALLSTPMKWGKKLYELFADDSFQQNRIYMHPAVLTAGRISEMGVCFGTIPVANPDDAAQGSGHTKSILNLRTNTETSNPCARTIVKLFEIQKTGFNIQDMDIVASEHLLHQSLVGKQSPFQNAYNVKGNATSANIV

SEQ ID NO: 632 - protein, 482 aa, Artificial Sequence
  derived and/or modified protein sequence (wt) from CCHFV(SPU 383/87)__KJ682816.1__N
MENKIEVNNKDEMNKWFEEFKKGNGLVDTFTNSYSFCESVPNLDKFVFQMAGATDDAQKDSIYASALVEATKFCAPIYECAWVSSTGIVKRGLEWFEKNAGTIKSWDESYTELKVDVPKIEQLANYQQAALKWRKDIGFRVNANTAALSNKVLAEYKVPGEIVMSVKEMLSDMIRRRNQILNRGGDENPRGPVSREHVDWCREFVKGKYIMAFNPPWGDINKSGRSGIALVATGLAKLAETEGKGVFDEAKKTVEALNGYLDKHKDEVDRASADSMITNLLKHIAKAQELYKNSSALRAQGAQIDTAFSSYYWLYKAGVTPETFPTVSQFLFELGKQPRGTKKMKKALLSTPMKWGKKLYELFADDSFQQNRIYMHPAVLTAGRISEMGVCFGTIPVANPDDAAQGSGHTKSILNLRTNTETSNPCARTIVKLFEIQKTGFNIQDMDIVASEHLLHQSLVGKQSPFQNAYNVKGNATSANII

SEQ ID NO: 633 - protein, 482 aa, Artificial Sequence
  derived and/or modified protein sequence (wt) from CCHFV(SPU 431/85)__KJ682815.1__N
MENKIEVNNKDEMNKWFEEFKKGNGLVDTFTNSYSFCESVPNLDKFVFQMASATDDAQKDSIYASALVEATKFCAPVYECAWVSSTGIVKRGLEWFEKNAGTIKSWDESYTELKVDVPKIEQLANYQQAALKWRKDIGFRVNANTAALSNKVLAEYKVPGEIVMSVKEMLSDMIRRRNQILNRGGDENPRGPVSREHVDWCREFVKGKYIMAFNPPWGDINKSGRSGIALVATGLAKLAETEGKGVFDEAKKTVEALNGYLDKHKDEVDRASADSMITNLLKHIAKAQELYKNSSALRAQGAQIDTAFSSYYWLYKAGVTPETFPTVSQFLFELGKQPRGTKKMKKALLSTPMKWGKKLYELFADDTFQQNRIYMHPAVLTAGRISEMGVCFGTIPVANPDDAAQGSGHTKSILNLRTNTETNNPCARTIVKLFEIQKTGFNIQDMDIVASEHLLHQSLVGKQSPFQNAYNVKGNATSVNII

SEQ ID NO: 634 - protein, 482 aa, Artificial Sequence
  derived and/or modified protein sequence (wt) from CCHFV(SPU 45/88)__KJ682819.1__N
MENKIEVNNKDEMNKWFEEFKKGNGLVDTFTNSYSFCESVPNLDKFVFQMASATDDAQKDSIYASALVEATKFCAPIYECAWVSSTGIVKRGLEWFEKNAGTIKSWDESYTELKVDVPKIEQLANYQQAALKWRKDIGFRVNANTAALSNKVLAEYKVPGEIVMSVKEMLSDMIRRRNQILNRGGDENPRGPVSREHVDWCREFVKGKYIMAFNPPWGDINKSGRSGIALVATGLAKLAETEGKGVFDEAKKTVEALNGYLDKHKDEVDRASADSMITNLLKHIAKAQELYKNSSALRAQGAQIDTAFSSYYWLYKAGVTPETFPTVSQFLFELGKQPRGTKKMKKALLSTPMKWGKKLYELFADDSFQQNRIYMHPAVLTAGRISEMGVCFGTIPVANPDDAAQGSGHTKSILNLRTNTETNNPCARTIVKLFEIQKTGFNIQDMDIVASEHLLHQSLVGKQSPFQNAYNVKGNATSANII

SEQ ID NO: 635 - protein, 482 aa, Artificial Sequence
  derived and/or modified protein sequence (wt) from CCHFV(SPU 48/90)__KJ682822.1__N
MENKIEVNNKDEMNKWFEEFKKGNGLVDTFTNSYSFCESVPNLDKFVFQMASATDDAQKDSIYASALVEATKFCAPIYECAWVSSTGIVKRGLEWFEKNAGTIKSWDESYTELKVDVPKIEQLANYQQAALKWRKDIGFRVNANTAALSNKVLAEYKVPGEIVMSVKEMLSDMIRRRNQILNRGGDENPRGPVSREHVDWCREFVKGKYIMAFNPPWGDINKSGRSGIALVATGLAKLAETEGKGVFDEAKKTVEALNGYLDKHKDEVDRASADSMITNLFKHIAKAQELYKNSSALRAQGAQIDTAFSSYYWLYKAGVTPETFPTVSQFLFELGKQPRGTKKMKKALLSTPMKWGKKLYELFADDSFQQNRIYMHPAVLTAGRISEMGVCFGTIPVANPDDAAQGSGHTKSILNLRTNTETNNPCARTIVKLFEIQKTGFSIQDMDIVASEHLLHQSLVGKQSPFQNAYNVKGNATSANII

SEQ ID NO: 636 - protein, 482 aa, Artificial Sequence
  derived and/or modified protein sequence (wt) from CCHFV(SPU 497/88)__KJ682820.1__N
MENKIEVNNKDEMNKWFEEFKKGNGLVDTFTNSYSFCESVPNLDKFVFQMASATDDAQKDSIYASALVEATKFCAPIYECAWVSSTGIVKRGLEWFEKNAGTIKSWDESYTELKVDVPKIEQLANYQQAALKWRKDIGFRVNANTAALSNKVLAEYKVPGEIVMSVKEMLSDMIRRRNQILNRGGDENPRGPVSREHVDWCREFVKGKYIMAFNPPWGDINKSGRSGIALVATGLAKLAETEGKGVFDEAKKTVEALNGYLDKHKDEVDRASADSMITNLLKHIAKAQELYKNSSALRAQGAQIDTAFSSYYWLYKAGVTPETFPTVSQFLFELGKQPRGTKKMKKALLSTPMKWGKKLYELFADDSFQQNRIYMHPAVLTAGRISEMGVCFGAIPVANPDDAAQGSGHTKSILNLRTNTETNNPCARTIVKLFEIQKTGFNIQDMDIVASEHLLHQSLVGKQSPFQNAYNVKGNATSANII

SEQ ID NO: 637 - protein, 482 aa, Artificial Sequence
  derived and/or modified protein sequence (wt) from CCHFV(SPU 556/87)__KJ682817.1__N
MENKIEVNNKDEMNRWFEEFKKGNGLVDTFTNSYSFCESVPNLDRFVFQMAGATDDAQKDSIYASALVEATKFCAPIYECAWVSSTGIVKKGLEWFEKNAGTIKSWDESYTELKVDVPKIEQLANYQQAALKWRKDIGFRVNANTAALSNKVLAEYKVPGEIVMSVKEMLSDMIRRRNQILNRGGDENPRGPVSREHVDWCREFVKGKYIMAFNPPWGDINKSGRSGIALVATGLAKLAETEGKGVFDEAKKTVEALNGYLDKHKDEVDRASADSMITNLLKHIAKAQELYKNSSALRAQGAQIDTAFSSYYWLYKAGVTPETFPTVSQFLFELGKQPRGTKKMKKALLSTPMKWGKKLYELFADDSFQQNRIYMHPAVLTAGRISEMGVCFGTIPVANPDDAAQGSGHTKSILNLRTNTETNNPCAKTIVKLFEIQKTGFNIQDMDIVASEHLLHQSLVGKQSPFQNAYNVKGNATSANII

SEQ ID NO: 638 - protein, 482 aa, Artificial Sequence
  derived and/or modified protein sequence (wt) from CCHFV(SPU 92/01)__KC880335.1__N
MENKIEVNNKDEMNKWFEEFKKGNGLVDTFTNSYSFCESVPNLDKFVFQMASATDDAQKDSIYASALVEATKFCAPIYECAWVSSTGIVKRGLEWFEKNAGTIKSWDESYTELKVDVPKIEQLANYQQAALKWRKDIGFRVNANTAALSNKVLAEYKVPGEIVMSVKEMLSDMIRRRNQILNRGGDENPRGPVSREHVDWCREFVKGKYIMAFNPPWGDINKSGRSGIALVATGLAKLAETEGKGVFDEAKKTVEALNGYLDKHKDEVDRASADSMITNLLKHIAKAQELYKNSSALRAQGAQIDTAFSSYYWLYKAGVTPETFPTVSQFLFELGKQPRGTKKMKKALLSTPMKWGKKLYELFADDSFQQNRIYMHPAVLTAGRISEMGVCFGTIPVANPDDAAQGSGHTKSILNLQTNTETNNPCARTIVKLFEIQKTGFNIQDMDIVASEHLLHQSLVGKQSPFQNAYNVKGNATSVNII

SEQ ID NO: 639 - protein, 482 aa, Artificial Sequence
  derived and/or modified protein sequence (wt) from CCHFV(SRR)__KU707901.1__N
MENKIEVNNKDEMNKWFEEFKKGNGLVDTFTNSYSFCESVPNLDRFVFQMAGATDDAQKDSIYASALVEATKFCAPIYECAWVSSTGIVKKGLEWFEKNAGTIKSWDESYTELKVEVPKIEQLANYQQAALKWRKDIGFRVNANTAALSHKVLAEYKVPGEIVMSVKEMLSDMIRRRNLILNRGGDENPRGPVSREHVEWCREFVKGKYIMAFNPPWGDINKSGRSGIALVATGLAKLAETEGKGVFDEAKKTVEALNGYLDKHKDEVDKASADNMITNLLKHIAKAQELYKNSSALRAQGAQIDTAFSSYYWLYKAGVTPETFPTVSQFLFELGKQPRGTKKMKKALLSTPMRWGKKLYELFADDSFQQNRIYMHPAVLTAGRISEMGVCFGTIPVANPDDAAQGSGHTKSILNLRTNTETNNPCAKTIVKLFEIQKTGFNIQDMDIVASEHLLHQSLVGKQSPFQNAYNVKGNATSANII

SEQ ID NO: 640 - protein, 482 aa, Artificial Sequence
  derived and/or modified protein sequence (wt) from CCHFV(STV/HU29223)__AF481802.1__N
MENKIEVNSKDEMNKWFEEFKKGNGLMDTFTNSYSFCENVPNLDKFVFQMASATDDAQKDSIYASALVEATKFCAPIYECAWVSSTGIVKKGLEWFEKNSGTIKSWDENYAELKVDVPKIEQLANYQQAALKWRKDIGFRVNANTAALSNKVLAEYKVPGEIVMSVKEMLSDMIRRRNLILNRGGDENLRGPVSREHVEWCREFVKGKYIMAFNPPWGDINKSGRSGIALVATGLAKLAETEGKGVFDEAKKTVEALNGYLDKHRDEVDKASADSMITNLLKHIAKAQELYKNSSALRAQGAQIDTPFSSFYWLYKAGVTPETFPTISQFLFELGKQPRGTKKMKKALLSTPMKWGKKLYELFADDSFQQNRIYMHPAVLTAGRISEMGVCFGTIPVANPDDAAQGSGHTKSILNLRTSTETNNPCAKTIVKLFEIQKTGFNIQDMDIVASEHLLHQSLVGKQSPFQNAYNVKGNATSANII

SEQ ID NO: 641 - protein, 482 aa, Artificial Sequence
  derived and/or modified protein sequence (wt) from CCHFV(TAJ/HU8966)__AY049083.2__N
MENKIEVNNKDEMNKWFEEFKKGNGLVDTFTNSYSFCESVPNLDRFVFQMASATDDAQKDSIYASALVEATKFCAPIYECAWVSSTGIVKKGLEWFEKNAGTIKSWDESYTELKVEVPKIEQLANYQQAALKWRKDIGFRVNANTAALSHKVLAEYKVPGEIVMSVKEMLSDMIRRRNLILNRGGDENPRGPVSREHVEWCREFVKGKYIMAFNPPWGDINKSGRSGIALVATGLAKLAETEGKGVFDEAKKTVEALNGYLDKHKDEVDKASADNMITNLLKHIAKAQELYKNSSALRAQGAQIDTAFSSYYWLYKAGVTPETFPTVSQFLFELGKQPRGTKKMKKALLSTPMKWGKKLYELFADDSFQQNRIYMHPAVLTAGRISEMGVCFGTIPVADPDDAAQGSGHTKSILNLRTNTETNNPCAKTIVKLFEIQKTGFNIQDMDIVASEHLLHQSLVGKQSPFQNAYNVKGNATSANII

SEQ ID NO: 642 - protein, 482 aa, Artificial Sequence
  derived and/or modified protein sequence (wt) from CCHFV(TAJ/HU8975)__AY297692.2__N
MENKIEVNNKDEMNKWFEEFKKGNGLVDTFTNSYSFCESVPNLDRFVFQMASATDDAQKDSIYASALVEATKFCAPIYECAWVSSTGIVKKGLEWFEKNAGTIKSWDESYIELKVEVPKIEQLANYQQAALKWRKDIGFRVNANTAALSHKVLAEYKVPGEIVMSVKEMLSDMIRRRNLILNRGGDENPRGPVSREHVEWCREFVKGKYIMAFNPPWGDINKSGRSGIALVATGLAKLAETEGKGVFDEAKKTVEALNGYLDKHKDEVDKASADNMITNLLKHIAKAQELYKNSSALRAQGAQIDTAFSSYYWLYKAGVTPETFPTVSQFLFELGKQPRGTKKMKKALLSTPMKWGKKLYELFADDSFQQNRIYMHPAVLTAGRISEMGVCFGTIPVANPDDAAQGSGHTKSILNLRTNTETNNPCAKTIVKLFEIQKTGFNIQDMDIVASEHLLHQSLVGKQSPFQNAYNVKGNATSANII

SEQ ID NO: 643 - protein, 482 aa, Artificial Sequence
  derived and/or modified protein sequence (wt) from CCHFV(TAJ/HU8978)__AY297691.2__N
MENKIEVNNKDEMNKWFEEFKKGNGLVDTFTNSYSFCESVPNLDRFVFQMAGATDDAQKDSIYASALVEATKFCAPIYECAWVSSTGIVKKGLEWFEKNAGTIKSWDESYTELKVEVPKIEQLANYQQAALKWRKDIGFRVNANTAALSHKVLAEYKVPGEIVMSVKEMLSDMIRRRNLFLNRGGDENPRGPVSREHVEWCREFVKGKYIMAFNPPWGDINKSGRSGIALVATGLAKLAETEGKGVFDEAKRTVEALNGYLDKHKDEVDKASADNMITNLLKHIAKAQELYKNSSALRAQGAQIDTSFSSYYWLYKAGRTPETFPTVSQFLFELGKQPRGTKKMKKALLSTPMKWGKKLYELFADDSFQQNRIYMHPAVLTAGRISEMGVCFGTIPVANPDDAAQGSGHTKSILNLRTNTETNNPCAKTIVKLFEIQKTGFNIQDMDIVASEHLLHQSLVGKQSPFQNAYNVKGNATSANII

SEQ ID NO: 644 - protein, 482 aa, Artificial Sequence
  derived and/or modified protein sequence (wt) from CCHFV(Uzbek/TI10145)__AF481799.1__N
MENKIEVNNKDEMNKWFEEFKKGNGLVDTFTNSYSFCESVPNLDRFVFQMASATDDAQKDSIYASALVEATKFCAPIYECAWVSSTGIVKKGLEWFEKNAGTIKSWDESYTELKVEVPKIEQLADYQQAALKWRKDIGFRVNANTAALSHKVLAEYKVPGEIVMSVKEMLSDMIRRRNLILNRGGDENPRGPVSREHVEWCREFVKGKYIMAFNPPWGDINKSGRSGIALVATGLAKLAETEGKGVFDEAKKTVEALNGYLDKHKDEVDKASADNMITNLLKHIAKAQELYKNSSALRAQGAQIDTAFSSYYWLYKAGVTPETFPTVSQFLFELGKQPRGTKKMKKALLSTPMKWGKKLYELFADDSFQQNRIYMHPAVLTAGRISEMGVCFGTIPVANPDDAAQGSGHTKSILNLRTNTETNNPCAKTIVKLFEIQKTGFNIQDMDIVASEHLLHQSLVGKQSPFQNAYNVKGNATSANII

SEQ ID NO: 645 - protein, 482 aa, Artificial Sequence
  derived and/or modified protein sequence (wt) from CCHFV(ROS/TI28044)__AY277672.1__N
MENKIEVNSKDEMNKWFEEFKKGNGLMDTFTNSYSFCENVPNLDKFVFQMASATDDAQKDSIYASALVEATKFCAPIYECAWVSSTGIVKKGLEWFEKNSGTIKSWDENYAELKVDVPKIEQLANYQQAALKWRKDIGFRVNANTAALSNKVLAEYKVPGEIVMSVKEMLSDMIRRRNLILNRGGDENPRGPVSREHVEWCREFVKGKYIMAFNPPWGDINKPGRSGIALVATGLAKLAETEGKGVFDEAKKTVEALNGYLDKHRDEVDKASADSMIANLLKHIAKAQELYKNSSALRAQGAQIDTPFSSFYWLYKAGVTPETFPTISQFLFELGKQPRGTKKMKKALLSTPMKWGKKLYELFADDSFQQNRIYMHPAVLTAGRISEMGVCFGTIPVANPDDAAQGSGHTKSILNLRTSTETNNPCAKTIVKLFEIQKTGFNIQDMDIVASEHLLHQSLVGKQSPFQNAYNVKGNATSANII

SEQ ID NO: 646 - protein, 482 aa, Artificial Sequence
  derived and/or modified protein sequence (wt) from CCHFV(7001)__AF415236.1__N
MENKIEVNNKDEMNKWFEEFKKGNGLVDTFTNSYSFCESVPNLDRFVFQMASATDDAQKDSIYASALVEATKFCAPIYECAWVSSTGIVKRGLEWFEKNAGTIKSWDESYTELKVEVPKIEQLADYQQAALKWRKDIGFRVNANTTALSHKVLAEYKVPGEIVMSVKEMLSDMIRRRNLILNRGGDESPRGPVSREHVEWCREFVKGKYIMAFNPPWGDINKSGRSGIALVATGLAKLAETEGKGVFDEAKKTVEALNGYLNKHKDEVDKASADSMITNLLKHIAKAQELYKNSSALRAQGAQIDTAFSSYYWLYKAGVTPETFPTVSQFLFELGKQPRGTKKMKKALLSTPLKWGKKLYELFADDSFQQNRIYMHPAVLTAGRISEMGVCFGTIPVANPDDAAQGSGHTKSILNLRTNTETNNPCPKTIVKLFEIQKTGFNIQDMDIVASEHLLHQSLVGKQSPFQNAYNVKGNATSANII

SEQ ID NO: 647 - protein, 482 aa, Artificial Sequence
  derived and/or modified protein sequence (wt) from CCHFV(79121M18)__GU477494.1__N
MENKIEVNNKDEMNKWFEEFKKGNGLVDTFTNSYSFCESVPNLDRFVFQMASATDDAQKDSIYASALVEATKFCAPIYECAWVSSTGIVKRGLEWFEKNAGTIKSWDESYTELKVEVPKIEQLADYQQAALKWRKDIGFRVNANTTALSHKVLAEYKVPGEIVMSVKEMLSDMIRRRNLILNRGGDESPRGPVSREHVEWCREFVKGKYIMAFNPPWGDINKSGRSGIALVATGLAKLAETEGKGVFDEAKKTVEALNGYLNKHKDEVDKASADSMITNLLKHIAKAQELYKNSSALRAQGAQIDTAFSSYYWLYKAGVTPETFPTVSQFLFELGKQPRGTKKMKKALLSTPLKWGKKLYELFADDSFQQNRIYMHPAVLTAGRISEMGVCFGTIPVANPDDAAQGSGHTKSILNLRTNTETNNPCAKTIVKLFEIQKTGFNIQDMDIVASEHLLHQSLVGKQSPFQNAYNVKGNATSANII

SEQ ID NO: 648 - protein, 482 aa, Artificial Sequence
  derived and/or modified protein sequence (wt) from CCHFV(AP92)__DQ211638.1__N
MENKIEVNSKDDLNKWFEEFKKGNGLVDTFTNSYSFCENVPNLDRFVYQMASATDDAQKDSIYASALVEATKYCAPIYECAWVSSTGIVKKGLEWFEKNTSTIKSWDESYTELKVDIPKIEQLSSYQQAALKWRKDIGFRINANTTALSNKVLAEYKVPGEILVPVKEMLSDMIRRRNIILNRGSDENPRGPVSHEHIEWCREFIKGKYIMAFNPPWGDINKSGRSGIALVATGLAKLAETEGKGVFEEAKKTVEALKDYLDKHRDEVDKTSADNMVTSLLKHIAKAQELYKNSSALRAQGAQIDTPFSSFYWLYKAGVTPETFPTVSQFLFELGKQPRGTKKMKKALLSTPMKWGKKLYELFADDSFQQNRIYMHPAVLTAGRISEMGVCFGTIPVANPDDAAQGSGHTKSILNLRTNTESNNPCARTIVKLFEIQKTGFDIKDMDIVASEHLLHQSLVGKQSPFQNAYNVKGNATSANII

SEQ ID NO: 649 - protein, 482 aa, Artificial Sequence
  derived and/or modified protein sequence (wt) from CCHFV(ArD15786)__DQ211640.1__N
MENKIEVNNKDELNKWFEEFKKGNGLVDTFTNSYSFCENVPNLDRFVFQMAGATDDAQKDSIYASALVEATKYCAPIYECAWVSSTGIVKRGLEWFEKNTGTIKSWDESYTELKVDVPKIEQLANYQQAALKWRKDIGFRVNANTAALSNKVLSEYKVPGEIVMSVKEMLSDMIRRRNLILNRGGDENPRGPVSKEHIEWCREFVKGKYIMAFNPPWGDVNKSGRSGIALVATGLAKLAETEGKGVFEEAKKTVEALKEYLDKHKDEVDKASADSMVTNLLKHITKAQELYKNSSALRAQGAQIDTPFSSFYWLYKAGVTPETFPTVSQFLFELGKQPRGTKKMKKALLSTPMKWGKKLYELFADDSFQQNRIYMHPAVLTAGRISEMGVCFGTIPVANPDDAAQGSGHTKSILNLRTNSETNNPCAKTIVKLFEVQKTGFNIQDMDIVASEHLLHQSLVGKQSPFQNAYNVKGNATSANII

SEQ ID NO: 650 - protein, 482 aa, Artificial Sequence
  derived and/or modified protein sequence (wt) from CCHFV(ArD39554)__DQ211641.1__N
MENKIEVNNKDEMNKWFEEFKKGNGLVDTFTNSYSFCESVPNLDKFVFQMASATDDAQKDSIYASALVEATKFCAPIYECAWVSSTGIVKRGLEWFEKNAGTIKSWDESYTELKVDVPKIEQLANYQQAALKWRKDIGFRVNANTAALSNKVLAEYKVPGEIVMSVKEMLSDMIRRRNQILNRGGDENPRGPVSREHVDWCREFVKGKYIMAFNPPWGDINKSGRSGIALVATGLAKLAETEGKGVFDEAKKTVEALNGYLDKHKDEVDKASADSMITNLLKHIAKAQELYKNSSALRAQGAQIDTAFSSYYWLYKAGVTPETFPTVSQFLFELGKQPRGTKKMKKALLTTPMKWGKKLYELFADDSFQQNRIYMHPAVLTAGRISEMGVCFGTIPVANPDDAAQGSGHTKSILNLRTNTETNNPCARTIVKLFEIQKTGFNIQDMDIVASEHLLHQSLVGKQSPFQNAYNVKGNATSANII

SEQ ID NO: 651 - protein, 482 aa, Artificial Sequence
  derived and/or modified protein sequence (wt) from CCHFV(BT958)__EF123122.1__N
MENKIEVNNKDEMNRWFEEFKKENGLVDTFTNSHSFCESVPNLDKFVFQMASATDDAQKDSIYAAALVEATKFCAPIYECAWVSSTGIVKKGLEWFEKNAGTIKSWDESYTELKVEVPKIEQLSNYQQAALKWRKDIGFRVNANTATLSHKVLAEYKVPGEIVMSVKEMLSDMIRRRNLILNRGGDENPRGPVSREHVEWCREFVKGKYIMAFNPPWGDINKSGRSGIALVATGLAKLAEAEGKGVFDEAKKTVEALNGYLDKHKDEVDKSSADSMITNLLKHIAKAQELYRNSSALRAQGAQIDTAFSSYYWLYKAGVTPETFPTVSQFLFELGKQPRGTKKMKKALLSTPMKWGKKLYELFADDSFQQNRIYMHPAVLTAGRISEMGVCFGTIPVANPDDAALGSGHTKSILNLRTSTEANNPCAKTIVKLFEIQKKGFVIKDMDIVASEHLLHQSLVGKQSPFQNAYNVKGNATSANII

SEQ ID NO: 652 - protein, 482 aa, Artificial Sequence
  derived and/or modified protein sequence (wt) from CCHFV(C-68031)__DQ211642.1__N
MENKIEVNNKDEMNKWFEEFKKGNGLVDTFTNSYSFCESVPNLERFVFQMASATDDAQKDSIYASALVEATKFCAPIYECAWVSSTGIVKKGLEWFEKNAGTIKSWDESYIELKVEVPKIEQLANYQQAALKWRKDIGFRVNANTAALSHKVLAEYKVPGEIVMSVKEMLSDMIRRRNLILNRGGDENPRGPVSREHVEWCREFVKGKYIMAFNPPWGDINKSGRSGIALVATGLAKLAETEGKGVFDEAKKTVEALNGYLDKHKDEVDKASADNMITNLLKHIAKAQELYKNSSALRAQGAQIDTAFSSYYWLYKAGVTPETFPTVSQFLFELGKQPRGTKKMKKALLSTPMKWGKKLYELFADDSFQQNRIYMHPAVLTAGRISEMGVCFGTIPVANPDDAAQGSGHTKSILNLRTNTETNNPCAKTIVKLFEIQKTGFNIQDMDIVASEHLLHQSLVGKQSPFQNAYNVKGNATSANII

SEQ ID NO: 653 - protein, 482 aa, Artificial Sequence
  derived and/or modified protein sequence (wt) from CCHFV(China)__AF354296.1__N
MENKIEVNNKDEMNKWFEEFKKGNGLVDTFTNSYSFCESVPNLERFVFQMASATDDAQKDSIYASALVEATKFCAPIYECAWVSSTGIVKKGLEWFEKNAGTIKSWDESYTELKVEVPKIEQLANYQQAALKWRKDIGFRVNANTAALSHKVLAEYKVPGEIVMSVKEMLSDMIRRRNLILNSGGDENPRGPVSREHVEWCREFVKGKYIMAFNPPWGDINKSGRSGIALVATGLAKLAETGGKGVFDEAKKTVEALNGYLDKHKDEVDKASADNMITNLLKHIAKAQELYKNSSALRAQGAQIDTAFSSYYWLYKAGATPETFPTVSQFLFELGKQPRGTKKMKKALLSTPMKWGKKLYELFADDSFQQNRIYMHPAVLTAGRISEMGVCFGTIPVANPDDAAQGSGHTKSILNLRTNTETNNPCAKTIVRLFEIQKTGFNIQDMDIVASEHLLHQSLVGKQSPFQNAYNVKGNATSANII

SEQ ID NO: 654 - protein, 482 aa, Artificial Sequence
  derived and/or modified protein sequence (wt) from CCHFV(China)__AF358784.1__N
MENKIEVNNKDEMNKWFEEFKKGNGLVDTFTNSYSFCESVPNLDRFVFQMASATDDAQKDSIYASALVEATKFCAPIYECAWVSSTGIVKRGLEWFEKNAGTIKSWDESYTELKVEVPKIEQFADYQQAALKWRKDIGFRVNANTTALSHKVLAEYKVPGEIVMSVKEMLSDMIRRRNLILNRGGDESPRGPVSREHVEWCREFVKGKYIMAFNPPWGDINKSGRSGIALVATGLAKLAETEGKGVFDEAKKTVEALNGYLNKHKDEVDKASADSMITNLLKHIAKAQELYKNSSALRAQGAQIDTAFSSYYWLYKAGVTPETFPTVSQFLFELGKQPRGTKKMKKALLSTPLKWGKKLYELFADDSFQQNRIYMHPAVLTAGRISEMGVCFGTIPVANPDDAAQGSGHTKSILNLRTNTETNNPCAKTIVKLFEIQKTGFNIQDMDIVASEHLLHQSLVGKQSPFQNAYNVKGNATSANII

SEQ ID NO: 655 - protein, 482 aa, Artificial Sequence
  derived and/or modified protein sequence (wt) from CCHFV(China)__AF362080.1__N
MENKIEVNNKDEMNKWFEEFKKGNGLVDTFTNSYSFCESVPNLERFVFQMASATDDAQKDSIYASALVEATKFCAPIYECAWVSSTGIVKKGLEWFEKNAGTIKSWDESYTELKVEVPKIEQLTNYQQAALKWRKDIGFRVNANTAALSHKVLAEYKVPGEIVMSVKEMLSDMIRRRNLILNRGGDENPRGPVSREHVEWCREFVKGTYIMAFNPPWGDINKSGRSGIALVATGLAKLAETEGKGVFDEAKKTVEALNGYLDKHKDEVDKASADNMITNLLKHIAKAQELYKNSSALRAQGAQIDTAFSSYYWLYKAGVTPETFPTVSQFLFELGKQPRGTKKMKKALLSTPMKWGKKLYELFADDSFQQNRIYMHPAVLTAGRISEMGVCFGTIPVANPDDAAQGSGHTKSILNLRTNTETNNPCAKTIVKLFEIQKTGFNIQDMDIVASEHLLHQSLVGKQSPFQNAYNVKGNATSANII

SEQ ID NO: 656 - protein, 482 aa, Artificial Sequence
  derived and/or modified protein sequence (wt) from CCHFV(China)__AY029157.1__N
MENKIEVNNKDEMNKWFEEFKKGNGLVDTFTNSYSFCESVPNLERFVFQMASATDDAQKDSIYASALVEATKFCAPIYECAWVSSTGIVKKGLEWFEKNAGTIKSWDESYTELKVEVPKIEQLANYQQAALKWRKDIGFRVNANTAALSHKVLAEYKVPGEIVMSVKEMLSDMIRRRNLILNRGGDENPRGPVSREHVEWCREFVKGKYIMAFNPPWGDINKSGRSGIALVATGLAKLAETEGKGVFDEAKKTVEALNGYLDKHKDEVDKASADNMITNLLKHIAKAQELYKNSSALRAQGAQIDTAFSSYYWLYKAGVTPETFPTVSQFLFELGKQPRGTKKMKKALLSTPMKWGKKLYELFADDSFQQNRIYMHPAVLTAGRISEMGVCFGTIPVANPDDAAQGSGHTKSILNLRTNTETNNPCAKTIVKLFEIQKTGFNIQDMDIVASEHLLHQSLVGKQSPFQNAYNVKGNATSANII

SEQ ID NO: 657 - protein, 482 aa, Artificial Sequence
  derived and/or modified protein sequence (wt) from CCHFV(DAK 8194)__U88411.1__N
MENKIEVNNKDELNKWFEEFKKGNGLVDTFTNSYSFCENMPNLDRFVFQMAGATDDAQKDSIYASALVEATKYCAPIYECAWVSSTGIVKRGLEWFEKNTGTIKSWDESYTELKVDVPKIEQLANYQQAALKWRKDIGFRVNANTAALSNKVLSEYKVPGEIVMSVKEMLSDMIRRRNLILNRGGDENPRGPVSKEHIEWCREFVKGKYIMAFNPPWGDVNKSGRSGIALVATGLAKLAETEGKGVFEEAKKTVEALKEYLDKHKDEVDKASADSMVTNLLKHITKAQELYKNSSALRAQGAQIDTPFSSFYWLYKAGVTPETFPTVSQFLFELGKQPRGTKKMKKALLSTPMKWGKKLYELFADDSFQQNRIYMHPAVLTAGRISEMGVCFGTIPVADPDDAAQGSGHTKSILNLRTSSETNNPCAKTIVKLFEVQKTGFNIQDMDIVASEHLLHQSLVGKQSPFQNAYNVKGNATSANII

SEQ ID NO: 658 - protein, 482 aa, Artificial Sequence
  derived and/or modified protein sequence (wt) from CCHFV(Drosdov)__U88412.1__N
MENKIEVNSKDEMNKWFEEFKKENGLMDTFTNSYSFCENVPNLDKFVFQMASATDDAQKDSIYASALVEATKFCAPIYECAWVSSTGIVKKGLEWFEKNSGTIKSWDENYTELKVDVPKIEQLANYQQAALKWRKDIGFRVNANTAALSNKVLAEYKVPGEIVMSVKEMLSDMIRRRNLILNRGGDENPRGPVSREHVEWCREFVKGKYIMAFNPPWGDINKSGRSGIALVATGLAKLAETEGKGVFDEAKKTVEALNGYLDKHRDEVDKASADSMITNLLKHIAKAQELYKNSSALRAQGAQIDTPFSSFYWLYKAGVTPETFPTISQFLFELGKQPRGTKKMKKALLSTPMKWGKKLYELFADDSFQQNRIYMHPAVLTAGRISEMGVCFGTIPVANPDDAAQGSGHTKSILNLRTSTETNNPCAKTIVKLFEIQKTGFNIQDMDIVASEHLLHQSLVGKQSPFQNAYNVKGNATSANII

SEQ ID NO: 659 - protein, 482 aa, Artificial Sequence
  derived and/or modified protein sequence (wt) from CCHFV(Eskisehir23-2012)__KR092376.1__N
MENKIEVNSKDEMNKWFEEFKKGNGLMDTFTNSYSFCENVPNLDKFVFQMASATDDAQKDSIYASALVEATKFCAPIYECAWVSSTGIVKKGLEWFEKNTGTIKSWDENYAELKVDVPKIEQLANYQQAALKWRKDIGFRVNANTAALSNKVLAEYKVPGEIVMSVKEMLSDMIRRRNLILNRGGGENPRGPVSREHVEWCREFVKGKYIMAFNPPWGDINKSGRSGIALVATGLAKLAETEGKGVFDEAKRTVEALNGYLDKHRDEVDKASADSMITNLLKHIAKAQELYKNSSALRAQGAQIDTPFSSFYWLYKAGVTPETFPTISQFLFELGKQPRGTKKMKKALLSTPMKWGKKLYELFADDSFQQNRIYMHPAVLTAGRISEMGVCFGTIPVANPDDAAQGSGHTKSILNLRTSTETNNPCAKTIVKLFEIQKTGFNIQDMDIVASEHLLHQSLVGKQSPFQNAYNVKGNATSANII

SEQ ID NO: 660 - protein, 482 aa, Artificial Sequence
  derived and/or modified protein sequence (wt) from CCHFV(Hodzha)__AY223475.1__N
MENKIEVNNKDEMNKWFEEFKKGNGLVDTFTNSYSFCESVPNLDRFVFQMASATDDAQKDSIYASALVEATKFCAPIYECAWVSSTGIVKKGLEWFEKNAGTIKSWDESYTELKVEVPKIEQLANYQQAALKWRKDIGFRVNANTAALSHKVLSEYKVPGEIVMSVKEMLSDMIRRRNLILNRGGDENPRGPVSREHVEWCREFVKGKYIMAFNPPWGDINKSGRSGIALVATGLAKLAETEGKGVFDEAKKTVEALNGYLDKHKDEVDKASADNMTTNLLKHIAKAQELYKNSSALRAQGAQIDTAFSSYYWLYKAGVTPETFPTVSQFLFELGKQPRGTKKMKKALLSTPMKWGKKLYELFADDSFQQNRIYMHPAVLTAGRISEMGVCFGTVPVADPDDAAQGSGHTKSILNLRTNTETNNPCAKTIVKLFEIQKTGFNIQDMDIVASEHLLHQSLVGKQSPFQNAYNVKGNATSANII

SEQ ID NO: 661 - protein, 482 aa, Artificial Sequence
  derived and/or modified protein sequence (wt) from CCHFV(Iran-52)__DQ446212.1__N
MENKIEVNSKDEMNKWFEEFKKGNGLVDTFTNSYSFCESVPNLDRFVFQMASATDDAQKDSIYASALVEATKFCAPIYECAWASSTGIVKKGLEWFEKNAGTIKSWDESYTELKVEVPKIEQLSNYQQAALKWRKDIGFRVNANTAALSNKVLAEYKVPGEIVMSVKEMLSDMIRRRNLILNRGGDENPRGPVSREHVEWCREFVKGKYIMAFNPPWGDINKSGRSGIALVATGLAKLAETEGKGVFDEAKKTVEALNGYLDKHKDEVDKASADSMITNLLKHIAKAQELYKNSSALRAQGAQIDTVFSSYYWLYKAGVTPDTFPTVSQFLFELGKQPRGTKKMKKALLSTPMKWGKKLYELFADDSFQQNRIYMHPAVLTAGRISEMGVCFGTIPVANPDDAALGSGHTKSILNLRTNTETNNPCARTIVKLFEIQKTGFNIQDMDIVASEHLLHQSLVGKQSPFQNAYNVKGNATSANII

SEQ ID NO: 662 - protein, 482 aa, Artificial Sequence
  derived and/or modified protein sequence (wt) from CCHFV(Iran-53)__DQ446213.1__N
MENKIEVNSKDEMNKWFEEFKKGNGLVDTFTNSYSFCESVPNLDRFVFQMASATDDAQKDSIYASALVEATKFCAPIYECAWASSTGIVKKGLEWFEKNAGTIKSWDESYTELKVEVPKIEQLSNYQQAALKWRKDIGFRVNANTAALSNKVLAEYKVPGEIVMSVKEMLSDMIRRRNLILNKGGDENPRGPVSREHVEWCREFVKGKYIMAFNPPWGDINKSGRSGIALVATGLAKLAETEGKGVFDEAKKTVEALNGYLDKHKDEVDKASADSMITNLLKHIAKAQELYKNSSALRAQGAQIDTVFSSYYWLYKAGVTPDTFPTVSQFLFELGKQPRGTKKMKKALLSTPMKWGKKLYELFADDSFQQNRIYMHPAVLTAGRISEMGVCFGTIPVANPDDAALGSGHTKSILNLRTNTETNNPCARTIVKLFEIQKTGFNIQDMDIVASEHLLHQSLVGKQSPFQNAYNVKGNATSANII

SEQ ID NO: 663 - protein, 482 aa, Artificial Sequence
  derived and/or modified protein sequence (wt) from CCHFV(JD 206)__U88414.1__N
MENKIEVNSKDEMNKWFEEFKKGNGLVDTFTNSYSFCENVPNLDRFVFQMASATDDAQKDSIYASALVEATKFCAPIYECAWASSTGIVKKGLEWFEKNAGTIKSWDESYTELKVEVPKIEQLSNYQQAALKWRKDIGFRVNANTAALSNKVLAEYKVPGEIVMSVKEMLSDMIRRRNLILNRGGDENPRGPVSREHVEWCREFVKGMYIMAFNPPWGDINKSGRSGIALVATGLAKLAETEGKGVFDEAKKTVEALNGYLDKHKDEVDKASADSMITNLLKHIAKAQELYKNSSALRAQGAQIDTVFSSYYWLYKAGVTPDTFPTVSQFLFELGKQPRGTKKMKKALLSTPMKWGKKLYELFADDSFQQNRIYMHPAVLTAGRISEMGVCFGTIPVANPDDAALGSGHTKSILNLRTNTETNNPCAKTIVKLFEIQKTGFNIQDMDIVASEHLLHQSLVGKQSPFQNAYNVKGNATSANII

SEQ ID NO: 664 - protein, 482 aa, Artificial Sequence
  derived and/or modified protein sequence (wt) from CCHFV(Kashmanov)__DQ211644.1__N
MENKIEVNSKDEMNKWFEEFKKENGLMDTFTNSYSFCENVPNLDKFVFQMASATDDAQKDSIYASALVEATKFCAPIYECAWVSSTGIVKKGLEWFEKNSGTIKSWDENYAELKVDVPKIEQLANYQQAALKWRKDIGFRVNANTAALSNKVLAEYKVPGEIVMSVKEMLSDMIRRRNLILNRGGDENPRGPVSREHVEWCREFVKGKYIMAFNPPWGDINKSGRSGIALVATGLAKLAETEGKGVFDEAKKTVEALNGYLDKHRDEVDKASADSMITNLLKHIAKAQELYKNSSALRAQGAQIDTPFSSFYWLYKAGVTPETFPTISQFLFELGKQPRGTKKMKKALLSTPMKWGKKLYELFADDSFQQNRIYMHPAVLTAGRISEMGVCFGTIPVANPDDAAQGSGHTKSILNLRTSTETNNPCAKTIVKLFEIQKTGFNIQDMDIVASEHLLHQSLVGKQSPFQNAYNVKGNATSANII

SEQ ID NO: 665 - protein, 482 aa, Artificial Sequence
  derived and/or modified protein sequence (wt) from CCHFV(NIV 10405051)__JF922681.1__N
MENKIEVNNKDEMNKWFEEFKKGNGLVDTFTNSYSFCESVPNLDRFVFQMASATDDAQKDSIYASALVEATKFCAPIYECAWVSSTGIVKKGLEWFEKNAGTIKSWDESYTELKVEVPKIEQLANYQQAALKWRKDIGFRVNANTAALSHKVLAEYKVPGEIVMSVKEMLSDMIRRRNLILNRGGDENPRGPVSREHVEWCREFVKGKYIMAFNPPWGDINKSGRSGIALVATGLAKLAETEGKGVFDEAKKTVEALNGYLDKHKDEVDKASADNMITNLLKHIAKAQELYKNSSALRAQGAQIDTAFSSYYWLYKAGVTPETFPTVSQFLFELGKQPRGTKKMKKALLSTPMRWGKKLYELFADDSFQQNRIYMHPAVLTAGRISEMGVCFGTIPVANPDDAAQGSGHTKSILNLRTNTETNNPCAKTIVKLFEIQKTGFNIQDIDIVASEHLLHQSLVGKQSPFQNAYNVKGNATSANII

SEQ ID NO: 666 - protein, 482 aa, Artificial Sequence
  derived and/or modified protein sequence (wt) from CCHFV(Oman)__DQ211645.1__N
MENKIEVNNKDEMNKWFEEFKKGNGLVDTFTNSYSFCESVPNLDRFVFQMASATDDAQKDSIYASALVEATKFCAPIYECAWASSTGIVKKGLEWFEKNAGTIKSWDESYTELKVEVPKIEQLSNYQQAALKWRKDIGFRVNANTAALSNKVLAEYKVPGEIVMSVKEMLSDMIRRRNLILNRGGDENPRGPVSREHVEWCREFIKGKYIMAFNPPWGDINKSGRSGIALVATGLAKLAETEGKGVFDEAKKTVEALNGYLDKHKDEVDKASADSMITNLLKHIAKAQELYKNSSALRAQGAQIDTVFSSYYWLYKAGVTPDTFPTVSQFLFELGKQPRGTKKMKKALLSTPMKWGKKLYELFADDSFQQNRIYMHPAVLTAGRISEMGVCFGTIPVANPDDAALGSGHTKSILNLRTNTETNNPCAKTIVKLFEIQKTGFNIQDMDIVASEHLLHQSLVGKQSPFQNAYNVKGNATSANII

SEQ ID NO: 667 - protein, 482 aa, Artificial Sequence
  derived and/or modified protein sequence (wt) from CCHFV(SCT ex Afghanistan)__JX908640.1__N
MENKIEVNNKDEMNKWFEEFKKGNGLVDTFTNSYSFCESVPNLDRFVFQMASATDDAQKDSIYASALVEATKFCAPIYECAWASSTGIVKKGLEWFEKNAGTIKSWDESYTELKVEVPKIEQLSNYQQAALKWRKDIGFRVNANTAALSNKVLAEYKVPGEIVMSVKEMLSDMIRRRNLILNRGGDENPRGPVSREHVEWCREFIKGKYIMAFNPPWGDINKSGRSGIALVATGLAKLAETEGKGVFDEAKKTVEALNGYLDKHKDEVDKASADSMITNLLKHIAKAQELYKNSSALRAQGAQIDTVFSSYYWLYKAGVTPETFPTVSQFLFELGKQPRGTKKMKKALLSTPMKWGKKLYELFADDSFQQNRIYMHPAVLTAGRISEMGVCFGTIPVANPDDAALGSGHTKSILNLRTNTETNNPCAKTIVKLFEIQKTGFNIQDMDIVASEHLLHQSLVGKQSPFQNAYNVKGNATSANII

SEQ ID NO: 668 - protein, 482 aa, Artificial Sequence
  derived and/or modified protein sequence (wt) from CCHFV(Semunya)__DQ076413.1__N
MENKIEVTSKDEMNRWFEEFKKSNGLVDTFTNSYSFCESVPNLDRFVFQMASATDDAQKDSIYASALVEATKFCAPIYECAWVSSTGIVKKGLEWFEKNAGTIKSWDESYTELKVGVPKIEQLANYQQAALKWRKDIGFRVNANTAALSNKVLAEYKVPGEIVMSVKEMLSDMIRRRNLILNRGGDENPRGPVSREHVEWCREFVKGKYIMAFNPPWGDINKSGRSGIALVATGLAKLAETEGKGVFDEAKKTVEALNGYLDKHKDEVDKASADGMVTNLLKHIAKAQELYKNSSALRAQGAQIDTPFSSFYWLYKAGVSPETFPTVSQFLFELGKQPRGTKKMKKALLSTPMKWGKKLYELFADDSFQENRIYMHPAVLTAGRISEMGVCFGTIPVANPDDAAQGSGHTKSILNLRTNTETNNPCAKTIVKLFEIQKTGFNIQDMDIVASEHLLHQSLVGKQSPFQNAYNVKGNATSANII

SEQ ID NO: 669 - protein, 482 aa, Artificial Sequence
  derived and/or modified protein sequence (wt) from CCHFV(SK 2015/human)__KX129738.1__N
MENKIEVNNKDEMNKWFEEFKKGNGLVDTYTNSYSFCESVPNLDRFVFQMASATDDAQKDSIYASALVEATKFCAPIYECAWASSTGIVKKGLEWFEKNAGTIKLWDESYAELKVEVPKIEQLSNYQQAALKWRKDIGFRVNANTAALSNKVLAEYKVPGEIVMSVKEMLSDMIRRRNLILNRGGDENPRGPVSREHVEWCREFVKGKYIMAFNPPWGDINKSGRSGIALVATGLAKLAETEGKGVFDEAKKTVEALNGYLDKHKDEVDKASADSMITNLLKHIAKAQELYKNSSALRAQGAQIDTVFSSYYWLYKAGVTPDTFPTVSQFLFELGKQPRGTKKMKKALLSTPMKWGKKLYELFADDSFQQNRIYMHPAVLTAGRISEMGVCFGTVPVANPDDAALGSGHTKSILNLRTNTETNNPCAKTIVKLFEIQKTGFNIQDMDIVASEHLLHQSLVGKQSPFQNAYNVKGNATSANII

SEQ ID NO: 670 - protein, 482 aa, Artificial Sequence
  derived and/or modified protein sequence (wt) from CCHFV(SPU128/81/7)__DQ076415.1__N
MENKIEVNNKHEMNKWFEEFKKGNGLVDTFTNSYSFCESVPNLDKFVFQMASATDDAQKDSIYASALVEATKFCAPIYECAWVSSTGIVKRGLEWFEKNAGTIKSWDESYTELKVDVPKIEQLANYQQAALKWRKDIGFRVNANTAALSNKVLAEYKVPGEIVMSVKEMLSDMIRRRNQILNRGGDENPRGPVSREHVDWCREFVKGKYIMAFNPPWGDINKSGRSGIALVATGLAKLAETEGKGVFDEAKKTVEVLNGYLDKHKDEVDRASADSMITNLLKHIAKAQELYKNSSALRAQGAQIDTAFSSYYWLYKAGVTPETFPTVSQFLFELGKQPRGTKKMKKALLSTPMKWGKKLYELFADDSFQQNRIYMHPAVLTAGRISEMGVCFGTIPVANPDDAAQGSGHTKSILNLRTNTETNNPCARTIVKLFEIQKTGFNIQDMDIVASEHLLHQSLVGKQSPFQNAYNVKGNATSANII

SEQ ID NO: 671 - protein, 482 aa, Artificial Sequence
  derived and/or modified protein sequence (wt) from CCHFV(Sudan Al-Fulah 4-2008)__GQ862372.1__N
MENKIEVNNKDEMNKWFEEFKKGNGLVDTFTNSYSFCESVPNLDKFVFQMASATDDAQKDSIYASALVEATKFCAPIYECAWVSSTGIVKRGLEWFEKNAGTIKSWDESYTELKVDVPKIEQLANYQQAALKWRKDIGFRVNANTAALSNKVLAEYKVPGEIVMSVKEMLSDMIRRRNQILNRGGDENPRGPVSREHVDWCREFVKGKYIMAFNPPWGDINKSGRSGIALVATGLAKLAETEGKGVFDEAKKTVEALNGYLDKHKDEVDRASADSMITNLLKHIAKAQELYKNSSALRAQGAQIDTAFSSYYWLYKAGVTPETFPTVSQFLFELGKQPRGTKKMKKALLSTPMKWGKKLYELFADDSFQQNRIYMHPAVLTAGRISEMGVCFGTIPVANPDDAAQGSGHTKSILNLRTNTETNNPCARTIVKLFEIQKTGFSIQDMDIVASEHLLHQSLVGKQSPFQNAYNVKGNATSANII

SEQ ID NO: 672 - protein, 482 aa, Artificial Sequence
  derived and/or modified protein sequence (wt) from CCHFV(TAJUK)__JN086996.1__N
MENKIEVNNKDEMNKWFEEFKKGNGLVDTFTNSYSFCESVPNLDRFVFQMASATDEAQKDSIYASALVEATKFCAPIYECAWVSSTGIVKKGLEWFEKNAGTIKSWDESYTELKVEVPKIEQLANYQQAALKWRKDIGFRVNANTAALSHKVLAEYKVPGEIVMSVKEMLSDMIRRRNLILNRGGDENPRGPVSREHVEWCREFVKGKYIMAFNPPWGDINKSGRSGIALVATGLAKLAETEGKGVFDEAKKTVEALNGYLDKHKDEVDKASADNMITNLLKHIAKAQELYKNSSALRAQGAQIDTAFSSYYWLYKAGVTPETFPTVSQFLFELGKQPRGTKKMKKALLSTPMKWGKKLYELFADDSFQQNRIYMHPAVLTAGRISEMGVCFGTIPVANPDDAAQGSGHTKSILNLRTNTETNNPCAKTIVKLFEIQKTGFNIQDMDIVASEHLLHQSLVGKQSPFQNAYNVKGNATSANII

SEQ ID NO: 673 - protein, 482 aa, Artificial Sequence
  derived and/or modified protein sequence (wt) from CCHFV(UG3010)__DQ211650.1__N
MENKIEVTSKDEMNRWFEEFKKSNGLVDTFTNSYSFCESVPNLDRFVFQMASATDDAQKDSIYASALVEATKFCAPIYECAWVSSTGIVKKGLEWFEKNAGTIKSWDESYTELKVGVPKIEQLANYQQAALKWRKDIGFRVNANTAALSNKVLAEYKVPGEIVMSVKEMLSDMIRRRNLILNRGGDENPRGPVSREHVEWCREFVKGKYIMAFNPPWGDINKSGRSGIALVATGLAKLAETEGKGVFDEAKKTVEDLNGYLDKHKDEVDKASADGMVTNLLKHIAKAQELYKNSSALRAQGAQIDTPFSSFYWLYKAGVSPETFPTVSQFLFELGKQPRGTKKMKKALLSTPMKWGKKLYELFADDSFQENRIYMHPAVLTAGRISEMGVCFGTIPVANPDDAAQGSGHTKSILNLRTNTETNNPCAKTIVKLFEIQKTGFNIQDMDIVASEHLLHQSLVGKQSPFQNAYNVKGNATSANII

SEQ ID NO: 674 - protein, 482 aa, Artificial Sequence
  derived and/or modified protein sequence (wt) from CCHFV(UGANDA 3010)__U88416.1__N
MENKIEVTSKDEMNRWFEEFKKSNGLVDTFTNSYSFCESVPNLDRFVFQMASATDDAQKDSIYASALVEATKFCAPIYECAWVSSTGIVKKGLEWFEKNAGTIKSWDESYTELKVGVPKIEQLANYQQAALKWRKDIGFRVNANTAALSNKVLAEYKVPGEIVMSVKEMLSDMIRRRNLILNRGGDENPRGPVSREHVEWCREFVKGKYIMAFNPPWGDINKSGRSGIALVATGLAKLAETEGKGVFDEAKKTVEDLNGYLDKHKDEVDKASADGMVTNLLKHIAKAQELYKNSSALLLQGAQIDTPFSSFYWLYKAGVSPETFPTVSQFLFELGKQPRGTKKMKKALLSTPMKWGKKLYELFADDSFQENRIYMHPAVLTAGRISEMGVCFGTIPVANPDDAAQGSGHTKSILNLGTNTETNNPCAKTIVKLFEIQKTGFNIQDMDIVASEHLLHQSLVGKQSPFQNAYNVKGNATSANII

SEQ ID NO: 675 - protein, 482 aa, Artificial Sequence
  derived and/or modified protein sequence (wt) from CCHFV(UK ex Bulgaria)__KM201260.1__N
MENKIEVNSKDEMNKWFEEFKKGNGLMDTFTNSYSFCENVPNLDKFVFQMASATDDAQKDSIYASALVEATRFCAPIYECAWVSSTGIVKKGLEWFEKNSGTIKSWDENYAELKVDVPKIEQLANYQQAALKWRKDIGFRVNANTAALSNKVLAEYKVPGEIVMSVKEMLSDMIRRRNLILNRGGDENPRGPVSREHVEWCREFVKGKYIMAFNPPWGDINKSGRSGIALVATGLAKLAETEGKGVFDEAKKTVEALNGYLDKHRDEVDKASADSMITNLLKHIAKAQELYKNSSALRAQGAQIDTPFSSFYWLYKAGVTPETFPTISQFLFELGKQPRGTKKMKKALLSTPMKWGKKLYELFADDSFQQNRIYMHPAVLTAGRISEMGVCFGTIPVANPDDAAQGSGHTKSILNLRTSTETNNPCAKTIVKLFEIQKTGFNIQDMDIVASEHLLHQSLVGKQSPFQNAYNVKGNATSANII

SEQ ID NO: 676 - protein, 482 aa, Artificial Sequence
  derived and/or modified protein sequence (wt) from CCHFV(Yozgat19-2012)__KR092375.1__N
MENKIEVNSKDEMNKWFEEFKKGNGLMDTFTNSYSFCENVPNLDKFVFQMASATDDAQKDSIYASALVEATKFCAPIYECAWVSSTGIVKKGLEWFEKNSGTIKSWDENYAELKVDVPKIEQLANYQQAALKWRKDIGFRVNANTAALSNKVLAEYKVPGEIVMSVKEMLSDMIRRRNLILNRSGDENPRGPVSREHVEWCREFVKGKYIMAFNPPWGDINKSGRSGIALVATGLAKLAETEGKGVFDEAKKTVEALNGYLDKHRDEVDKASADSMITNLLKHIAKAQELYKNSSALRAQGAQIDTPFSSFYWLYKAGVTPETFPTISQFLFELGKQPRGTKKMKKALLSTPMKWGKKLYELFADDSFQQNRIYMHPAVLTAGRISEMGVCFGTIPVANPDDAAQGSGHTKSILNLRTSTETNNPCAKTIVKLFEIQKTGFNIQDMDIVASEHLLHQSLVGKQSPFQNAYHVKGNATSANII

SEQ ID NO: 677 - protein, 482 aa, Artificial Sequence
  derived and/or modified protein sequence (wt) from CCHFV(Yozgat207-2011)__KR092377.1__N
MENKIEVNSKDEMNKWFEEFKKGNGLMDTFTNSYSFCENVPNLDKFVFQMASATDDAQKDSIYASALVEATKFCAPIYECAWVSSTGIVKKGLEWFEKNSGTIKSWDENYAELKVDVPKIEQLANYQQAALKWRKDIGFRVNANTAALSNKVLAEYKVPGEIVMSVKEMLSDMIRRRNLILNRGGDENPRGPVSREHVEWCREFVKGKYIMAFNPPWGDINKSGRSGIALVATGLAKLAETEGKGVFDEAKKTVEALNGYLDKHRDEVDKASADSMITNLLKHIAKAQELYKNSSALRAQGAQIDTPFSSFYWLYKAGVTPETFPTISQFLFELGKQPRGTKKMKKALLSTPMKWGKKLYELFADDSFQQNRIYMHPAVLTAGRISEMGVCFGTIPVANPDDAAQGSGHTKSILNLRTSTETNNPCAKTIVKLFEIQETGFNIQDMDIVASEHLLHQSLVGKQSPFQNAYNVKGNATSANII

SEQ ID NO: 678 - protein, 483 aa, Artificial Sequence
  derived and/or modified protein sequence (wt) from DUGV(ArD44313)__AF434161.1__N
MENQIKANNKKEFDEWFKPFSEKLQLRSNLTNSASLCDRVPDLALAEMKMALATDDKEKDSIFSNALVEATRFCAPIYECAWTCSTGVVQKSLSWFDKNKDFIKLWDAKYMDLKKGIPEPEQLVSYQQAAQKWRKDVGYEINQFTRSLTHPVVAEYKVPGEIAVDVKEMLSDMIRRRNVLLNGDGENAGKKGPISREHVSWGRELAGGKFQVVFNPPWGDINKCGKSGIPLAATAMVKVAELDGSKKLEDIRQALLDLKKWVEDNKDALEDGKGNELVQTMTKHLAQAVELSKKSNALRAQGAQIDTPFSAYYWAWSAGVKPETFFTLSQFLFEMGQSARGGKKMIKALTSTPLRWGKGLINLFADDDFLGNRLYMHPAVLTPGRMSEMGACFGVIPVASPEDAILGSGHSKNILNFKIDTSVQNPCASTIVQLYRIQKSGFDLESLEVVSTEHLLHQSFVGKRCPTQNAYKVRGNATNVNII

SEQ ID NO: 679 - protein, 483 aa, Artificial Sequence
  derived and/or modified protein sequence (wt) from DUGV(ArD16095)__AF434162.1__N
MENQIKANNKKEFDEWFKPFSEKLQLRSNLTNSASLCDRVPDLALAEMKMALATDDKEKDSIFSNALVEATRFCAPIYECAWTCSTGVVQKSLSWFDKNKDFIKLWDSKYMDLRKGIPEPEQLVSYQQAAQKWRKDVGYEINQFTRSLTHPVVAEYKVPGEIAVDVKEMLSDMIRRRNVLLNGDGENAGKKGPISREHVSWGRELAGGKFQVVFNPPWGDINKCGKSGIPLAATAMVKVAELDGSKKLEDIRQALLDLKKWVEDNKDALEDGKGNELVQTMTKHLAQAVELSKKSNALRAQGAQIDTPFSAYYWAWSAGVKPETFFTLSQFLFEMGQSARGGKKMIKALTSTPLRWGKGLINLFADDDFSGNRLYMHPAVLTPGRMSEMGACFGVIPVASPEDAILGSGHSKNILNFKIDTSVQNPCASTIVQLYRIQKSGFDLESLEVVSTEHLLHQSFVGKRCPTQNAYKVRGNATNVNII

SEQ ID NO: 680 - protein, 483 aa, Artificial Sequence
  derived and/or modified protein sequence (wt) from DUGV(IbH11480)__AF434163.1__N
MENQIKANNKKEFDEWFKPFSEKLQLRSNLTNSASLCDRVPDLALAEMKMALATDDKEKDSIFSNALVEATRFCAPIYECAWTCSTGVVQKSLSWFDKNKDFIKLWDAKYMDLRKGIPEPEQLVSYQQAAQKWRKDVGYEINQFTRSLTHPVVAEYKVPGEIAVDVKEMLSDMIRRRNVLLNGDGENAGKKGPISREHVSWGRELAGGKFQVVFNPPWGDINKCGKSGIPLAATAMVKVAELDGSKKLEDIRQALLDLKKWVEDNKDALEDGKGNELVQTMTKHLAQAVELSKKSNALRAQGAQIDTPFSAFYWAWSAGVKPETFFTLSQFLFEMGQSARGGKKMIKALTSTPLRWGKGLINLFADDDFLGNRLYMHPAVLTPGRMSEMGACFGVIPVASPEDAILGSGHSKNILNFKIDTSVQNPCASTIVQLYRIQKSGFDLESLEVVSTEHLLHQSFVGKRCPTQNAYKVRGNATNVNII

SEQ ID NO: 681 - protein, 483 aa, Artificial Sequence
  derived and/or modified protein sequence (wt) from DUGV(IbAr1792)__AF434164.1__N
MENQIKANNKKEFDEWFKPFSEKLQLRSNLTNSASLCDRVPDLALAEMKMALATDDKEKDSIFSNALVEATRFCAPIYECAWTCSTGVVQKSLSWFDKNKDFIKLWDAKYMDLRKGIPEPEQLVSYQQAAQKWRKDVGYEINQFTRSLTHPVVAEYKVPGEIAVDVKEMLSDMIRRRNVLLNGDGENAGKKGPISREHVSWGRELAGGKFQVVFNPPWGDINKCGKSGIPLAATAMVKVAELDGSKKLEDIRQALLDLKKWVEDNKDALEDGKGNELVQTMTKHLAQAVELSKKSNALRAQGAQIDTPFSAYYWAWSAGVKPETFFTLSQFLFEMGQSARGGKKMIKALTSTPLRWGKGLINLFADDDFLGNRLYMHPAVLTPGRMSEMGACFGVIPVASPEDAILGSGHSKNILNFKIDTSVQNPCASTIVQLYRIQKSGFDLESLEVVSTEHLLHQSFVGKRCPTQNAYKVRGNATNVNII

SEQ ID NO: 682 - protein, 483 aa, Artificial Sequence
  derived and/or modified protein sequence (wt) from DUGV(KT281/75)__AF434165.1__N
MENQIKANTKKEFDEWFKPFSDKLQLRSTLTNSASLCDRVPDLALAEMKMALATDDKEKDSIFSNALVEATRFCAPIYECAWTCSTGVVQKSLSWFDKNKDFIKLWDAKYMDLRKGIPEPEQLVSYQQAAQKWRKDIGYEINQFTRSLTHPVVAEYKVPGEIAVDVKEMLSDMIRRRNVLLNGDGENAGKKGPISREHVSWGRELAGGKFQVVFNPPWGDINKCGKSGIPLAATAMVKVAELDGSKKLEDIRQALLDLKKWIEDNKDALEDGKGNELIQTMTKHLAQAVELSKKSNALRAQGAQIDTPFSAFYWAWSAGVKPETFFTLSQFLFEMGQSARGGKKMIKALTSTPLRWGKGLINLFADDDFSGNRLYMHPAVLTPGRMSEMGACFGVIPVASPEDAILGSGHSKNILNFKIDTSVQNPCASTIVQLYRIQKSGFDLESLEVVSTEHLLHQSFVGKRCPTQNAYKVRGNATNVNII

SEQ ID NO: 683 - protein, 483 aa, Artificial Sequence
  derived and/or modified protein sequence (wt) from DUGV(NJT130)__FJ422213.2__N
MENQIKANNKKEFDEWFKPFSDKLQLRSTLTNSASLCDKVPDLALAEMKMALATDDKEKDSIFSNALVEATRFCAPIYECAWTCSTGVVQKSLSWFDKNKDFIKLWDAKYMDLRKGIPEPEQLVSYQQAAQKWRKDIGYEINQFTRSLTHPVVAEYKVPGEIAVDVKEMLSDMIRRRNVLLNGDGENAGKKGPISREHVSWGRELAEGKFQVVFNPPWGDINKCGKSGIPLAATAMVKVAELDGSKKLEDIRQALLDLKKWVEDNKDALEDGKGNELIQTMTKHLAQAVELSKKSNALRAQGAQIDTPFSAFYWAWSAGVKPETFFTLSQFLFEMGQSARGGKKMIKALTSTPLRWGKGLINLFADDDFSGNRLYMHPAVLTPGRMSEMGACFGVIPVASPEDAILGSGHSKNILNFKIDTSVQNPCASTIVQLYRIQKSGFDLESLEVVSTEHLLHQSFVGKRCPTQNAYKVRGNATNVNII

SEQ ID NO: 684 - protein, 483 aa, Artificial Sequence
  derived and/or modified protein sequence (wt) from DUGV(IbAr1792)__KU925457.1__N
MENQIKANNKKEFDEWFKPFSEKLQLRSNLTNSASLCDRVPDLALAEMKMALATDDKEKDSIFSNALVEATRFCAPIYECAWTCSTGVVQKSLSWFDKNKDFIKLWDAKYMDLRKGIPEPEQLVSYQQAAQKWRKDVGYEINQFTRSLTHPVVAEYKVPGEIAVDVKEMLSDMIRRRNVLLNGDGENAGKKGPISREHVSWGRELAGGKFQVVFNPPWGDINKCGKSGIPLAATAMVKVAELDGSKKLEDIRQALLDLKKWVEDNKDALEDGKGNELVQTMTKHLAQAVELSKKSNALRAQGAQIDTPFSAFYWAWSAGVKPETFFTLSQFLFEMGQNARGGKKMIKALTSTPLRWGKGLINLFADDDFLGNRLYMHPAVLTPGRMSEMGACFGVIPVASPEDAILGSGHSKNILNFKIDTSVQNPCASTIVQLYRIQKSGFDLESLEVVSTEHLLHQSFVGKRCPTQNAYKVRGNATNVNII

SEQ ID NO: 685 - protein, 482 aa, Artificial Sequence
  derived and/or modified protein sequence (wt) from NSDV(Jilin)__NC_034386.1__N
MQNQIVADNKDAILAWHKTYSEKHRLKSVLTNSASFCETIPDLSGYEVSMRLVSSESEKDSVYASALVAATKFCAPILECAWTSCTGMVERGLDWFENNKETVKIWDAEYGKLRTEAPSPEQLLGYQRAALKWRKDTKYGINRNTAALAAAIATEYRVPGSIVVNVKDMLSDMIRRRNKILNRDGSEDVPKRGPVSKEHIDWARDLAQGKFLVVFNPPWGDINKAGKSGIALAATGMAKLIELDGPKIAEDLRESLKGLVAWINAHKDEVENGKEVVDGLTKHLQKALELAKQSSAMRAQGAQIDTVFSSYYWLWKAGVTAEMFPTVSQFLFELGKVPRGNKKMKKALSSMPLKWGKKLLALFADDSFTANRIYMHPGVLTAGRMSELGVCFGAIPVANPDDAAEGSGHIKNILAQTTDTQAGNPCAQNIVALFNIQKAGFDIESMDIVALEHLLHQSLVGKRSPFQNAYNIRGNATSIQII

SEQ ID NO: 686 - protein, 482 aa, Artificial Sequence
  derived and/or modified protein sequence (wt) from NSDV(62873)__HQ286609.1__N
MQNQIVADNKDAILAWHKTYSEKHKLKSVLTNSASFCETIPDLSGYEVSMRLVSSESEKDSVYASALVAATKFCAPILECAWTSCTGMIQRGLDWFENNGEMVKIWDADYGKLRTEIPSPEQLLGYQRAALKWRKDTKYGINKNTAALAAAIATEYRVPGSIVVNVKDMLSDMIRRRNKILNRDGSEDVPKRGPVSKEHIDWARDLAQGKFLVVFNPPWGDINKAGKSGIALAATGMAKLIELDGPKVAEDLKESLKSLVAWINAHKDEVENGKEVVDGLTKHLQKALELAKQSSAMRAQGAQIDTVFSSYYWLWKAGVTAEMFPTVSQFLFELGKVPRGNKKMKKALSSMPLKWGKKLLALFADDSFTANRIYMHPGVLTAGRMSELGVCFGAIPVANPDDAAEGSGHIKNILNYKTDTQAGNPCAQNIVALFNIQKAGFDIESMDIVASEHLLHQSLVGKRSPFQNAYNIRGNATSIQII

SEQ ID NO: 687 - protein, 482 aa, Artificial Sequence
  derived and/or modified protein sequence (wt) from NSDV(779)__HQ286602.1__N
MQNQIVADNKDAILAWHKTYSEKHKLKSVLTNSASFCETIPDLSGYEVSMRLVSSESEKDSVYASALVAATKFCAPILECAWTSCTGMIQRGLDWFDNNGEMVKIWDADYGKLRTEVPSPEQLLGYQRAALKWRKDTKYGINKNTAALAAAIATEYRVPGSIVVNVKDMLSDMIRRRNKILNRDGSEDVPKRGPVSKEHIDWARDLAQGKFLVVFNPPWGDINKAGKSGIALAATGMAKLIELDGPKVAEDLKESLKSLVAWINAHKDEVENGKEVVDGLTKHLQKALELAKQSSAMRAQGAQIDTVFSSYYWLWKAGVTAEMFPTVSQFLFELGKVPRGNKKMKKALSSMPLKWGKKLLALFADDSFTANRIYMHPGVLTAGRMSELGVCFGAIPVANPDDAAEGSGHIKNILNYKTDTQAGNPCAQNIVALFNIQKAGFDIESMDIVASEHLLHQSLVGKRSPFQNAYNIRGNATSIQII

SEQ ID NO: 688 - protein, 482 aa, Artificial Sequence
  derived and/or modified protein sequence (wt) from NSDV(6233)__HQ286603.1__N
MQNQIVADNKDAILAWHKTYSEKHKLKSVLTNSASFCETIPDLSGYEVSMRLVSSESEKDSVYASALVAATKFCAPILECAWTSCTGMIQRGLDWFDNNGEMVKIWDADYGKLRTEVPSPEQLLGYQRAALKWRKDTKYGINKNTAALAAAIATEYRVPGSIVVNVKDMLSDMIRRRNKILNRDGSEDVPKRGPVSKEHIDWARDLAQGKFLVVFNPPWGDINKAGKSGIALAATGMAKLIELDGPKVAEDLKESLKSLVAWINAHKDEVENGKDVVDGLTKHLQKALELAKQSSAMRAQGAQIDTVFSSYYWLWKAGVTAEMFPTVSQFLFELGKVPRGNKKMKKALSSMPLKWGKKLLALFADDSFTANRIYMHPGVLTAGRMSELGVCFGAIPVANPDDAAEGSGHIKNILNYKTDTQAGNPCAQNIVALFNIQKAGFDIESMDIVASEHLLHQSLVGKRSPFQNAYNIRGNATSIQII

SEQ ID NO: 689 - protein, 482 aa, Artificial Sequence
  derived and/or modified protein sequence (wt) from NSDV(40350)__HQ286608.1__N
MQNQIVADSKDAILAWHKTYSEKHKLKSVLTNSASFCETIPDLSGYEVSMRLVSSDSEKDSVYASALVAATKFCAPILECAWTSCTGMIQRGLDWFENNGEMVKIWDADYGKLRTEVPSPEQLLGYQRAALKWRKDTKYGINKNTAALAAAIATEYRVPGSIVVNVKDMLSDMIRRRNKILNRDGSEDVPKRGPVSKEHIDWARDLAQGKFLVVFNPPWGDINKAGKSGIALAATGMAKLIELDGPKIAEDLKESLKSLVAWINAHKDEVENGKEVVDGLTKHLQKALELAKQSSAMRAQGAQIDTVFSSYYWLWKAGVTAEMFPTVSQFLFELGKVPRGNKKMKKALSSMPLKWGKKLLALFADDSFTANRIYMHPGVLTAGRMSELGVCFGAIPVANPDDAAEGSGHIKNILNYKTDTQAGNPCAQNIVALFNIQKAGFDIESMDIVASEHLLHQSLVGKRSPFQNAYNIRGNATSIQII

SEQ ID NO: 690 - protein, 482 aa, Artificial Sequence
  derived and/or modified protein sequence (wt) from NSDV(616287)__HQ286605.1__N
MQNQIVADNKDAILAWHKTYSEKHKLKSVLTNSASFCETIPDLSGYEVSMRLVSSESEKDSVYASALVAATKFCAPILECAWTSCTGMIQRGLDWFDNNGEMVKIWDADYGKLRTEVPSPEQLLGYQRAALKWRKDTKYGINKNTAALAAAIATEYRVPGSIVVNVKDMLSDMIRRRNKILNRDGSEDVPKKGPVSKEHVDWARDLAQGKFLVVFNPPWGDINKAGKSGIALAATGMAKLIELDGPKVAEDLKESLKSLVAWINAHKDEVENGKEVVDGLTKHLQKALELAKQSSAMRAQGAQIDTVFSSYYWLWKAGVTAEMFPTVSQFLFELGKVPRGNKKMKKALSSMPLKWGKKLLALFADDSFTANRIYMHPGVLTAGRMSELGVCFGAIPVANPDDAAEGSGHIKNILNYKTDTQAGNPCAQNIVALFNIQKAGFDIESMDIVASEHLLHQSLVGKRSPFQNAYNIRGNATSIQII

SEQ ID NO: 691 - protein, 482 aa, Artificial Sequence
  derived and/or modified protein sequence (wt) from NSDV(615526)__HQ286606.1__N
MQNQIVADNKDAILAWHKAYSEKHKLKSVLTNSASFCETIPDLSGYEVSMRLVSSESEKDSVYASALVAATKFCAPILECAWTSCTGMIQRGLDWFDSNGEMVKIWDADYGKLRTEVPSPEQLLGYQRAALKWRKDTKYGINKNTAALAAAIATEYRVPGSIVVNVKDMLSDMIRRRNKILNRDGSEDVPKGGPVSKEHIDWARDLAQGKFLVVFNPPWGDINKAGKSGIALAATGMAKLIELDGPKIAEDLKESLKSLVAWINAHKDEVENGKEVVDGLTKHLQKALELAKQSSAMRAQGAQIDTVFSSYYWLWKAGVTAEMFPTVSQFLFELGKVPRGNKKMKKALSSMPLKWGKKLLALFADDSFTANRIYMHPGVLTAGRMSELGVCFGAIPVANPDDAAEGSGHIKNILNYKTDTQAGNPCAQNIVALFNIQKAGFDIESMDIVASEHLLHQSLVGKRSPFQNAYNIRGNATSIQII

SEQ ID NO: 692 - protein, 482 aa, Artificial Sequence
  derived and/or modified protein sequence (wt) from NSDV(708)__AF504293.1__N
MQNQIVADNKDAILAWHKAYSEKHKLKSVLTNSASFCEAIPDLSGYEVSMRLVSSDSEKDSVYASALVAATKFCAPILECAWTSCTGMVERGLDWFENNREMVKIWDTEYGKLRTEVPSPEQLLGYQRAALKWRKDTKYGINKNTAALAAAIATEYKVPGSLVVNVKDMLSDMIRRRNKILNRDGSEDVPKRGPVSKEHIDWARDLAQGKFLVVFNPPWGDINKAGKSGIALAATGMAKLIELDGPKIAEDLKESLKSLVAWINAHKDEVENGKEVVDSLTKYLQKALELAKQSSAMRAQGAQIDTVFSSYYWLWKAGVTAEMFPTVSQFLFELGKVPRGNKKMKKALSSMPLKWGKKLLALFADDSFTANRIYMHPGVLTAGRMSELGVCFGAIPVANPDDAADGSGHIKSILNYKTDTQAGNPCAQNIVALFNIQKAGFDIESMDIVASEHLLHQSLVGKRSPFQNAYNIRGNATSIQII

SEQ ID NO: 693 - protein, 233 aa, Artificial Sequence
  derived and/or modified protein sequence (wt) from BUNV__NC_001927.1__N
MIELEFHDVAANTSSTFDPEVAYANFKRVHTTGLSYDHIRIFYIKGREIKTSLAKRSEWEVTLNLGGWKITVYNTNFPGNRNNPVPDDGLTLHRLSGFLARYLLEKMLKVSEPEKLIIKSKIINPLAEKNGITWNDGEEVYLSFFPGSEMFLGTFRFYPLAIGIYKVQRKEMEPKYLEKTMRQRYMGLEAATWTVSKLTEVQSALTVVSSLGWKKTNVSAAARDFLAKFGINM

SEQ ID NO: 694 - protein, 233 aa, Artificial Sequence
  derived and/or modified protein sequence (wt) from BUNV(SFCrEq231)__KP063894.1__N
MIELEFNDVAANTSSTFDPEVAYINFKRIYTTGLSYDHIRIFYIKGREIKTSLTKRSEWEVTLNLGGWKVTVFNTNFPGNRNSPVPDDGLTLHRLSGFLARYLLEKILKVSEPEKLIIKSKIINPLAEKNGITWSDGEEVYLSFFPGSEMFLGTFKFYPLAIGIYKVQRKEMEPKYLEKTMRQRYMGLEASTWTVSKVNEVQSALTVVSGLGWKKTNVSAAAREFLAKFGINM

SEQ ID NO: 695 - protein, 233 aa, Artificial Sequence
  derived and/or modified protein sequence (wt) from BUNV(AMH001130)__JF961342.1__N
MIELEFHDVAANTSSTFDPEVAYANFKRVHTTGLSYDHIRIFYIKGREVKTSLAKRSEWEVTLNLGGWKITVYNTNFPGNRNNPVPDDGLTLHRLSGFLARYLLEKMLKVSEPEKLIIKSKIINPLAEKNGITWNDGEEVYLSFFPGSEMFLGTFRFYPLAIGIYKVQRKEMEPKYLEKTMRQRYMGLEAATWTVSKLTEVQSALTVVSSLGWKKTNVSAAARDFLAKFGINM

SEQ ID NO: 696 - protein, 233 aa, Artificial Sequence
  derived and/or modified protein sequence (wt) from BUNV(ArB29051)__AM709778.1__N
MIELEFHDVAANTSSTFDPEVAYANFKRVHTTGLSYDHIRIFYIKGREIKTSLAKRSEWEVTLNLGGWKITVYNTNFPGNRNNPVPDDGLTLHRLSGFLARYLLEKMLKLSEPEKLIIKSKIINPLAEKNGITWNDGEEVYLSFFPGSEMFLGTFRFYPLAIGIYKVQRKEMEPKYLEKTMRQRYMGLEAATWTVSKLTEVQSALTVVSSLGWKKTNVSAAARDFLAKFGINM

SEQ ID NO: 697 - protein, 233 aa, Artificial Sequence
  derived and/or modified protein sequence (wt) from BUNV(ArB28215)__AM711130.1__N
MIELEFNDVAVNTSSSFDPEAAYANFKRVHTTGLSYDHIRIFYIKGREIKVSLSKRSEWEVTINLGGWKIAVYNTNFPGNRNSPVPDDGLTLHRLSGFLARFLLEKMLKMSEPEKLIIKAKIINPLAEKNRITWNDGEEVYLSFFPGSEMFLGTFKFYPLAIGIYKVQRKEMEPKYFEKTMRQRYMGLEASSWTVSKLTDVQSALTVVSGLGWKKTNVSAAARDFLAKFGINM

SEQ ID NO: 698 - protein, 233 aa, Artificial Sequence
  derived and/or modified protein sequence (wt) from BUNV(Peurto Almendras)__AJ697960.1__N
MSEIAFDDIGQIAASTFNPDNQYIGFKKVFTIGLTYDQIRIFFLNGKKAKETLSKRSEETVTLNFGGWRIPIVNTHFPGNRNIDLADDALTLHRVSGYLARYLLEKVLSAQEPEKVIIKTRIINPIAASNGITWDDGYEVYLSFFPGSECFLEAFKFYPLAIGIYKVQKGMMDVKFLEKTMRQKYAGLDATVWTQQKYTDVINALLVVNGLGWKKSNVSAAAKDFLSKFGIQI

SEQ ID NO: 699 - protein, 233 aa, Artificial Sequence
  derived and/or modified protein sequence (wt) from BUNV__AF325122.1__N
MIELEFNDVAANTSSTFDPEVAYINFKRLYTTGLSYDHIRIFYIKGREIKTSLAKRSEWEVTLNLGGWKVTVFNTNFPGNRNSPVPDDGLTLHRLSGYLARYLLEKILKVSDPEKLIIKSKIINPLAEKNGITWSDGEEVYLSFFPGSEMFLGTFRFYPLAIGIYKVQRKEMEPKYLEKTMRQRYMGLEASTWTVSKLNEVQSALTVVSGLGWKKTNVSSAAREFLAKFGISM

SEQ ID NO: 700 - protein, 233 aa, Artificial Sequence
  derived and/or modified protein sequence (wt) from Ab-BUNV(Cu20-XJ)__KJ710424.1__N
MLELEFEDVPTNIGSTFDPESGYINFQRNYLPGVTLDQIRIFYIKGREIKNSLAKRSEWEVTLNLGGWKVPVLNTNFPGNRSNAVPDYGLTFHRISGYLARYLLGKYLAETEPEKLIMRTKIINPLAEKNGITWESGPEVYLSFFPGAEMFLGTFKFYPLAIGIYKVQRKEMDPKFLEKTMRQRYLGLDAQTWTTTKLDEVERALKVVSGLGWKKTNVSNAAREFLSKFGIRM

SEQ ID NO: 701 - protein, 233 aa, Artificial Sequence
  derived and/or modified protein sequence (wt) from ANADV(2513 Irkutsk)__KT313716.1__N
MIELEFNDVAANTSSTFDPEVAYINFKRIYTTGLSYDHIRIFYIKGREIKTSLAKRSEWEVTLNLGGWKVTVFNTNFPGNRNSPVPDDGLTLHRLSGFLARYLLEKILKVSDPEKLIIKSKIINPLAEKNGITWADGEEVYLSFFPGSEMFLGTFRFYPLAIGIYKVQRKEMEPKYLEKTMRQRYMGLEASTWTVSKLNEVQSALTVVSGLGWKKTNVSSAAREFLARFGINM

SEQ ID NO: 702 - protein, 233 aa, Artificial Sequence
  derived and/or modified protein sequence (wt) from ANADV(EIV-23263Tyum)__KT313761.1__N
MIELEFNDVAANTSSTFDPEVAYINFKRIYTTGLSYDHIRIFYIKGREIKTSLAKRSEWEVTLNLGGWKITVFNTNFPGNRNSPVPDDGLTLHRLSGFLARYLLEKILKVSDPEKLIIKSKIINPLAEKNGITWADGEEVYLSFFPGSEMFLGTFRFYPLAIGIYKVQRKEMEPKYLEKTMRQRYMGLEASTWTVSKLNEVQSALTVVSGLGWKKTNVSSAAREFLARFGINM

SEQ ID NO: 703 - protein, 233 aa, Artificial Sequence
  derived and/or modified protein sequence (wt) from BATV__X73464.1__N
MIELEFNDVAANTSSTFDPEVAYINFKRIYTTGLSYDNIRIFYIKGREIKTSLSKRSEWEVTLNLGGWKVTVFNTNFPGNRNSPVPDDGLTLHRLSGFLARYLLEKILKVSDPEKLIIKSKIVNPLAEKNGITWADGEEVYLSFFPGSEMFLGTFRFYPLAIGIYKVQRKEMEPKYLEKTMRQRYMGLEASTWTVSKLNEVQSALTVVSGLGWKKTNVSSAAREFLAKFGISM

SEQ ID NO: 704 - protein, 233 aa, Artificial Sequence
  derived and/or modified protein sequence (wt) from BATV(668)__KT313687.1__N
MIELEFNDVAANTSSTFDPEVAYLNFKRIYTTGLSYDNIRIFYIKGREIKVSLAKRSEWEVTLNLGGWKVTVFNTNFPGNRNSPVPDDGLTLHRLSGFLARYLLEKILKVSDPEKLIIKSKIINPLAEKNGITWSDGEEVYLSFFPGSEMFLGTFRFYPLAIGIYKVQRKEMEPKYLEKTMRQRYMGLEASTWTVSKLNEVQSALTVVSGLGWKKTNVSSAAREFLAKFGINM

SEQ ID NO: 705 - protein, 233 aa, Artificial Sequence
  derived and/or modified protein sequence (wt) from BATV(804922)__FJ436805.1__N
MIELEFNDVAANTSSTFDPEVAYINFKRIYTTGLSYDNIRIFYIKGREIKTSLAKRSEWEVTLNLGGWKVTVFNTNFPGNRNSPVPDDGLTLHRLSGFLARYLLEKILKVSDPEKLIIKSKIVNPLAEKNGITWADGEEVYLSFFPGSEMFLGTFRFYPLAIGIYKVQRKEMEPKYLEKTMRQRYMGLEASTWTVSKLNEVQSALTVVSGLGWKKTNVSSAAREFLAKFGISM

SEQ ID NO: 706 - protein, 233 aa, Artificial Sequence
  derived and/or modified protein sequence (wt) from BATV(8627-11)__FJ436802.1__N
MIELEFNDVAANTSSTFDPEVAYINFKRIYTTGLSYDNIRIFYIKGREIKTSLAKRSEWEVTLNLGGWKVTVFNTNFPGNRNSPVPDDGLTLHRLSGFLARYLLEKILKVSDPEKLIIKSKIVNPLAEKNGITWADGEEVYLSFFPGSEMFLGTFRFYPLAIGIYKVQRKEMEPKYLEKTMRHRYMGLEASTWTVSKLNEVQSALTVVSGLGWKKTNVSSAAREFLAKFGISM

SEQ ID NO: 707 - protein, 233 aa, Artificial Sequence
  derived and/or modified protein sequence (wt) from BATV(G-20217)__FJ436806.1__N
MIELEFNDVAANTSSTFDPEVAYINFKRIYTTGLSYDNIRIFYIKGREIKTSLAKRSEWEVTLNLGGWKVTVFNTNFPGNRNSPVPDDGLTLHRLSGFLARYLLEKILKVSDPEKLIIKSKIVNPLAEKNGITWADGEEVYLSFFPGSEMFLGTFRFYPLSIGIYKVQRKEMEPKYLEKTMRQRYMGLEASTWTVSKLNEVQSALTVVSGLGWKKTNVSSAAREFLAKFGISM

SEQ ID NO: 708 - protein, 233 aa, Artificial Sequence
  derived and/or modified protein sequence (wt) from BATV(MS50)__JX846604.1__N
MIELEFNDVAANTSSTFDPEVAYANFKRVHTTGLSYDHVRIFYIKGREIKTSLSKRSEWEVTLNLGGWKIAVYNTNFPSNRNNPVPDDGLTLHRLSGYLARYLFEKIVKVSEPEKLLIKSKIINPLAEKNGITWADGEEIYLSFFPGSEMFLGTFKFYPLAIGIYKVQRKEMEPKYLEKTMRQRYMGLEAGTWTVSKVNEVQAAVNVVSTLGWKKTNVSAAAREFLAKFGIAM

SEQ ID NO: 709 - protein, 233 aa, Artificial Sequence
  derived and/or modified protein sequence (wt) from BATV(ON-1/E/94)__AB257761.1__N
MIELEFNDVAANTSSTFDPEVAYINFKRVYTTGLSYDNIRIFYIKGREIKTSLAKRSEWEVTLNLGGWKVTVFNTNFPGNRNSPVPDDGLTLHRLSGFLARYLLEKILKVSDPEKLIIKSKIVNPLAEKNGITWADGEEVYLSFFPGSEMFLGTFRFYPLAIGIYKVQRKEMEPKYLEKTMRQRYMGLEASTWTVSKLNEVQSALTVVSGLGWKKTNVSSAAREFLAKFGISM

SEQ ID NO: 710 - protein, 233 aa, Artificial Sequence
  derived and/or modified protein sequence (wt) from BATV(UgMP-6830)__JX846601.1__N
MIELEFNDVAANTSSTFDPEVAYINFKRIYTTGLSYDNIRIFYIKGREIKTSLAKRSEWEVTLNLGGWKVTVFNTNFPGNRNSPVPDDGLTLHRLSGFLARYLLEKILKVSDPEKLIIKSKIINPLAEKNGITWADGEEVYLSFFPGSEMFLGTFRFYPLAIGIYKVQRKEMEPKYLEKTMRQRYMGLEASTWTVSKLNEVQSALTVVSGLGWKKTNVSSAAREFLAKFGISM

SEQ ID NO: 711 - protein, 233 aa, Artificial Sequence
  derived and/or modified protein sequence (wt) from BIRV(ArB2198)__AM711131.1__N
MIELEFHHVAANTSSTFDPEVAYANFKRIHTNGLSYDNIRIFYIKGREIKTSLAKRSEWEVTLNLGGWKVAVYNTNFPGNRNNPVPDDGLTLHRLSGFLARYLLEKMLKVSEPEKLIIKTKIINPLAEKNGITWKDGEEVYLSFFPGSEMFLGTFKFYPLAIGIYKVQKKEMDPKYLEKTMRQRYMGLEASTWTVSKVSEVQSALTVVSSLGWKKTNVTAAARDFFAKFGINM

SEQ ID NO: 712 - protein, 233 aa, Artificial Sequence
  derived and/or modified protein sequence (wt) from BOZOV(ArB13529)__AM711132.1__N
MIELEFNDVAANTSSTFDPEAAYANFKRVHTTGLTYDHIRIFYIKGSEIKTSLAKRSEWEVTLNLGGWKITVYNTNFPGNRNNPSPDDGLTLHFFCGFLAKSLLEKMLKVSAPEKLIIKSKITSPLAEKNGITWNDGEEVYLSFFPGSEMFLGTFHFYPLPIGIYQGLRRDLEPKYFGKTLRLMYMGLEASSWTVSKLTEGQSALTVVSGLGWKKTNVSAAARDFLAKFGINM

SEQ ID NO: 713 - protein, 233 aa, Artificial Sequence
  derived and/or modified protein sequence (wt) from CVV__X73465.1__N
MIELEFNDVAANTSSTFDPEIAYVNFKRIHTTGLSYDHIRIFYIKGREIKTSLTKRSEWEVTLNLGGWKVTVFNTNFPGNRNSPVPDDGLTLHRLSGYLARYLLEKILKVSDPEKVIIKSKIINPLAEKNGITWSDGEEVYLSFFPGSEMFLGTFKFYPLAIGIYKVQRKEMEPKYLEKTMRQRYMGLEASTWTISKVNEVQAALTVVSGLGWKKTNVSAAAREFLAKFGISM

SEQ ID NO: 714 - protein, 233 aa, Artificial Sequence
  derived and/or modified protein sequence (wt) from CVV(10081)__KP835932.1__N
MIELEFNDVAANTSSTFDPEIAYVNFKRIYTTGLSYDHIRIFYIKGREIKTSLTKRSEWEVTLNLGGWKITVFNTNFPGNRNSPVPDDGLTLHRLSGYLARYLLEKILKVSDPEKVIIKSKIINPLAEKNGITWSDGEEVYLSFFPGSEMFLGTFKFYPLAIGIYKVQRKEMEPKYLEKTMRQRYMGLEASTWTISKVNEVQAALTVVSGLGWKKTNVSAAAREFLAKFGISM

SEQ ID NO: 715 - protein, 233 aa, Artificial Sequence
  derived and/or modified protein sequence (wt) from CHLV(CHLV-Mex07)__EU879062.3__N
MIELEFNDVAANTSSTFDPEIAYVNFKRIYTTGLSYDHIRIFYIKGREIKTSLTKRSEWEVTLNLGGWKVTVFNTNFPGNRNSPVPDDGLTLHRLSGYLARYLLEKILKVSDPEKVIIKSKIINPLAEKNGITWSDGEEVYLSFFPGSEMFLGTFKFYPLAIGIYKVQRKEMEPKYLEKTMRQRYMGLEASTWTVSKVNEVQAALTVVSGLGWKKTNVSAAAREFLAKFGISM

SEQ ID NO: 716 - protein, 233 aa, Artificial Sequence
  derived and/or modified protein sequence (wt) from GERV__M19420.1__N
MLELEFEDVPNNIGSTFDPESGYTNFQRNYLPGVTLDQIRIFYIKGREIKNSLSKRSEWEVTLNLGGWKVPVLNTNFPGNRNNAVPDYGLTFHRISGYLARYLLGKYLAETEPEKLIMRTKIVNPLAEKNGITWESGPEVYLSFFPGAEMFLGTFRFYPLAIGIYKVQRKEMDPKFLEKTMRQRYLGIDAQTWTTTKLGEVEAALKVVSGLGWKKTNVSSAAREFLSKFGIRM

SEQ ID NO: 717 - protein, 233 aa, Artificial Sequence
  derived and/or modified protein sequence (wt) from IACOV(BeAn314206)__JN572067.1__N
MSEIIFDDVGQITSSTFNPDVQYINFKKNHTTGLNYDQIRVFFLNGKKAKETLAKRSEESLQLNFGGWRVVVMNTHFPGNRNMLIPDEAMTLHRLSGYLARYLLERILSGPEHEKVVITSKIVNPIAASNGITWTDGPEVYLSFFPGTEMFLESFKFYPLAIGIYKVQKKMMESKYLEKAMRQKYSGMDATLWTQQKYAEVTNALAVVSNLGWKKSNVSAAARDFLAKFGIQL

SEQ ID NO: 718 - protein, 233 aa, Artificial Sequence
  derived and/or modified protein sequence (wt) from ILEV(ArB16282)__AM709780.1__N
MIELEFHDVTANTSSTFDPEVAYANFKRIHTNGLNYDHIRIFYIKGREIKTSLAKRSEWEVTLNLGGWKISVYNTKFPGNRNNPVPDDGLTLHRLSGFLARYLLEKMLKVSEPEKLIIKSKIINPLAEKNGITWYDGEEVYLSFFPGSEMCLGTQDFYPMAIEFYQVQRKEMEPKFLEKTLKQRSLGLEPSTWTISQLVKLQSALTVVSGLGWKKTNVGAAARNFLAKFGINM

SEQ ID NO: 719 - protein, 233 aa, Artificial Sequence
  derived and/or modified protein sequence (wt) from ILEV(HB80P125)__AM709779.1__N
MIELEFHDVTANTSSTFDPEVAYANFKRIHTNGLNYDHIRIFYIKGREIKTSLAKRSEWEVTLNLGGWKIAVYNTNFPGNRNNPVPDDGLTLHRLSGYLARCLLEKMLKVSEPEKQIIKSKIINPLAEKNGITWDDGEEVYLSFFPGSEMFLGTFRFYPLAIGIYKVQRKEMEPKYLEKTMRQRYMGLEASTWTISKLAEVQSALTVVSGLGWKKTNVSAAARDFLAKFGINM

SEQ ID NO: 720 - protein, 233 aa, Artificial Sequence
  derived and/or modified protein sequence (wt) from ILEV(ILESHA/8e)__KC608151.1__N
MIELEFHDVTANTSSTFDPEVAYANFKRIHTNGLNYDHIRIFYIKGREIKTSLAKRSEWEVTLNLGGWKIAVYNTNFPGNRNNPIPDDGLTLHRLSGYLARYLLEKMLKVSEPEKQIIKSKIINPLAEKNGITWDDGEEVYLSFFPGSEMFLGTFRFYPLAIGIYKVQRKEMEPKYLEKTMRQRYMGLEASTWTISKLAEVQSALTVVSGLGWKKTNVSAAARDFLAKFGINM

SEQ ID NO: 721 - protein, 233 aa, Artificial Sequence
  derived and/or modified protein sequence (wt) from ILEV(R5964)__AY729651.1__N
MIELEFHDVTANTSSTFDPEVAYANFKRIHTNGLNYDHIRIFYIKGREIKTSLAKRSEWEVTLNLGGWKIAVYNTNFPGNRNNPIPDDGLTLHRLSGYLARYLLEKMLKVSEPEKQIIKSKIINPLAEKNGITWDDGEEVYLSFFPGSEMFLGTFRFYPLAIGIYKVQRKEMEPKYLEKTMRQRYMGLEASTWTISKLAEVQSALTVVSGLGWKKTNVSAPARDFLAKFGINM

SEQ ID NO: 722 - protein, 233 aa, Artificial Sequence
  derived and/or modified protein sequence (wt) from MAGV__D13783.1__N
MIELEFNDVAANTSSTFDPEIAYVNFKRIHTTGLSYDHIRVLYIKGREIKTSLTKRSEWEVTLNLGGWKVAVFNTNFPGNRNSPVPDDGLTLHRLSGFLARYLLEKILKVSDPEKLIIKSKIINPLAEKNGITWADGEEVYLSFFPGSEMFLGTFKFYPLAIGIYKVQKKEMEPKYLEKTMRQRYMGLEAATWTVSKVNEVQAALTVVSGLGWKKTNVSAAAREFLAKFGINM

SEQ ID NO: 723 - protein, 233 aa, Artificial Sequence
  derived and/or modified protein sequence (wt) from MAGV(7272)__KX100103.1__N
MIELEFNDVAANTSSTFDPEIAYVNFKRIHTTGLSYDHIRVLYIKGREIKTSLTKRSEWEVTLNLGGWKVAVFNTNFPGNRNSPVPDDGLTLHRLSGFLARYLLEKILKVSDPEKLIIKSKIINPLAEKNGITWADGEEVYLSFFPGSEMFLGTFKFYPLAIGIYKVQRKEMEPKYLEKTMRQRYMGLEAATWTVSKVNEVQAALTVVSGLGWKKTNVSAAAREFLAKFGINM

SEQ ID NO: 724 - protein, 233 aa, Artificial Sequence
  derived and/or modified protein sequence (wt) from MAGV(3363)__KX100106.1__N
MIELEFNDVAANTSSTFDPEIAYVNFKRIYTTGLSYDHIRIFYIKGREIKTSLTKRSEWEVTLNLGGWKVTVFNTNFPGNRNSPVPDDGLTLHRLSGYLARYLLEKILKVSDPEKVIIKSKIINPLAEKNGITWSDGEEVYLSFFPGSEMFLGTFKFYPLAIGIYKVQRKEMEPKYLEKTMRQRYMGLEASTWTISKVNEVQAALTVVSGLGWKKTNVSAAAREFLAKFGISM

SEQ ID NO: 725 - protein, 233 aa, Artificial Sequence
  derived and/or modified protein sequence (wt) from NRIV(DakArY357/6e)__AY593727.1__N
MIELEFHDVTANTSSTFDPEVAYANFKRIHTNGLNYDYIRIFYIKGREIKTSLAKRSEWEVTLNLGGWKIAVYNTNFPGNRNNPIPDDGLTLHRLSGYLARYLLEKMLKVSEPEKQIIKSKIINPLAEKNGITWDDGEEVYLSFFPGSEMFLGTFRFYPLAIGIYKVQRKEMEPKYLEKTMRQRYMGLEASTWTISKLAEVQSALTVVSGLGWKKTNVSAAARDFLAKFGINM

SEQ ID NO: 726 - protein, 233 aa, Artificial Sequence
  derived and/or modified protein sequence (wt) from NORV__X73470.1__N
MIELEFNDVAANTSSTFDPEVAYINFKRVYTTGLSYDHIRIFYIKGREIKTSLTKRSEWEVTLNLGGWKVTVFNTNFPGNRNSPVPDDGLTLHRLSGFLARYLLEKILKVSEPEKLIIKSKIINPLAEKNGITWTDGEEVYLSFFPGSEMFLGTFKFYPLAIGIYKVQRKEMEPKYLEKTMRQRYMGLEASTWTISKVNEVQAALTVVSGLGWKKTNVSAAAREFLAKFGINM

SEQ ID NO: 727 - protein, 233 aa, Artificial Sequence
  derived and/or modified protein sequence (wt) from POTV(89-3380)__AY729652.1__N
MIELEFNDVAADTSSTFDPEIAYVNFKRIHTTGLSYDHIRIFYIKGREIKTSLTKRSEWEVTLNLGGWKITVFNTNFPGNRNSPVPDDGLTLHRLSGYLARYLLEKILKVSDPEKVIIKSKIINPLAEKNGITWSDGEEVYLSFFPGSEMFLGTFKFYPLAIGIYKVQRKEMEPKYLEKTMRQRYMGLEASTWTVSKVNEVQAALTVVSGLGWKKTNVSAAAREFLAKFGISM

SEQ ID NO: 728 - protein, 233 aa, Artificial Sequence
  derived and/or modified protein sequence (wt) from SHOV(4042)__EU564831.1__N
MIELEFHDVAANTSSTFDPEVAYANFKRVHTTGLSYDHIRIFYIKGREIKTSLAKRSEWEVTLNLGGWKITVYNTNFPGNRNNPVPDDGLTLHRLSGFLARYLLEKMLKVSEPEKLIIKSKIINPLAEKNGITWTDGEEVYLSFFPGAEMFLGTFKFYPLAIGIYKVQRKEMEPKYLEKTMRQRYMGLEAATWTVSKLTEVQAALTVVSGLGWKKTNVSAAARDFLAKFGISM

SEQ ID NO: 729 - protein, 233 aa, Artificial Sequence
  derived and/or modified protein sequence (wt) from TENV(TSV-FE3-66FB)__FJ943505.1__N
MIELEFNDVAANTSSTFDPEVGYVNFKRVHTTGLSYDHIRIFYIKGREIKTSLTKRSEWEVTLNLGGWKVTVFNTNFPGNRNSPVPDDGLTLHRLSGFLARYLLEKILKVSDPEKLIIKSKIINPLAEKNGITWADGEEVYLSFFPGSEMFLGTFKFYPLAIGIYKVQRKEMEPKYLEKTMRQRYMGLEAATWTISKVNEVQSALTVVSGLGWKKTNVSAAAREFLAKFGINM

SEQ ID NO: 730 - protein, 233 aa, Artificial Sequence
  derived and/or modified protein sequence (wt) from XINV(BeH388464)__EU564830.1__N
MLELEFNDVAANTSSTFDPEVGYANFKRIHTNGLSYDNIRIFYIKGREIKTSLAKRSEWEVTLNLGGWKITVYNTNFPGNRNHPIPDDGLTIHRLSGYLARYLLEKILKVSDPEKLLIKTKIINPLAEKNGITWNDGEEVYLSFFPGSEMFLGTFKFYPLAIGIYKVQRKEMEPKYLEKAMRQRYMGLESATWTVSKLNEVQSALTVVSGLGWKKTNVSAAAREFLAKFGINM

SEQ ID NO: 731 - protein, 233 aa, Artificial Sequence; identical to SEQ ID NO: 693
  derived and/or modified protein sequence (wt) from NRIV(9800535)__JX857328.1__N

SEQ ID NO: 732 - protein, 233 aa, Artificial Sequence
  derived and/or modified protein sequence (wt) from NRIV(Adrar)__KJ716848.1__N
MIELEFHDVAANTSSTFDPEVAYANFKRIYTTGLSYDHIRIFYIKGREIKTSLAKRSEWEVTLNLGGWKITVYNTNFPGNRNNPVPDDGLTLHRLSGFLARYLLEKMLKVSEPEKLIIKSKIINPLAEKNGITWNDGEEVYLSFFPGSEMFLGTFRFYPLAIGIYKVQRKEMEPKYLEKTMRQRYMGLEAATWTVSKLTEVQSALTVVSSLGWKKTNVSAAARDFLAKFGINM

SEQ ID NO: 733 - protein, 233 aa, Artificial Sequence
  derived and/or modified protein sequence (wt) from NRIV(D28542/4e)__KC608154.1__N
MIELEFHDVAANTSSTFDPEVAYANFKRVYTTGLSYDHIRIFYIKGREIKTSLAKRSEWEVTLNLGGWKITVYNTNFPGNRNNPVPDDGLTLHRLSGFLARYLLEKMLKVSEPEKLIIKSKIINPLAEKNGITWNDGEEVYLSFFPGSEMFLGTFRFYPLAIGIYKVQRKEMEPKYLEKTMRQRYMGLEAATWTVSKLTEVQSALTVVSSLGWKKTNVSAAARDFLAKFGINM

SEQ ID NO: 734 - protein, 233 aa, Artificial Sequence
  derived and/or modified protein sequence (wt) from NRIV(SUD-HKV141)__JX857322.1__N
MIELEFHDVAANTSSTFDPEVAYANFKRVHTTGLSYDHIRIFYIKGREIKTSLAKRSEWEVTLNLGGWKVTVYNTNFPGNRNNPVPDDGLTLHRLSGFLARYLLEKMLKVSEPEKLIIKSKIINPLAEKNGITWNDGEEVYLSFFPGSEMFLGTFRFYPLAIGIYKVQRKEMEPKYLEKTMRQRYMGLEAATWTVSKLTEVQSALTVVSSLGWKKTNVSAAARDFLAKFGINM

SEQ ID NO: 735 - protein, 234 aa, Artificial Sequence
  derived and/or modified protein sequence (wt) from BWAV(M459)__NC_034480.1__N
MSDLIFYDVDSVNANEFDPDTGYLDFKNNYPGALNTNTARTFFLNAAKAKNVLRNKPDKKVNPKFGNWEVEVVNNHFPGNRNNPIGKDDLTLHRISGYLARWILEEYKRDDESEKEIIESTVINPIAESNGIRWSDGAEIYLSFFPGTEMFLEPFKFYPLAIGIYRVKHKMMDAQFLKKALRQRYGKMTAEKWMSTKVKTIGEAVRNVEKLKWGKGGLSDAARNFLKKFDIAMI

SEQ ID NO: 736 - protein, 234 aa, Artificial Sequence
  derived and/or modified protein sequence (wt) from BWAV(M459)__EU564827.1__N
MSDLIFYDVDSVNANEFDPDTGYLDFKNNYPGALNTNTARTFFLNAAKAKNVLRNKPDKKVNPKFGNWEVEVVNNHFPGNRNNPIGKDDLTLHRISGYLARWILEEYKRDDESEKEIIESTVINPIAESNGIRWSDGAEIYLSFFPGTEMFLEPFKFYPLAIGIYRVKHKMMDAQFLKKALRQRYGKMTAEKWMSTKVKAIGEAVRNVEKLKWGKGGLSDAARNFLKKFDIAMI

SEQ ID NO: 737 - protein, 234 aa, Artificial Sequence
  derived and/or modified protein sequence (wt) from BWAV(UgAr1888)__KJ867185.1__N
MSDLIFYDVDSVNANEFDPDTGYLDFKNNYPGALNTNTARTFFLNAAKAKNVLRNKPDKKVNPKFGNWEVEIVNNHFPGNRNNPIGKDDLTLHRISGYLARWILEEYKRDDESEKEIIESTVINPIAESNGIRWSDGAEIYLSFFPGTEMFLEPFKFYPLAIGIYRVKHKMMDAQFLKKALRQRYGKMTAEKWMSTKVKAIGEAVRNVEKLKWGKGGLSDAARNFLKKFDIAMI

SEQ ID NO: 738 - protein, 235 aa, Artificial Sequence
  derived and/or modified protein sequence (wt) from BWAV/PGAV(SAAr1)__EU564828.1__N
MSGDLVFYDVDSVNSNAFDPDAGYVAFSNNHPGALNITTARTFFLNAAKAKGVLRNKPDKKVKPKFGDWEVEIVNNHFPGNRNNTIGEDDLTLHRISGYLARWVLEEHSKDDESEKELIESTIVNPIAESNGIKWSDGAAIYLSFFPGTEMFLEPFKFFPLAIGIYRVKHKMMDAQFLKKALRQRYGKLTAEKWMATKVKSIGEAVRAVEKLKWGKGGISDAARTFLKKFDIALI

SEQ ID NO: 739 - protein, 235 aa, Artificial Sequence; identical to SEQ ID NO: 738
  derived and/or modified protein sequence (wt) from BWAV/PGAV(191B-07)__KJ867179.1__N

SEQ ID NO: 740 - protein, 235 aa, Artificial Sequence
  derived and/or modified protein sequence (wt) from CEV(283)__KX817314.1__N
MSDLVFYDVASTGANGFDPDAGYVDFCAKYGESINLAAVRIFFLNAAKAKAALSRKPERKANPKFGEWQVEVVNNHFPANRNNPIGNNDLTIHRISGYLARWVLEQYKENEDESQRELVKTTVINPIAESNGIRWENGAEIYLAFFPGTEMFLETFKFYPLTIGIYRVKNGMMDSQYLKKALRQRYGSLTAEKWMSQKTGMIAKSLKEVEQLKWGRGGLSDTARTFLQKFGIKLP

SEQ ID NO: 741 - protein, 235 aa, Artificial Sequence
  derived and/or modified protein sequence (wt) from CEV(BFS-283)__U12797.1__N
MSDLVFYDVASTGANGFDPDAGYVDFCAKHGESINLAAVRIFFLNAAKAKAALSRKPERKANPKFGEWQVEVVNNHFPANRNNPIGNNDLTIHRISGYLARWVLEQYKENEDESQRELVKTTVINPIAESNGIRWENGAEIYLAFFPGTEMFLETFKFYPLTIGIYRVKNGMMDSQYLKKALRQRYGSLTAEKWMSQKTGMIAKSLKEVEQLKWGRGGLSDTARTFLQKFGIKLP

SEQ ID NO: 742 - protein, 235 aa, Artificial Sequence
  derived and/or modified protein sequence (wt) from CHATV(Mohko ILO8-3)__KF719221.1__N
MSDLVFYDVASTGANGFDPDEGYMAFCVKHAESISLAAVRIFFLNAAKAKAALARKPEKKASPKFGEWQVEIVNNHFPGNRNNPIGNNDLTVHRLSGYLARWVLEQYKENEDESQRELIKTTVINPIAESNGVRWDSGPEIYLSFFPGTEMFLETFKFYPLTIGIYRVKQGMMDPQYLKKALRQRYGTLTADKWMSQKVTAIAKSLKEVEQLKWGRGGLSDTARTFLQKFGIRLP

SEQ ID NO: 743 - protein, 235 aa, Artificial Sequence
  derived and/or modified protein sequence (wt) from CHATV(Mohko M07-1)__KF719224.1__N
MSDLVFYDVASTGANGFDPDEGYMAFCVKHAESINLAAVRIFFLNAAKAKAALARKPEKKASPKFGEWQVEIVNNHFPGNRNNPIGNNDLTVHRLSGYLARWVLEQYKENEDESQRELIKTTVINPIAESNGVRWDSGPEIYLSFFPGTEMFLETFKFYPLTIGIYRVKQGMMDPQYLKKALRQRYGTLTADKWMSQKVTAIAKSLKEVEQLKWGRGGLSDTARTFLQKFGIRLP

SEQ ID NO: 744 - protein, 235 aa, Artificial Sequence
  derived and/or modified protein sequence (wt) from CHATV(Mohko S07-2)__KF719233.1__N
MSDLVFYDVASTGANGFDPDEGYMAFCVKHAESINLAAVRIFFLNAAKAKAALARKPEKKASPKFGEWQVEIVNNHFPGNRNNPIGNNDLTVHRLSGYLARWVLEQYKENEDESQRELIKTTVINPIAESNGVRWDSGPEIYLSFFPGTEMFLETFKVYPLTTGIYRVKQGMMDPQYLKKALRQRYGTLTADKWMSQKVTAIAKSLKEVEQLKWGRGGLSDTARTFLQKFGIRLP

SEQ ID NO: 745 - protein, 235 aa, Artificial Sequence
  derived and/or modified protein sequence (wt) from CHATV(LEIV-11483)__FJ853592.1__N
MSDLVFYDVASTGANGFDPDEGYMAFCVKHGQSVNLAAVRIFFLNAAKAKAALARKPEKKASPKFGEWQVEIVNNHFPGNRNNPIGNNDLTIHRLSGYLARWVLEQYKENEDESQRELIKTTVINPIAESNGVRWDSGAEIYLSFFPGTEMFLETFKFYPLTIGIYRVKQGMMDPQYLKKALRQRYGTLTADKWMSQKVTAIAKSLKEVEQLKWGRGGLSDTARTFLQKFGIRLP

SEQ ID NO: 746 - protein, 235 aa, Artificial Sequence
  derived and/or modified protein sequence (wt) from CHATV(LEIV-11552)__EU479702.1__N
MSDLVFYDVASTGANGFDPDEGYMAFCVKHGQSVNLAAVRIFFLNAAKAKAALARKPEKKASPKFGEWQVEIVNNHFPGNRNNPIGNNDLTIHRLSGYLARWILEQYKENEDESQRELIKTTVINPIAESNGVRWDSGAEIYLSFFPGTEMFLETFKFYPLTIGIYRVKQGMMDPQYLKKALRQRYGTLTADKWMSQKVTAIAKSLKEVEQLKWGRGGLSDTARTFLQKFGIRLP

SEQ ID NO: 747 - protein, 235 aa, Artificial Sequence
  derived and/or modified protein sequence (wt) from CHATV(LEIV-13107)__FJ946829.1__N
MSDLVFYDVASTGANGFDPDEGYMAFCVKHGQSVNLAAVRIFFLNAAKAKAALARKPEKKANPKFGEWQVEIVNNHFPGNRNNPIGNNDLTIHRLSGYLARWVLEQYKENEDESQRELIKTTVINPIAESNGVRWDSGAEVYLSFFPGTEMFLETFKFYPLTIGIYRVKQGMMDPQYLKKALRQRYGTLTADKWMSQKVTAIAKSLKEVEQLKWGRGGLSDTARTFLQKFGIRLP

SEQ ID NO: 748 - protein, 235 aa, Artificial Sequence
  derived and/or modified protein sequence (wt) from CHATV(LEIV-17794)__FJ913879.1__N
MSDLVFYDVASTGANGFDPDEGYMAFCVKHGQSVNLAAVRIFFLNAAKAKAALARKPERKASPKFGEWQVEIVNNHFPGNRNNPIGNNDLTIHRLSGYLARWVLEQYKENEDESQRELIKTTVINPIAESNGVRWDSGAEIYLSFFPGTEMFLETFKFYPLTIGIYRVKQGMMDPQYLKKALRQRYGTLTADKWMSQKVTAIAKSLKEVEQLKWGRGGLSDTARTFLQKFGIRLP

SEQ ID NO: 749 - protein, 235 aa, Artificial Sequence
  derived and/or modified protein sequence (wt) from CHATV(LEIV-17827)__GQ330475.1__N
MSDLVFYDVASTGANGFDPDEGYMAFCVKYGESINLAAVRIFFLNAAKAKAALARKPEKKANPKFGEWQVEIVNNHFPGNRNNPIGNNDLTIHRLSGYLARWVLEQYKENEDESQRELIKTTIINPIAESNGVRWESGAEVYLSFFPGTEMFLEIFKFYPLTIGIYRVKQGMMDPQYLKKALRQRYGTLTADKWMSQKVTAIAKSLKEVEQLKWGRGGLSDTARTFLQKFGIRLP

SEQ ID NO: 750 - protein, 235 aa, Artificial Sequence
  derived and/or modified protein sequence (wt) from CHATV(LEIV-17829)__GQ330476.1__N
MSDLVFYDVASTGANGFDPDEGYMAFCVKYGESINLAAVRIFFLNAAKAKAALARKPEKKANPKFGEWQVEIVNNHFPGNRNNPIGNNDLTIHRLSGYLARWVLEQYKENEDESQRELIKTTIINPIAESNGVRWDSGAEVYLSFFPGTEMFLEIFKFYPLTIGIYRVKQGMMDPQYLKKALRQRYGTLTADKWMSQKVTAIAKSLKEVEQLKWGRGGLSDTARTFLQKFGIRLP

SEQ ID NO: 751 - protein, 235 aa, Artificial Sequence
  derived and/or modified protein sequence (wt) from CHATV(LEIV-18733)__HQ734824.1__N
MSDLVFYDVASTGANGFDPDEGYMAFCVKYGESINLAAVRIFFLNAAKAKAALARKPEKKANPKFGEWQVEIINNHFPGNRNNPIGNNDLTIHRLSGYLARWVLEQYKENEDESQRELIKTTIINPIAESNGVRWDSGAEVYLSFFPGTEMFLEIFKFYPLTIGIYRVKQGMMDPQYLKKALRQRYGTLTADKWMSQKVTAIAKSLKEVEQLKWGRGGLSDTARTFLQKFGIRLP

SEQ ID NO: 752 - protein, 235 aa, Artificial Sequence
  derived and/or modified protein sequence (wt) from CHATV(LEIV-18895)__GQ330482.1__N
MSDLVFYDVASTGANGFDPDEGYMAFCVKYGESINLAAVRIFFLNAAKAKAALARKPERKANPKFGEWQVEIVNNHFPGNRNNPIGNNDLTIHRLSGYLARWVLEQYKENEDESQRELIKTTIINPIAESNGVRWDSGAEVYLSFFPGTEMFLEIFKFYPLTIGIYRVKQGLMDPQYLKKALRQRYGTLTADKWMSQKVTAIAKSLKEVEQLKWGRGGLSDTARTFLQKFGIRLP

SEQ ID NO: 753 - protein, 235 aa, Artificial Sequence
  derived and/or modified protein sequence (wt) from CHATV(LEIV-22712)__HQ734825.1__N
MSDLVFYDVASTGANGFDPDEGYMAFCVKHGESINLAAVRIFFLNAAKAKAALARKPEKKASPKFGEWQVEIINNHFPGNRNNPIGNNDLTIHRLSGYLARWVLEQYKENEDESQRELIKTTVINPIAESNGVRWDSGAEIYLSFFPGTEMFLETFKFYPLTIGIYRVKQGMMDPQYLKKALRQRYGTLTADKWMSQKVTAIAKSLKEVEQLKWGRGGLSDTARTFLQKFGIRLP

SEQ ID NO: 754 - protein, 235 aa, Artificial Sequence
  derived and/or modified protein sequence (wt) from CHATV(LEIV-23500)__EU479701.1__N
MSDLVFYDVASTGANGFDPDAGYMAFCVKHGESINLAAVRIFFLNAAKAKAALARKPEKKANPKFGEWQVEIVNNHFPGNRNNPIGNNDLTIHRLSGYLARWVLEQYKENEDESQRELIKTTVINPIAESNGVRWENGAEVYLSFFPGTEMFLETFKFYPLTIGIYRVKQGMMDPQYLKKALRQRYGTLTADKWMSQKVTAIAKSLKEVEQLKWGRGGLSDTARTFLQKFGIRLP

SEQ ID NO: 755 - protein, 235 aa, Artificial Sequence
  derived and/or modified protein sequence (wt) from INKV__Z68496.1__N
MGDLVFYDEASTGANGFDPDAGFVAFMADHGESINLAAVRIFFLNAAKAKAALARKPERKATPKFGEWQVEIVNNHFPGNRNNPIGNNDLTIHRLSGYLARWVLEHFTEDDDESQRELIRSTIINPIAESNGIHWNNGPEIYLSFFPGTEMFLEVFKFYPLTIGIYRVKHGMMDPQYLKKALRQRYGTLTAEKWMAQKTVLIAKSLKDVEQLKWGRGGLSDAARTFLIKFGVKLP

SEQ ID NO: 756 - protein, 235 aa, Artificial Sequence
  derived and/or modified protein sequence (wt) from INKV(KN3641)__U47137.1__N
MGDLVFYDVASTGANGFDPDAGFVAFMADHGESINLAAVRIFFLNAAKAKAALARKPERKATPKFGEWQVEIVNNHFPGNRNNPIGNNDLTIHRLSGYLARWVLEHFTEDDDESQRELIRSTIINPIAESNGIHWNNGPEIYLSFFPGTEMFLEVFKFYPLTIGIYRVKHGMMDPQYLKKALRQRYGTLTAEKWMAQKTVLIAKSLKDVEQLKWGRGGLSDAARTFLIKFGVKLP

SEQ ID NO: 757 - protein, 235 aa, Artificial Sequence
  derived and/or modified protein sequence (wt) from INKV(Lovanger)__KU302751.1__N
MGDLVFYDVASTGANGFDPDAGFVAFMADHGESINLAAVRIFFLNAAKAKAALARKPERKATPKFGEWQVEIVNNHFPGNRNNPIGNNDLTIHRLSGYLARWVLEHFTEDDDESQRELIRSTIINPIAESNGIHWNNGPEIYLSFFPGTEMFLEVFKFYPLTIGIYRVKHGMMDPQYLKKALRQRYGTLTAEKWMTQKTVLIAKSLKDVEQLKWGRGGLSDAARTFLIKFGVKLP

SEQ ID NO: 758 - protein, 235 aa, Artificial Sequence
  derived and/or modified protein sequence (wt) from INKV(SW AR 83-161)__U47138.1__N
MGDLVFYDVASTGANGFDPDAGFVAFMADHGESINLAAVRIFFLNAAKAKAALARKPERKATPKFGEWQVEIVNNHFPGNRNNPIGNNDLTIHRLSGYLARWVLEHFTEDDDESQRELIRSTIINPIAESNGIHWNNGPEIYLSFLPGTEMFLEVFKFYPLTIGIYRVKHGMMDPQYLKKALRQRYGTLTAEKWMAQKTVLIAKSLKDVEQLKWGRGGLSDAARTFLIKFGVKLP

SEQ ID NO: 759 - protein, 235 aa, Artificial Sequence
  derived and/or modified protein sequence (wt) from LUMV__X73468.1__N
MSDLVFYDVASTGANGFDPDAGYVDFCVKHGESINLHSVRIFFLNAAKAKAALARKPERKASPKFGEWQVEIVNNHFPGNRNNPIDNNDLTIHRLSGYLARWVLEQFKENEDAAQRELIKTTVINPIAESNGIRWDNGAEIYLAFFPGTEMFLETFNFYPLTIGIYRVKHGMMDPQYLKKALRRRYGSLTADKWMSQKTVAIAKSLKDVEQLKWGRGGLSDTARVFLQKFGIKLP

SEQ ID NO: 760 - protein, 235 aa, Artificial Sequence
  derived and/or modified protein sequence (wt) from LUMV(SAAr 1881)__KX817326.1__N
MSDLVFYDVASTGANGFDPDAGYVDFCVKHGESINLHSVRIFFLNAAKAKAALARKPERKASPKFGEWQVEIVNNHFPGNRNNPIDNNDLTIHRLSGYLARWVLEQFKENEDAAQRELIKTTVINPIAESNGIRWDNGAEIYLAFFPGTEMFLETFNFYPLTIGIYRVKHGMMDPQYLKKALRQRYGSLTADKWMSQKTVAIAKSLKDVEQLKWGRGGLSDTARVFLQKFGIKLP

SEQ ID NO: 761 - protein, 235 aa, Artificial Sequence
  derived and/or modified protein sequence (wt) from MELV(TRVL 9375)__KX817329.1__N
MGDLIFYDVASTGANGFDPDAGYLAFTIAHGEAINLSAVRIFFLNAAKAKAALSRKPERKATPKFGDWQVEIVNNHFPGNRNNPIGNNDLTIHRLSGYLARWVLDLFKENEDESQKELIQSTIINPIAESNGIHWANGVEIYLSFFPGTEMFLEAFRFYPLTIGIYRVKHGLMDPQYLKKALRQRYGTLTADKWMAQKTTMIAKSLKDVEQLKWGKGGLSDAARTFLQKFGVRLP

SEQ ID NO: 762 - protein, 235 aa, Artificial Sequence
  derived and/or modified protein sequence (wt) from MBV__U31989.1__N
MSDLVFYDVASTGANGFDPDAGYVDFCAKHGESINLAAVRIFFLNAAKAKAALSRKPERKANPKFGEWQVEIVNNHFPANRNNPIGNNDLTIHRISGYLARWVLEQYRENEDESQRELVKTTVINPIAESNGIRWENGPEIYLAFFPGTEMFLETFKFYPLTIGIYRVKHGMMDPQYLKKALRQRYGSLTAEKWMSQKTGMIAKSLKEVEQLKWGRGGLSDTARTFLQKFGIRLP

SEQ ID NO: 763 - protein, 235 aa, Artificial Sequence
  derived and/or modified protein sequence (wt) from SAV(VR723)__U47139.1__N
MSELVFYDVASTGANGFDPDAGYLAFCVKHGESISLSSVRIFFLNAAKAKAALSRKPERKANPKFGEWQVEIVNNHFPGNRNNPIDNLDLTIHRLSGYLARWVLEQFIENEDESQRELIKTTVINPIAESNGIKWENGAEIYLSFFPGTEMFLEIFKFYPLTIGIYRVKQGMMDPQYLKKALRQRYGSLTADKWMSQKVGAIAKSLKDIEQLKWGKGGLSDTARTFLQKFGIKLP

SEQ ID NO: 764 - protein, 235 aa, Artificial Sequence
  derived and/or modified protein sequence (wt) from SDNV(BeAr 103645)__U47140.1__N
MGDLVFYDVASTGANGFDPDAGFVAFMAGHGESINLTAVRIFFLNAAKAKAALSRKPERKATPKFGDWQVEIVNNHFPGNRNNPIGNNDLTIHRISGYLARWTLEHFREGGDEAQKELIRTTIINPIAESNGIHWANGAEIYLSFFPGTEMFLEAFKFYPLTIGIYRVKHGMMDAQYLKKALRQRYGTLTADEWMAQKTVLITKSLKDVEQLKWGRGGLSDAARTFLSKFGVKLP

SEQ ID NO: 765 - protein, 235 aa, Artificial Sequence
  derived and/or modified protein sequence (wt) from SDNV(BeAr 103645)__KX817335.1__N
MGDLVFYDVASTGANGFDPDAGFVAFMAGHGESINLTAVRIFFLNAAKAKAALSRKPERKATPKFGDWQVEIVNNHFPGNRNNPIGNNDLTIHRISGYLARWTLEHFREGEDEAQKELIRTTIINPIAESNGIHWANGAEIYLSFFPGTEMFLEAFKFYPLTIGIYRVKHGMMDAQYLKKALRQRYGTLTADKWMAQKTVLITKSLKDVEQLKWGRGGLSDAARTFLSKFGVKLP

SEQ ID NO: 766 - protein, 235 aa, Artificial Sequence
  derived and/or modified protein sequence (wt) from SSHV__EU294510.1__N
MSDLVFYDVASTGANGFDPDAGYMAFCVKYAESVNLAAVRIFFLNAAKAKAALSRKPERKANPKFGEWQVEVVNNHFPGNRNNPINSDDLTIHRLSGYLARWVLEQYKENEDESRRELIKTTIINPIAESNGVRWDSGAEIYLSFFPGTEMFLETFKFYPLTIGIYRVKQGMMDPQYLKKALRQRYGSLTADKWMSQKVTAIAKSLKEVEQLKWGRGGLSDTARSFLQKFGIRLP

SEQ ID NO: 767 - protein, 235 aa, Artificial Sequence
  derived and/or modified protein sequence (wt) from SSHV(F10838)__KM215563.1__N
MSDLVFYDVASTGANGFDPDAGYMAFCVKYAESVNLAAVRIFFLNAAKAKAALSRKPERKANPKFGEWQVEVVNNHFPGNRNNPINSDDLTIHRLSGYLARWVLEQYKENEDESRRELIKTTIINPIAESNGVRWDSGAEIYLSFFPGTEMFLETFKFYPLTIGIYRVKQGMMDPQYLKKALRQRYGSLTADKWMSQKVTAIAKSLKEVEQLKWGRGGLSDTARSLLQKFGIRLP

SEQ ID NO: 768 - protein, 235 aa, Artificial Sequence
  derived and/or modified protein sequence (wt) from SORV(SORV-252)__GU018050.2__N
MGDLVFYDVASTGANGFDPDAGFVAFMADHGESISLSAVRIFFLNAAKAKAALARKPERKANPKFGEWQVEIVNNHFPGNRNNPIGNNDLTIHRLSGYLARWVLEHFTEDEDESQRELIRSTIINPIAESNGIRWNNGPEIYLSFFPGTEMFLEAFKFYPLTIGIYRVKHGLMDPQYLKKALRQRYGTLTAEKWMAQKTVLIAKSLKDVEQLKWGRGGLSDAARTFLIKFGVKLP

SEQ ID NO: 769 - protein, 235 aa, Artificial Sequence
  derived and/or modified protein sequence (wt) from SORV(NJO 94F)__U47141.1__N
MGDLVFYDVASTGANGFDPDAGFVAFMADHGESINLSAVRIFFLNAAKAKAALARKPERKANPKFGEWQVEIVNNHFPGNRNNPIGNNDLTIHRLSGYLARWVLEHFTEDEDESQRELIRSTIINPIAESNGIHWNNGPEIYLSFFPGTEMFLEAFKFYPLTIGIYRVKHGMMDPQYLKKALRQRYGTLTAEKWMAQKTVLIAKSLKDVEQLKWGRGGLSDAARTFLIKFGVKLP

SEQ ID NO: 770 - protein, 235 aa, Artificial Sequence
  derived and/or modified protein sequence (wt) from SORV(NJO-94F)__KX817338.1__N
MGDLVFYDVASTGANGFDPDAGFVAFMADHGESINLSAVRIFFLNAAKAKAALARKPERKANPKFGEWQVEIVNNHFPGNRNNPIGNNDLTIHRLSGYLARWVLEHFTEDEDESQRELIRSTIINPIAESNGIHWNNGPEIYLSFFPGTEMFLEAFKFYPLTIGIYRVKHGLMDPQYLKKALRQRYGTLTAEKWMAQKTVLIAKSLKDVEQLKWGRGGLSDAARTFLIKFGVKLP

SEQ ID NO: 771 - protein, 235 aa, Artificial Sequence
  derived and/or modified protein sequence (wt) from TAHV__Z68497.1__N
MSDLVFYDVASTGANGFDPDAGYVDFCIKHGEAINLHSVRIFFLNAAKAKAALARKPERKASPKFGEWQVEVVNYHFPGNRNNPIDNNDLTIHRLYGYLARWVLEQFKENEDAAQRELIKTTVINPIAESNGIRWDNGAEIYLAFFPGTEMFLETFNFYPLTIGIYRVKQGMMDPQYLKKALRQRYGSLTADKWMSQKTTAIAKSLKDVEQLKWGRGGLSDTARTFLQKFGIRLP

SEQ ID NO: 772 - protein, 235 aa, Artificial Sequence
  derived and/or modified protein sequence (wt) from TAHV(22595-6)__HM036217.1__N
MSDLVFYDVASTGANGFDPDAGYVDFCIKHGEAINLHSVRIFFLNAAKAKAALARKPERKASPKFGEWQVEVVNNHFPGNRNNPIDNNDLTIHRLSGYLARWVLEQFKENEDAAQRELIKTTVINPIAESNGIRWDNGAEIYLAFFPGTEMFLETFNFYPLTIGIYRVKQGMMDPQYLKKALRQRYGSLTADKWMSQKTTAIAKSLKDVEQLKWGRGGLSDTARTFLQKFGIRLP

SEQ ID NO: 773 - protein, 235 aa, Artificial Sequence
  derived and/or modified protein sequence (wt) from TAHV(NM08003)__HQ541823.1__N
MSDLVFYDVASTGANGFDPDAGYVDFCIKHGEAINLHSVRIFFLNAAKAKAALARKPERKASPKFGEWQVEVVNNHFPGNRNNPIDNNDLTIHRLSGYLARWVLEQFKENDDAAQRELIKTTVINPIAESNGIRWDNGAEIYLAFFPGTEMFLETFNFYPLTIGIYRVKQGMMDPQYLKKALRQRYGSLTADKWMSQKTTAIAKSLKDVEQLKWGRGGLSDTARTFLQKFGIRLP

SEQ ID NO: 774 - protein, 235 aa, Artificial Sequence
  derived and/or modified protein sequence (wt) from TAHV(XJ0625)__EU622820.2__N
MSDLVFYDVASTGANGFDPDAGYVDFCVKYGEAINLHSVRIFFLNAAKAKAALARKPERKASPKFGEWQVEVVNNHFPGNRNNPIDNNDLTIHRLSGYLARWVLEQFKENEDAAQRELIKTTVINPIAESNGIRWDNGAEIYLAFFPGTEMFLETFNFYPLTIGIYRVKQGMMDPQYLKKALRQRYGPLTADKWMSQKTVAIAKSLKDVEQLKWGRGGLSDTARTFLQKFGIRLP

SEQ ID NO: 775 - protein, 235 aa, Artificial Sequence
  derived and/or modified protein sequence (wt) from TAHV(XJ0708)__HM243139.1__N
MSDLVFYDVASTGANGFDPDAGYVDFCAKYGEAINLHSVRIFFLNAAKAKAALARKPERKASPKFGEWQVEVVNNHFPGNRNNPIDNNDLTIHRLSGYLARWVLEQFKENEDAAQRELIKTTVINPIAESNGIRWDNGAEIYLAFFPGTEMFLETFNFYPLTIGIYRVKQGMMDPQYLKKALRQRYGPLTADKWMSQKTVAIAKSLKDVEQLKWGRGGLSDTARTFLQKFGIRLP

SEQ ID NO: 776 - protein, 235 aa, Artificial Sequence
  derived and/or modified protein sequence (wt) from TVTV(AR42)__KX891323.1__N
MSELVFYDAPSTGANGFDPDAGYVAFIAAHAGSYDLSAVRIFFLNAAKAKNALSRKPEGKVSIKFGEWSVEVVNNHFPGNRNNPIGNNDLTIHRISGYLARWVLEEFKGQDDEAQKDIIRSTIVNPIAESNGIHWDSGADAYLSFFPGTEMFLESFDFLPLAIGIYRVKNGMMDVQYLKKALRQRYGTMTADKWMSTKTTVIAKTLKRVESFKWGKGGLSEAARAFLSKFNVKIP

SEQ ID NO: 777 - protein, 235 aa, Artificial Sequence
  derived and/or modified protein sequence (wt) from TVTV(ND3374)__KM215564.1__N
MSELVFYDAPSTGANGFDPDAGYVAFIAAHAGSYDLSAVRIFFLNAAKAKNALSRRPEGKVSIKFGEWSVEVVNNHFPGNRNNPIGNNDLTIHRISGYLARWVLEEFKGQDDEAQKDIIRSTIVNPIAESNGIHWDSGADAYLSFFPGTEMFLESFDFLPLAIGIYRVKNGMMDVQYLKKALRQRYGTMTADKWMSTKTTVIAKTLKRVESFKWGKGGLSEAARAFLSKFNVKIP

SEQ ID NO: 778 - protein, 235 aa, Artificial Sequence
  derived and/or modified protein sequence (wt) from JCV(3324-04)__HM007356.1__N
MGDLVFYDVASTGANGFDPDAGFVAFMADHGESVSLSAVRIFFLNAAKAKAALARKPERKATPKFGEWQVEIVNNHFPGNRNNPIGNNDLTIHRLSGYLARWVLEHFTTDDDESQRELIRSTIINPIAESNGIHWNNGPEIYLSFFPGTEMFLEIFKFYPLTIGIYRVKHGMMDPQYLKKALRQRYGTLTAEKWMAQKTVLIAKSLKDVEQLKWGRGGLSDAARTFLIKFGVKLP

SEQ ID NO: 779 - protein, 235 aa, Artificial Sequence
  derived and/or modified protein sequence (wt) from JCV(61v2235)__U12796.1__N
MGDLVFYDVASTGANGFDPDAGFVAFMADHGESINLSAVRIFFLNAAKAKAALARKPERKATPKFGEWQVEIVNNHFSGNRNNPIGNNDLTIHRLSGYLARWVLEHFNSDDDESQRELIRSTIINPIAESNGIHWNNGPEIYLSFFPGTEMFLEIFKFYPLTIGIYRVKHGMMDPQYLKKALRQRYGTLTAEKWMAQKTVLIAKSLKDVEQLKWGRGGLSDAARTFLIKFGVKLP

SEQ ID NO: 780 - protein, 235 aa, Artificial Sequence
  derived and/or modified protein sequence (wt) from JCV(1064-03)__EF681816.1__N
MGDLVFYDVASTGANGFDPDAGFVAFMADHGEAINLAAVRIFFLNAAKAKAALARKPERKATPKFGEWQVEIVNNHFPGNRNNPIGNNDLTIHRLSGYLARWVLEHFTEDDDESQRELIRSTIINPIAESNGIHWNNGPEIYLSFFPGTEMFLEVFKFYPLTIGIYRVKHGMMDPQYLKKALRQRYGTLTAEKWMAQKTVLIAKSLKDVEQLKWGRGGLSDAARTFLIKFGVKLP

SEQ ID NO: 781 - protein, 235 aa, Artificial Sequence
  derived and/or modified protein sequence (wt) from JCV(33909)__EF681853.1__N
MGDLVFYDVASTGANGFDPDAGFVAFMADHGEVINLAAVRIFFLNAAKAKAALARKPERKATPKFGEWQVEIVNNHFPGNRNNPIGNNDLTIHRLSGYLARWVLEHFTEDDDESQRELIRSTIINPIAESNGIHWNNGPEIYLSFFPGTEMFLEVFKFYPLTIGIYRVKHGMMDPQYLKKALRQRYGTLTAEKWMAQKTVLIAKSLKDVEQLKWGRGGLSDAARTFLIKFGVKLP

SEQ ID NO: 782 - protein, 235 aa, Artificial Sequence
  derived and/or modified protein sequence (wt) from JCV(2179-00)__EF681808.1__N
MGDLVFYDVASTGANGFDPDAGFVAFMADHGESVSLSAVRIFFLNAAKAKAALARKPERKATPKFGEWQVEIVNNHFPGNRNNPIGNNDLTIHRLSGYLARWVLEHFTTDDDESQRELIRSTIINPIAESNGIHWNNGPEIYLSFFPGTEMFLEIFKFYPLTIGIYRVKHGMMDPQYLKKALRQRYGILTAEKWMAQKTVLIAKSLKDVEQLKWGRGGLSDAARTFLIKFGVKLP

SEQ ID NO: 783 - protein, 235 aa, Artificial Sequence
  derived and/or modified protein sequence (wt) from JCV(2989-06)__EF681849.1__N
MGDLIFYDVASTGANGFDPDAGFVAFMADHGESVSLSAVRIFFLNAAKAKAALARKPERKATPKFGEWQVEIVNNHFPGNRNNPIGNNDLTIHRLSGYLARWVLEHFTTDDDESQRELIRSTIINPIAESNGIHWNNGPEIYLSFFPGTEMFLEIFKFYPLTIGIYRVKHGMMDPQYLKKALRQRYGTLTAEKWMAQKTVLIAKSLKDVEQLKWGRGGLSDAARTFLIKFGVKLP

SEQ ID NO: 784 - protein, 235 aa, Artificial Sequence
  derived and/or modified protein sequence (wt) from JCV(5592-02)__EF681804.1__N
MGDLVFYDVASTGANGFDPDAGFVAFMADHGESVSLSAVRIFFLNAAKAKAALARKPERKATPKFGEWQVEIVNNHFPGNRNSPIGNNDLTIHRLSGYLARWVLEHFTTDDDESQRELIRSTIINPIAESNGIHWNNGPEIYLSFFPGTEMFLEIFKFYPLTIGIYRVKHGMMDPQYLKKALRQRYGTLTAEKWMAQKTVLIAKSLKDVEQLKWGRGGLSDAARTFLIKFGVKLP

SEQ ID NO: 785 - protein, 235 aa, Artificial Sequence
  derived and/or modified protein sequence (wt) from JCV(F5609)__KM215546.1__N
MGDLVFYDVASTGANGFDPDAGFVAFMADHGESVSLSAVRIFFLNAAKAKAALARKPERKATPKFGEWQVEIVNNHFPGNRNNPIGNNDLTIHRLSGYLARWVLEHFTTDDDESQRELIRSTIINPIAESNGIHWNNGPEIYLSFFPGTEMFLEIFKFYPLTIGIYRVKHGMMDPQYLKKALRQRYGTLTAEKWMAQKTVLIAKSLKDVEQLKWGRGGLSDAARTFLTKFGVKLP

SEQ ID NO: 786 - protein, 235 aa, Artificial Sequence
  derived and/or modified protein sequence (wt) from JCV(F6577)__KM215557.1__N
MGDLVFYDVASTGANGFDPDAGFVAFMADHGESVSLSAVRIFFLNAAKAKAALSRKPERKATPKFGEWQVEIVNNHFPGNRNNPIGNNDLTIHRLSGYLARWVLEHFTTDDDESQRELIRSTIINPIAESNGIHWNNGPEIYLSFFPGTEMFLEIFKFYPLTIGIYRVKHGMMDPQYLKKALRQRYGTLTAEKWMAQKTVLIAKSLKDVEQLKWGRGGLSDAARTFLIKFGVKLP

SEQ ID NO: 787 - protein, 235 aa, Artificial Sequence
  derived and/or modified protein sequence (wt) from JCV(W13135)__KM215552.1__N
MGDLVFYDVASTGANGFDPDAGFVAFMADHGESVNLSAVRIFFLNAAKAKAALARKPERKATPKFGEWQVEIVNNHFPGNRNNPIGNNDLTIHRLSGYLARWVLEHFTTDDDESQRELIRSTIINPIAESNGIHWNNGPEIYLSFFPGTEMFLEIFKFYPLTIGIYRVKHGMMDPQYLKKALRQRYGTLTAEKWMAQKTVLIAKSLKDVEQLKWGRGGLSDAARTFLIKFGVKLP

SEQ ID NO: 788 - protein, 235 aa, Artificial Sequence
  derived and/or modified protein sequence (wt) from JCV(W18393)__KM215559.1__N
MGDLVFYDVASTGANGFDPDAGFVAFMADHGESINLSAVRIFFLNAAKAKAALARKPERKATPKFGEWQVEIINNHFPGNRNNPIGNNDLTIHRLSGYLARWVLEHFTADDDESQRELIRSTIINPIAESNGIHWNNGPEIYLSFFPGTEMFLEIFKFYPLTIGIYRVKHGMMDPQYLKKALRQRYGTLTAEKWMAQKTVLIAKSLKDVEQLKWGRGGLSDAARTFLIKFGVKLP

SEQ ID NO: 789 - protein, 235 aa, Artificial Sequence
  derived and/or modified protein sequence (wt) from KEYV(KEYV/Ochlerotatus atlanticus/USA/KEYVLK01/2005)__KT630290.1__N
MGDLVFYDVASTGANGFDPDAGYVAFMANHGESISLSTVRIFFLNAAKAKAALTRKPERKATPKFGEWQVEIVNNHFPGNRNNPIGNNDLTLHRISGYLARWVLEHFGEGEDESQKELIKSTVINPIAESNGIRWGNGVEIYLSFFPGTEMFLELFKFYPLTIGIYRVKHGMMDAQYLKKALRQRYGTLTADKWMAQKTSMITKSLKDVEQLKWGKGGLSDTARAFLAKFGVRLP

SEQ ID NO: 790 - protein, 235 aa, Artificial Sequence
  derived and/or modified protein sequence (wt) from KEYV(KEYV/Ochlerotatus atlanticus/USA/KEYVLK02/2005)__KT630293.1__N
MGDLVFYDVASTGANGFDPDAGYVAFMANHGESISLSTVRIFFLNAAKAKAALTRKSERKATPKFGEWQVEIVNNHFPGNRNNPIGNNDLTLHRISGYLARWVLEHFGEGEDESQKELIKSTVINPIAESNGIRWGNGVEIYLSFFPGTEMFLELFKFYPLTIGIYRVKHGMMDAQYLKKALRQRYGTLTADKWMAQKTSMITKSLKDVEQLKWGKGGLSDTARAFLAKFGVRLP

SEQ ID NO: 791 - protein, 235 aa, Artificial Sequence; identical to SEQ ID NO: 789
  derived and/or modified protein sequence (wt) from KEYV(C14031-33)__U12801.1__N

SEQ ID NO: 792 - protein, 235 aa, Artificial Sequence
  derived and/or modified protein sequence (wt) from LACV(Human/78)__NC_004110.1__N
MSDLVFYDVASTGANGFDPDAGYMDFCVKNAELLNLAAVRIFFLNAAKAKAALSRKPERKANPKFGEWQVEVINNHFPGNRNNPIGNNDLTIHRLSGYLARWVLDQYNENDDESQHELIRTTIINPIAESNGVGWDSGPEIYLSFFPGTEMFLETFKFYPLTIGIHRVKQGMMDPQYLKKALRQRYGTLTADKWMSQKVAAIAKSLKDVEQLKWGKGGLSDTAKTFLQKFGIRLP

SEQ ID NO: 793 - protein, 235 aa, Artificial Sequence
  derived and/or modified protein sequence (wt) from LACV__KP271107.1__N
MSDLVFYDVASTGANGFDPDTGYMDFCVKNAESLNLAAVRIFFLNAAKAKAALSRKPERKANPKFGEWQVEVINNHFPGNRNNPIGNNDLTIHRLSGYLARWVLDQYNENDDESQHELIRTTIINPIAESNGVGWDSGPEIYLSFFPGTEMFLETFKFYPLTIGIHRVKQGMMDPQYLKKALRQRYGTLTADKWMSQKVAAIAKSLKDVEQLKWGKGGLSDTAKTFLQKFGIRLP

SEQ ID NO: 794 - protein, 235 aa, Artificial Sequence
  derived and/or modified protein sequence (wt) from LACV(BEN2_Lafayette_WI_2007)__GU596386.1__N
MSDLVFYDVASTGANGFDPDAGYMDFCVKNAESLNLAAVRIFFLNAAKAKAALSRKPERKANPKFGEWQVEVINNHFPGNRNNPIGNNDLTIHRLSGYLARWVLDQYNENDDESQHELIRTTIINPIAESNGVGWDSGPEIYLSFFPGTEMFLETFKFYPLTIGIHRVKQGMMDPQYLKKALRQRYGTLTADKWMSQKVAAIAKSLKDVEQLKWGKGGLSDTAKTFLQKFGIRLP

SEQ ID NO: 795 - protein, 235 aa, Artificial Sequence
  derived and/or modified protein sequence (wt) from LACV(Dallas/TX/2009)__GU591164.1__N
MSDLVFYDVASTGANGFDPDAGYMDFCVKNAESLNLAAVRIFFLNAAKAKAALSRKPERKANPKFGEWQVEVVNNHFPGNRNNPIGNNDLTIHRLSGYLARWVLDQYNENDDESQRELIRTTIINPIAESNGVRWDSGPEIYLSFFPGTEMFLETFKFYPLTIGIHRVKQGMMDPQYLKKALRQRYGTLTADKWMSQKVAAIAKSLKDVEQLKWGKGGLSDTAKTFLQKFGIRLP

SEQ ID NO: 796 - protein, 235 aa, Artificial Sequence
  derived and/or modified protein sequence (wt) from LACV(Fort Bend County/TX/2009)__GU591167.1__N
MSDLVFYDVASTGANGFDPDAGYMDFCVKNAESLNLAAVRIFFLNAAKAKAALSRKPERKANPKFGEWQVEVINNHFPGNRNNPIGNNDLTIHRLSGYLARWVLDQYNENDDESQRELIRTTIINPIAESNGVRWDSGPEIYLSFFPGTEMFLETFKFYPLTIGIHRVKQGMMDPQYLKKALRQRYGTLTADKWMSQKVAAIAKSLKDVEQLKWGKGGLSDTAKTFLQKFGIRLP

SEQ ID NO: 797 - protein, 235 aa, Artificial Sequence
  derived and/or modified protein sequence (wt) from LACV(LACV/95/OH-H (CCH-MB96))__GU206135.1__N
MSDLVFYDVASTGANGFDPDAGYMDFCVKNAESLNLAAVRIFFLNAAKAKAALSRKPERKANPKFGEWQVEVVNNHFPGNRNNPIGNNDLTIHRLSGYLARWVLDQYNENDDESQHELIKTTIINPIAESNGVGWDSGPEIYLSFFPGTEMFLETFKFYPLTIGIHRVKQGMMDPQYLKKALRQRYGTLTADKWMSQKVAAIAKSLKDVEQLKWGKGGLSDTAKTFLQKFGIRLP

SEQ ID NO: 798 - protein, 231 aa, Artificial Sequence
  derived and/or modified protein sequence (wt) from OROV(BeAn19991)__NC_005777.1__N
MSEFIFNDVPQRTTSTFDPEAAYVAFEARYGQVLNAGVVRVFFLNQKKAKDVLRKTSRPMVDLTFGGVQFAMVNNHFPQFQSNPVPDNGLTLHRLSGYLARWAFTQMRSPIKQAEFRATVVVPLAEVKGCTWNDGDAMYLGFAAGAEMFLQTFTFFPLVIEMHRVLKDGMDVNFMKKVLRQRYGQKTAEQWMREEIVAVRAAFEAVGTLAWARTGFSPAARDFLRQFGIDI

SEQ ID NO: 799 - protein, 231 aa, Artificial Sequence
  derived and/or modified protein sequence (wt) from OROV(AR136921)__HQ830443.1__N
MSEFIFNDVPQRTTSTFDPEAAYVAFEARYGQVLNAGVVRVFFLNQKKAKDVLRKTSRPMVDLTFGGVQFAMVNNHFPQFQSNPVPDNGLTLHRLSGYLARWAFTQMRSPIKQAEFRATVVVPLAEVKGCTWNDGDAMYLGFAAGAEMFLQTFTFFPLVIEMHRVLKDGMDVNFMKKVLRQRYGQKTAEQWMREEIVAVRAAFEAVGTLAWARTGFSPAARDFLRQFGIGI

SEQ ID NO: 800 - protein, 231 aa, Artificial Sequence
  derived and/or modified protein sequence (wt) from OROV(AR366927)__HQ830448.1__N
MSEFFFNDVPQRTTSTFDPEAAYVAFEARYGQVLNAGVVRVFFLNQKKAKDVLRKTSRPMVDLTFGGVQFAMVNNHFPQFQSNPVPDNGLTLHRLSGYLARWAFTQMRSPIKQAEFRATVVVPLAEVKGCTWNDGDAMYLGFAAGAEMFLQTFTFFPLVIEMHRVLKDGMDVNFMKKVLRQKYGQKTAEQWMREEIVAVRAAFEAVGTLAWARTGFSPAARDFLRQFGIGI

SEQ ID NO: 801 - protein, 231 aa, Artificial Sequence
  derived and/or modified protein sequence (wt) from OROV(BeAn 206119)__AY993909.1__N
MSEFIFNDVPQRTTSTFDPEAAYVAFEARYGQVLNAGVVRVFFLNQKKAKDVLRKTSRPMVDLTFGGVQFAMVNNHFPQFQSNPVPDNGLTLHRLSGYLARWAFTQMRSPIKQAEFRAAVVVPLVEVKGCTWNDGDAMYLGFAAGAEMFLQTFTFFPLVIEMHRVLKDGMDVNFMKKVLRQRYGQKTAEQWMREEIVAVRAAFETVGTFAWARTGFSPAARDFLRQFGIGI

SEQ ID NO: 802 - protein, 231 aa, Artificial Sequence
  derived and/or modified protein sequence (wt) from OROV(BeAn 208819)__AY993911.1__N
MSEFIFNDVPQRTTSTFDPEAAYVAFEARYGQVLNAGVVRVFFLNQKKAKDVLRKTSRPMVDLTFGGVQFAMVNNHFPQFQSNPVPDNGLTLHRLSGYLARWAFTQMRSPIKQAEFRATVVVPLVEVKGCTWNDGDAMYLGFAAGAEMFLQTFTFFPLVIEMHRVLKDGMDVNFMKKVLRQRYGQKTAEQWMREEIVAVRAAFEAVGTLAWARTGFSPAARDFLRQFGIGI

SEQ ID NO: 803 - protein, 231 aa, Artificial Sequence
  derived and/or modified protein sequence (wt) from OROV(BeAn 208823)__AY993912.1__N
MSEFIFNDVPQRTTSTFDPEAAYVAFEARYGQVLNAGVVRVFFLNQKKAKDVLRKTSRPMVDLTFGGVQFAMVNNHFPQFQSNPVPDNGLTLHRLSGYLARWAFTQMRSPIKQAEFRATVVVPLVEVKGCTWNDGDAMYLGFAAGAEMFLQTFTFFPLVIEMHRVLKDGMDVNFMKKVLRQRYGQKTAERWMREEIVAVRAAFEAVGTLAWARTGFSPAARDFLRQFGIGI

SEQ ID NO: 804 - protein, 231 aa, Artificial Sequence
  derived and/or modified protein sequence (wt) from OROV(H244576)__HQ830444.1__N
MSEFFFNDVPQRTTSTFDPEAAYVAFEARYGQVLNAGVVRVFFLNQKKAKDVLRKTSRPMVDLTFGGVQFAMVNNHFPQFQSNPVPDNGLTFHRLSGYLARWAFTQMRSPIKQAEFRATVVVPLAEVKGCTWNDGDAMYLGFAAGAEMFLQTFTFFPLVIEMHRVLKDGMDVNFMKKVLRQKYGQKTAEQWMREEIVAVRAAFEAVGTLAWARTGFSPAARDFLRQFGIGI

SEQ ID NO: 805 - protein, 231 aa, Artificial Sequence
  derived and/or modified protein sequence (wt) from OROV(H355186)__HQ830446.1__N
MSEFIFSDVPQRTTSTFDPEAAYVAFEARYGQVLNAGVVRVFFLNQKKAKDVLRKTSRPMVDLTFGGVQFAMVNNHFPQFQSNPVPDNGLTLHRLSGYLARWAFTQMRSPIKQAEFRATVVVPLAEVKGCTWNDGDAMYLGFAAGAEMFLQTFTFFPLVIEMHRVLKDGMDVNFMKKVLRQRYGQKTAEQWMREEIVAVRAAFEAVGTLAWARTGFSPAARDFLRQFGIGI

SEQ ID NO: 806 - protein, 231 aa, Artificial Sequence
  derived and/or modified protein sequence (wt) from OROV(H356898)__HQ830447.1__N
MSEFIFNDVPQRTTSTFDPEAAYVSFEARYGQVLNAGVVRVFFLNQKKAKDVLRKTSRPMVDLTFGGVQFAMVNNHFPQFQSNPVPDNGLTLHRLSGYLARWAFTQMRSPIKQAEFRATVVVPLAEVKGCTWNDGDAMYLGFAAGAEMFLQTFTFFPLVIEMHRVLKDGMDVNFMKKVLRQRYGQKTAEQWMREEIVAVRAAFEAVGTLAWARTGFSPAARDFLRQFGIGI

SEQ ID NO: 807 - protein, 231 aa, Artificial Sequence
  derived and/or modified protein sequence (wt) from OROV(H389865)__HQ830453.1__N
MSEFIFNDVPQRTTSTFDPEAAYVAFEARYGQVLNAGVVRVFFLNQKKAKDVLRKTSRPMVDLTFGGVQFAMVNNHFPQFQSNPVPDNGLTLHRLSGYLARWAFTHMRSPIKQAEFRATVVVPLAEVKGCTWNDGDAMYLGFAAGAEMFLQTFTFFPLVIEMHRVLKDGMDVNFMKKFLRQRYGQKTAEQWMREEILAVKAAFESVGTLAWARTGFSPAARDFLRQFAIGI

SEQ ID NO: 808 - protein, 231 aa, Artificial Sequence
  derived and/or modified protein sequence (wt) from OROV(H472433)__HQ830455.1__N
MSEFIFNDVPQRTTSTFDPEAAYVAFEARYGQVLNAGVVRVFFLNQKKAKDVLRKTSRPMVDLTFSGVQFAMVNNHFPQFQSNPVPDNGLTLHRLSGYLARWAFTQMRSPIKQAEFRATVVVPLAEVKGCTWNDGDAMYLGFAAGAEMFLQTFTFFPLVIEMHRVLKDGMDVNFMKKVLRQRYGQKTAEQWMREEIVAVRAAFEAVGTLAWARTGFSPAARDFLRQFGIGI

SEQ ID NO: 809 - protein, 231 aa, Artificial Sequence
  derived and/or modified protein sequence (wt) from OROV(H532490)__HQ830463.1__N
MSEFIFNDVPQRTTSTFDPEAAYVSFEARYGQVLNAGVVRVFFLNQKKAKDVLRKTSSPMVDLTFGGVQFAMVNNHFPQFQSNPVPDNGLTLHRLSGYLARWAFTQMRSPIKQAEFRATVVVPLAEVKGCTWNDGDAMYLGFAAGAEMFLQTFTFFPLVIEMHRVLKDGMDVNFMKKVLRQRYGQKTAEQWMREEIVAVRAAFEAVGTLAWARTGFSPAARDFLRQFGIGI

SEQ ID NO: 810 - protein, 231 aa, Artificial Sequence
  derived and/or modified protein sequence (wt) from OROV(H543629)__HQ830467.1__N
MSEFLFNDVPQRTTSTFDPEAAYVAFEARYGQVLNAGVVRVFFLNQKKAKDVLRKTSRPMVDLTFGGVQFAMVNNHFPQFQSNPVPDNGLTLHRLSGYLARWAFTQMRSPIKQAEFRATVVVPLAEVKGCTWNDGDAMYLGFAAGAEMFLQTFTFFPLVIEMHRVLKDGMDVNFMKKVLRQRYGQKTAEQWMREEIVAVRAAFEAVGTLAWARTGFSPAGRDFLRQFGIGI

SEQ ID NO: 811 - protein, 231 aa, Artificial Sequence
  derived and/or modified protein sequence (wt) from OROV(H543638)__HQ830468.1__N
MSEFLFNDVPQRTTSTFDPEAAYVAFEARYGQVLNAGVVRVFFLNQKKAKNVLRKTSRPMVDLTFGGVQFAMVNNHFPQFQSNPVPDNGLTLHRLSGYLARWAFTQMRSPIKQAEFRATVVVPLAEVKGCTWNDGDAMYLGFAAGAEMFLQTFTFFPLVIEMHRVLKDGMDVNFMKKVLRQRYGQKTAEQWMREEIVAVRAAFEAVGTLAWARTGFSPAGRDFLRQFGIGI

SEQ ID NO: 812 - protein, 231 aa, Artificial Sequence
  derived and/or modified protein sequence (wt) from OROV(H706890)__HQ830473.1__N
MAEFIFNDVPQRTTSTFDPEAAYVAFEARYGQVLNAGVVRVFFLNQKKAKDVLRKTSRPMVDLTFGGVQFAMVNNHFPQFQSNPVPDNGLTLHRLSGYLARWAFTQMRSPIKQAEFRATVVVPLAEVKGCTWNDGDAMYLGFAAGAEMFLQTFTFFPLVIEMHRVLKDGMDVNFMKKVLRQRYGQKTAEQWMREEIVAVRAAFEAVGTLAWARTGFSPAARDFLRQFGIGI

SEQ ID NO: 813 - protein, 231 aa, Artificial Sequence
  derived and/or modified protein sequence (wt) from OROV(H758669)__HQ830479.1__N
MSEFIFNDVPQRTTSTFDPEAAYVAFEARYGQVLNAGVVRVFFLNQKKAKDVLRKTSRPMVDLTFGGVQFAILNNHFPQFQSNPVPDNGLTLHRLSGYLARWAFTQMRSPIKQAEFRATVVVPLAEVKGCTWNDGDAMYLGFAAGAEMFLQTFTFFPLVIEMHRVLKDGMDVNFMKKVLRQRYGQKTAEQWMREEIVAVRAAFEAVGTLAWARTGFSPAARDFLRQFGIGI

SEQ ID NO: 814 - protein, 231 aa, Artificial Sequence
  derived and/or modified protein sequence (wt) from OROV(H758687)__HQ830478.1__N
MSEFIFNDVPQRTTSTFDPEAAYVAFEARYGQVLNAGVVRVFFLNQKKAKDVLRKTSRPMVDLTFGGVQFAMVNNHFPQFQSNPVPDNGLTLHRLSGYLARWAFTQMRSPIKQAEFRATVVVPLAEVKGCTWNDGDAMYLGFAAGAEMFLQTFTFFPFVIEMHRVLKDGMDVNFMKKVLRQRYGQKTAEQWMREEIVAVRAAFEAVGTLAWARTGFSPAARDFLRQFGIGI

SEQ ID NO: 815 - protein, 231 aa, Artificial Sequence
  derived and/or modified protein sequence (wt) from OROV(H759041)__HQ830488.1__N
MSEFIFNDVPQRTTSTFDPEAAYVAFEARYGQVLNAGVVRVFFLNQKKAKDVLRKTSRPMVDLTFGGVQFAMVNNHFPQFQSNPVPDNGLTLHRLSGYLARWAFTQMRSPIKQAEFRATVVVPLAEVKGCTWNDGDAMYLGFAAGAEMFLQTFTFFPLVIEMHRVLNDGMDVNFMKKVLRQRYGQKTAEQWMREEIVAVRAAFEAVGTLAWARTGFSPAARDFLRQFGIGI

SEQ ID NO: 816 - protein, 231 aa, Artificial Sequence
  derived and/or modified protein sequence (wt) from OROV(BeAr473358)__AF164539.1__N
MSEFIFNDVPQRTTSTFDPEAAYVAFEARYGQVLNAGVVRVFFLNQKKAKDVLRKTSRPMVDLTFGGVQFAMVNNHFPQFQSNPVPDNGLTLHRLSGYLARWAFTHMRSPIKQAEFRATVVVPLAEVKGCTWNDGDAMYLGFAAGAEMFLQTFTFFPLVIEMHRVLKDGMDVNFMKKILRQRYGQKTAEQWMREEIIAVKTAFETVGTLAWAITGFSPAARNFLRQFEIDI

SEQ ID NO: 817 - protein, 231 aa, Artificial Sequence
  derived and/or modified protein sequence (wt) from OROV(BeH 521086)__AY704559.1__N
MSEFLFNDVPQRTTSTFDPEAAYVAFESRYGQVLNAGVVRVFFLNQKKAKDVLRKTSRPMVDLTFGGVQFTMVNNHFPQFQSNPVPDNGLTLHRLSGYLARWAFTQMRSPIKQAEFRATVVVPLAEVKGCTWNDGDAMYLGFAAGAEMFLQTFTFFPLVIEMHRVLKDGMDVNFMKKVLRQRYGQKTAEQWMREEIVAVRAAFEAVGTLAWARTGFSPAARDFLRQSGIGI

SEQ ID NO: 818 - protein, 231 aa, Artificial Sequence
  derived and/or modified protein sequence (wt) from OROV(BeH121923)__HM470110.1__N
MSEFIFNDVPQRTTSSFDPEAAYVAFEARYGQVLNACVVRVFFLNQKKAKDVLRKTSWPMVDLTFGRVQFAMVNNHFPQFQSNPVPDNGLALHRLSGYLARWAFTQMRSPIKQAEFRATVVVPLAEVKGCTWNDGDAMYLGFAAGAEMFLQTFTFFPLVIEMHRVLKDGMDVNFMKKVLRQRYGQKTAEQWMREEIVAVRAAFEAVGTLAWARTGFSPAARDFLRQFGIDI

SEQ ID NO: 819 - protein, 231 aa, Artificial Sequence
  derived and/or modified protein sequence (wt) from OROV(BeH379693)__AF164534.1__N
MSEFIFNDVPQRTTSTFDPEAAYVAFEARYGQVLNAGVVRVFFLNQKKAKDVLRRTSRPMVDLTFGGVQFAMVNNHFPQFQSNPVPDNGLTLHRLSGYLARWAFTQMRSPIKQAEFRATVVVPLAEVKGCTWNDGDAMYLGFAAGAEMFLQTFTFFPLVIEMHRVLKDGMDVNFMKKVLRQRYGQKTAEQWMREEIVAVRAAFEAVGTLAWARTGFSPAARDFLRQFGIGI

SEQ ID NO: 820 - protein, 231 aa, Artificial Sequence
  derived and/or modified protein sequence (wt) from OROV(BeH381114)__AF164535.1__N
MSEFIFNDVPQRTTSTFDPEAAYVAFEARYGQVLNAGVVRVFFLNQKKAKDVLRKTSRPMVDLTFGGVQFAMVNNHFPQFQSNPVPDNGLTLHRLSGYLARWAFTQMRSPIKQAEFRATVVVPLAEVKGCTWNDGDAMYLGFAAGAEMFLQTFTFFPLVIEMHRVLKDGMDVNFMKKVLRQRYGQKTAEQWMREEIVAVRAAFEAVGTLAWARTGFSPAARDFLRQFGICI

SEQ ID NO: 821 - protein, 231 aa, Artificial Sequence
  derived and/or modified protein sequence (wt) from OROV(BeH390233)__AF164536.1__N
MSEFIFNDVPQRTTSTFDPEAAYVAFEARYGQVLNAGVVRVFFLNQKKAKDVLRKTSRPMVDLTFGGVQFAMVNNHFPQFQSNPVPDNGLTLHRLSGYLARWAFTQMRSPIKQAEFRATVVVPLAEVKGCTWNDGDAMYLGFAAGAEMFLQTFTFFPLVIEMHRVLKDGMDVNFMKKVLRQRYGQKTAEQWMREEIVAVRAAFEAVGTLAWARTGFSPAARDFLGQFGIGI

SEQ ID NO: 822 - protein, 231 aa, Artificial Sequence
  derived and/or modified protein sequence (wt) from OROV(BeH472204)__AF164538.1__N
MSEFIFNDVPQRTTSTFDPEAAYVAFEARYGQVLNAGVVRVFFLNQKKAKDVLRKTSRPMVDLTFGGVQFAMVNNHFPQFQSNPVPDNGLTLHRLSGYLARWAFTQMRSPIKQAEFRATVVVPLAEVKGCTWNDGDAMYLGFAAGAEMFLQTFTFFPLVIEMHRVLKDGMDVNFMKKVLRQRYVQKTAEQWMREEIVAVRAAFEAVGTLAWARTGFSPAARDFLRQFGIGI

SEQ ID NO: 823 - protein, 231 aa, Artificial Sequence
  derived and/or modified protein sequence (wt) from OROV(BeH505442)__AF164542.1__N
MSEFIFNDVPQRTTSTFDPEAAYVAFEARYGQVLNAGVVRVFFLNQKKAKDVLRKTSRPMVDLTFGGVQFAMVNNHFPQFQSNPVPDNGLTLHRLSGYLARWAFTQMRSPIKQAEFRATVVVPLAEVKGCTWNDGDAMYLGFAAGAEMFLQAFTFFPLVIEMHRVLKDGMDVNFMKKVLRQRYGQKTAEQWMREEIVAVRAAFEAVGTLAWARTGFSPAARDFLRQFGIDI

SEQ ID NO: 824 - protein, 231 aa, Artificial Sequence
  derived and/or modified protein sequence (wt) from OROV(BeH541863)__AF164544.1__N
MSEFIFSDVPQRTTSTFDPEAAYVAFEARYGQVLNAGVVRVFFLNQKKAKDVLRKTSRPMVDLTFGGVQFAMVNNHFPQFQSNPVPDNGLTLHRLSGYLARWAFTQMRSPIKQAEFRATVVVPLAEVKGCTWNDGDAMYLGFAAGAEMFLQTFTFFPLVIEMHRVLKDGMDVNFMKKVLRQRYGQKTAEQWMREEIVAVRAAFEAVGTLAWARTGFSPAARNFLRQFGIGI

SEQ ID NO: 825 - protein, 231 aa, Artificial Sequence
  derived and/or modified protein sequence (wt) from OROV(BeH543033)__AF164545.1__N
MSEFIFNDVPQRTTSTFDPEAAYVAFEARYGQVLNAGVVRVFFLNQKKAKDVLRKTSRPMVDLTFGGVQFAMVNNHFPQFQSNPVPDNGLTLHRLSGYLARWAFTQMRSPIKQAEFRATVVVPLAEVKGCTWNDGDAMYLGFAAGAEMFLQTFTFFPLVIEMHRVLKDGMDVNFMKKVLRQRYGQKTAEQWMREEIVAVRAAFEAVGTLAWARTGFSPAAREFLRQFGIGI

SEQ ID NO: 826 - protein, 231 aa, Artificial Sequence
  derived and/or modified protein sequence (wt) from OROV(BeH543618)__AF164548.1__N
MQEFIFNDVPQRTTSTFDPEAAYVAFEARYGQVLNAGVVRVFFLNQKKAKDVLRKTSRPMVDLTFGGVQFAMVNNHFPQFQSNPVPDNGLTLHRLSGYLARWAFTQMRSPIKQAEFRATVVVPLAEVKGCTWNDGDAMYLGFAAGAEMFLQTFTFFPLVIEMHRVLKDGMDVNFMKKVLRQRYGQKTAEQWMREEIVAVRAAFEAVGTLAWARTGFSPAARDFLRQFGIGI

SEQ ID NO: 827 - protein, 231 aa, Artificial Sequence
  derived and/or modified protein sequence (wt) from OROV(BeH544552)__AF164546.1__N
MSEFIFNDVPQRTTSTFDPEAAYVAFEARYGQVLNAGVVRVFFLNQKKAKDVLRKTSRPMVDLTFGGVQFAMVNNHFPQFQSNPVPDNGLTLHRLSGYLARWAFTQMRSPIKQAEFRATVVVPLAEVKGCTWNDGDAMYLGFAAGAEMFLQTFTFFPLVIEMHRVLKDGMDVNFMKKVLRQRYGQKTAEQWMREEIVAVRAAFEAVGTLAWARTGFSPAARDFLRQIGIGI

SEQ ID NO: 828 - protein, 231 aa, Artificial Sequence
  derived and/or modified protein sequence (wt) from OROV(GML444911)__AF164556.1__N
MSEFIFNDVPQRTTSTFDPEAAYVAFEARYGQVLNAGVVRVFFLNQKKAKDVLRKTSRPMVDLTFGGVQFAMVNNHFPQFQSNPVPDNGLTLHRLSGYLARWAFTQMRSPIKQAEFRATVVVPLAEVKGCTWNDGDAMYLGFAAGAEMFLQTFTFFPLVIEMHRVLKDGMDVNFMKKVLRQRYGQKTAEQWMREEIVAVRAAFEAVGTLAWARTGFSPAARDFLRQFGIYI

SEQ ID NO: 829 - protein, 231 aa, Artificial Sequence
  derived and/or modified protein sequence (wt) from OROV(IQT4083)__AF164552.1__N
MSEFIFNDVPQRTTSTFDPEAAYVAFEARYGQVLNAGVVRVFFLNQKKAKDVLRKTSRPMVDLTFGGVQFAMVNNHFPQFQSNPVPDNGLTLHRLSGYLARWAFTQMRSPIKQAEFRATVVVPLAEVKGCTWNDGDAMYLGFAAGAEMFLQTFTFFPLVIEMHRVLKDGMDVNFMKKVLRQRYGKKTAEQWMREEIVAVRAAFEAVGTLAWARTGFSPAARDFLRQFGIDI

SEQ ID NO: 830 - protein, 231 aa, Artificial Sequence
  derived and/or modified protein sequence (wt) from OROV(PPS 522 H 669314)__EF467370.1__N
MSEFISNDVPHRTTSTFDPEAAYVAFEARYGQVLNAGVVRVFFLNQKKAKDVLRKTSRPMVDLTFGGVQFAMVNNHFPQFQSNPVPDNGLTLHRLSGYLARWAFTQMRSPIKQAEFRATVVVPLAEVKGCTWNDGDAMYLGFAAGAEMFLQTFTFFPLVIEMHRVLKDGMDVNFMKKVLRQRYGQKTAEQWMREEIVAVRAAFEAVGTLAWARTGFSPAARDFLRQFGICI

SEQ ID NO: 831 - protein, 231 aa, Artificial Sequence
  derived and/or modified protein sequence (wt) from OROV(TVP-19254/GML-480914)__KP795083.1__N
MSEFIFNDVPQRTTSTFDPEAAYVAFEARYGQVLSAGVVRVFFLNQKKAKDVLRKTSRPMVDLTFGGVQFAMVNNHFPQFQSNPVPDNGLTLHRLSGYLARWAFTQMRSPIKQAEFRATVVVPLAEVKGCTWNDGDAMYLGFAAGAEMFLQTFTFFPLVIEMHRVLKDGMDVNFMKKVLRQRYGQKTAEQWMREEIVAVRAAFEAVGTLAWARTGFSPAARDFLRQFGIDI

SEQ ID NO: 832 - protein, 231 aa, Artificial Sequence
  derived and/or modified protein sequence (wt) from OROV(TVP-19256/IQE-7894)__KP795086.1__N
MSEFIFNDVPQRTTSTFDPEAAYVAFEARYGQVLNAGVVRVFFLNQKKAKDVLRKTSRPMVDLTFGGVQFTMVNNHFPQFQSNPVPDNGLTLHRLSGYLARWAFTQMRSPIKQAEFRATVVVPLAEVKGCTWNDGDAMYLGFAAGAEMFLQTFTFFPLVIEMHRVLKDGMDVNFMKKVLRQRYGQKTAEQWMREEIVAVRAAFEAVGTLAWARTGFSPAARDFLRQFGIDI

SEQ ID NO: 833 - protein, 231 aa, Artificial Sequence
  derived and/or modified protein sequence (wt) from OROV(TVP-19258/IQT-4083)__KP795092.1__N
MSEFIFNDVPQRTTSTFDPEAAYVAFEARYGQVLNAGVVRVFFLNQKKAKDVLRKTSRPMVDLTFGGVQFAMVNNHFPQFQSNPVPDNGLTLHRLSGYLARWAFTQMRSPIKQAEFRGTVVVPLAEVKGCTWNDGDAMYLGFAAGAEMFLQTFTFFPLVIEMHRVLKDGMDVNFMKKVLRQRYGQKTAEQWMREEIVAVRAAFEAVGTLAWARTGFSPAARDFLRQFGIDI

SEQ ID NO: 834 - protein, 232 aa, Artificial Sequence
  derived and/or modified protein sequence (wt) from OROV/FPV(Aus Ch 16129)__AF362400.1__N
MTDFVFNDVPQRATSTFDPEAAYVAFENRFRANLTVDVARIFFLNQKKAKDRLAKTARATVDITFGGVVFPVVNNHYPEYQRNPVPDDGLTLHRLSGYLARWLIDQCNASPVRMTEIRTKVIIPLAEVKGCTWNDGASMYLGFAAGAEMFLQSFTFYPLVIEMQRVLKDGMDVNFMRKVLRQRYGTKTAEQWMRDDIVAVKTAFEAINTISWARSGFSPAAREFLRQFGINI

SEQ ID NO: 835 - protein, 231 aa, Artificial Sequence
  derived and/or modified protein sequence (wt) from OROV/IQTV(IQE3728/PER/06)__KF150535.1__N
MSEFIFNDVPQRTTSTFDPEAAYVAFEARYGQVLNAGVVRVFFLNQKKAKDVLRKTSRPMVDLTFGGVQFAMVNNHFPQFQSNPVPDNGLTLHRLSGYLARWAFTQMRSPIKQAEFRATVVVPLAEVKGCTWNDGDAMYLGFAAGTEMFLQTFTFFPLVIEMHRVLKDGMDVNFMKKVLRQRYGQKTAEQWMREEIVAVRAAFEAVGTLAWARTGFSPAARDFLRQFGIGI

SEQ ID NO: 836 - protein, 232 aa, Artificial Sequence
  derived and/or modified protein sequence (wt) from OROV/UTIV(Be An 84785)__KF697156.1__N
MAEFVFNDVPQRSTSTFDPEVAYATFEAAFRQTLNVNVVRVFFLNQKNAKNVLRKTSRPNVDLTFGGATFPIVNNHFPQFQSNPVPDNGLTLHRLSGYLARWSMDQMRTNPIRQAEFRAAVVVPLAEIKGCTWNDGDAMYLAFAAGAEMFLNTFTFFPLVIEMHRVLKDGMDVNFMRKVLRQRYGTKTAEQWMKDEIIPIKAAFEAVGMLSWARTGFSPAARDFLRQFGINV

SEQ ID NO: 837 - protein, 245 aa, Artificial Sequence
  derived and/or modified protein sequence (wt) from HRTV(TN)__KJ740146.1__N
MTDWSAIAVEIGNEPLDVPALVEFAKEIAYEGLDPAVILGLLRERGGENWRNDVKYIIVFALTRGNKIVKACGKMSKKGAERMTNLARVYELKENAVDRMAVTPVRVAQCLPTWTCAAAAAIKEYLPVGPAIMHNKIQGYPLEMMCMAFGSLIPQADVSIEVIKDFMDAYSLWQDTFARTINVDQRKMTKAEVYAKFRDPLHAAVNSLFFPNATRISWLQAKGLLTATKEASGSVKAAAAAYRNM

SEQ ID NO: 838 - protein, 245 aa, Artificial Sequence
  derived and/or modified protein sequence (wt) from HRTV(Patient1)__JX005842.1__N
MTDWSAIAVEIGNEPLDVPALVEFAKEIAYEGLDPAVIFGLLRERGGENWRNDVKYIIVFALTRGNKIVKACGKMSKKGAERMTNLARVYELKENAVDRMAVTPVRVAQCLPTWTCAAAAAIKEYLPVGPAIMHNKIQGYPLEMMCMAFGSLIPQADVSIEVIKDFMDAYSLWQDTFARTINVDQRKMTKAEVYAKFRDPLHAAVNSLFFPNATRISWLQAKGLLTATKEASGSVKAAAAAYRNM

SEQ ID NO: 839 - protein, 245 aa, Artificial Sequence; identical to SEQ ID NO: 837
  derived and/or modified protein sequence (wt) from HRTV(Patient2)__JX005843.1__N

SEQ ID NO: 840 - protein, 243 aa, Artificial Sequence
  derived and/or modified protein sequence (wt) from PTV(PAN472868)__NC_027202.1__N
MSYEEIAVQFASESIDEQAVAGWVTDFAYQGFDAKRVIALVKDRGGEDWKQDVKKMIVLSLTRGNKPNKMVLKMSDKGKAMVNELVLKYKLKSGNPSRDDLTLSRITAAFAGWTCQAADYVQEYLPVTGRAMDAISSSYPRAMMHPSFAGLIDQELPADVLSEITQAHCLFMIQFSKTINPSLRGLSKDEIVSSFERPMQAAISSTFLTSANRRAMLKTLGIINDNLKPSSSTVSAAKVFRSL

SEQ ID NO: 841 - protein, 243 aa, Artificial Sequence
  derived and/or modified protein sequence (wt) from PTV(Adames)__KR912210.1__N
MSYEEIAVQFASESIDEQAVAGWVTDFAYQGFDAKRVIALVKERGGEDWKQDVKKMIVLSLTRGNKPNKMVLKMSDKGKAMVNELVLKYKLKSGNPSRDDLTLSRITAAFAGWTCQAADYVQEYLPVTGRAMDTISSGYPRAMMHPSFAGLIDQELPADVLSEITQAHCLFMIQFSKTINPSLRGLSKDEIVSSFERPMQAAISSTFLTSANRRAMLKTLGIINDNLKPSSSTVSAAKVFRSL

SEQ ID NO: 842 - protein, 243 aa, Artificial Sequence
  derived and/or modified protein sequence (wt) from PTV(Balliet)__KR912211.1__N
MSYEEIAVQFASESIDEQTVAGWVTDFAYQGFDAKRVIALVKDRGGEDWKQDVKKMIVLSLTRGNKPNKMILKMSDKGKAMVNELVLKYKLKSGNPSRDDLTLSRITAAFAGWTCQAADYVQEYLPVTGRAMDAISSSYPRAMMHPSFAGLIDQELPADVFSEITQAHCLFMIQFSKTINPSLRGLSKDEIVSSFERPMQAAISSTFLTSANRRAMLKTLGIINDNLKPSSSTVSAAKVFRSL

SEQ ID NO: 843 - protein, 243 aa, Artificial Sequence
  derived and/or modified protein sequence (wt) from PTV(PaAR2381)__KP272006.1__N
MSYEEIAVQFASESIDEQAVAGWVTDFAYQGFDAKRVIALVKDRGGDDWKQDVKKMIVLSLTRGNKPNKMVLKMSDKGKAMVNELVLKYKLKSGNPSRDDLTLSRITAAFAGWTCQAADYVQEYLPVTGRAMDAISSSYPRAMMHPSFAGLIDQELPADVLSEITQAHCLFMIQFSKTINPSLRGLSKDEIVSSFERPMQAAISSTFLTSANRRAMLKTLGIINDNLKPSSSTVSAAKVFRSL

SEQ ID NO: 844 - protein, 243 aa, Artificial Sequence
  derived and/or modified protein sequence (wt) from PTV(GML902876)__KP272012.1__N
MSYEEIAVQFASESIDEQAVAGWVTDFAYQGFDAKRVIALVKDRGGDDWKQDVKKMIVLSLTRGNKPNKMVLKMSDKGKAMVNELVLKYKLKSGNPSRDDLTLSRITAAFAGWTCQAADYVQEYLPVTGRAMDAISSSYPRAMMHPSFAGLIDQELPADVLSEITQAHCLFMIQFSKTINPSLRGLSKDEIVSSFERPMQAAISSTFLTSANRRAMLKTLGIINDNLKPSSSTASAAKVFRSL

SEQ ID NO: 845 - protein, 243 aa, Artificial Sequence
  derived and/or modified protein sequence (wt) from PTV(Adames)__KP272030.1__N
MSYEEIAVQFASESIDEQAVAGWVTHFAYQGFDAKRVIALVKERGGEDWKQDVKKMIVLSLTRGNKPNKMVLKMSDKGKAMVNELVLKYKLKSGNPSRDDLTLSRITAAFAGWTCQAADYVQEYLPVTGRAMDTISSGYPRAMMHPSFAGLIDQELPADVLSEITQAHCLFMIQFSKTINPSLRGLSKDEIVSSFERPMQAAISSTFLTSANRRAMLKTLGIINDNLKPSSSTVSAAKVFRSL

SEQ ID NO: 846 - protein, 244 aa, Artificial Sequence
  derived and/or modified protein sequence (wt) from Phlebovirus(CoAr171616)__HM566153.1__N
MSYEEIAVNFASESIDESTISAWVSDFAYQGFDAKRVIALIKERGGENWKEDVKKMIVLSLTRGNKPAKMILKMSDKGKKEVNDLITRYKLKSGNPSRDDLTLSRVAAAFAGWTCQAAEYVQEYLPVTGRAMDAFSADFPRALMHPSFAGLIDQELPSSAMTDIVHAHCLFMIQFSKTINPTIRSASKDEIVASFDRPMQAAINSTFLTSAQRRAMLKTLGVINDNLKVSTAVSSAAKAFKKLQ

SEQ ID NO: 847 - protein, 244 aa, Artificial Sequence
  derived and/or modified protein sequence (wt) from Phlebovirus(CoAr171616)__EF201836.1__N
MSYEEIAIHFASESIDESTISAWVSDFAYQGFDAKRVIALIKERGGENWKEDVKKMIVLSLTRGNKPAKMILKMSDKGKKEVNDLITRYKLKSGNPSRDDLTLSRVAAAFAGWTCQAAEYVQEYLPVTGRAMDAFSADFPRALMHPSFAGLIDQELPSSAMTDIVHAHCLFMIQFSKTINPTIRSASKDEIVASFDRPMQAAINSTFLTSAQRRAMLKTLGVINDNLKVSTAVSSAAKAFKKLQ

SEQ ID NO: 848 - protein, 243 aa, Artificial Sequence
  derived and/or modified protein sequence (wt) from Phlebovirus(CoAr170255)__EF201840.1__N
MSYEEIAIQFASESVDATTIAAWVSEFAYQGFDARQVINLVKQRGGDDWKEDVKKMIVLSLTRGNKPSKMLNKMSESGQKIVNDLISKYKLKSGNPGRNDLTLSRIAAAFAGWTCQAAEVVQDYLPVTGRAMDAISDKFPRALMHPSFAGLVDPTLPEGVVEDIVHAHCLFMIQFSKTINPSLRSSSKSEVVSSFDRPMQAAINSPFLTAGNRRDILMSLGLINSNLKPSPAVIAAAKVYRKL

SEQ ID NO: 849 - protein, 243 aa, Artificial Sequence
  derived and/or modified protein sequence (wt) from Buenaventura virus(CoAr3319)__KP272003.1__N
MSYEEIAIQFASESVDATTIAAWVSEFAYQGFDARQVINLVKQRGGDDWKEDVKKMIVLSLTRGNKPSKMLNKMSESGQKIVNDLISKYKLKSGNPGRNDLTLSRIAAAFAGWTCQAAEVVQDYLPVTGRAMDAISDKFPRALMHPSFAGLVDPTLPEGVVEDIVHAHCLFMIQFSKTINPSLRSSSKSEVVSSFDRPMQAAINSPFLTAGNRRDILMSLGLINSNLKPSPTVVAAAKVYRKL

SEQ ID NO: 850 - protein, 243 aa, Artificial Sequence
  derived and/or modified protein sequence (wt) from Cocle virus(GML244915)__KP272035.1__N
MSYEEIAVQFASESIDEQAVAGWVTDFAYQGFDARRVIALVKDRGGEDWKQDVKKMIVLSLTRGNKPNKMVLKMSDKGKAMVNELVLKYKLKSGNPSRDDLTLSRITAAFAGWTCQAADYVQEYLPVTGRAMDAISSGYPRAMMHPSFAGLIDQELPADVLSEITQAHCLFMIQFSKTINPSLRGLGKDEIVSSFERPMQAAISSTFLTSANRRAMLKTLGIINDNLKPSSSTVSAAKVFRSL

SEQ ID NO: 851 - protein, 243 aa, Artificial Sequence
  derived and/or modified protein sequence (wt) from Capira virus(VP-366G)__KP272044.1__N
MSYEEIAIQFASESIDESTIAAWVSDFAYQGFDAKQVIILIKKRGGENWKEDVKKMIVLSLTRGNKPSKMVNKMSDEGKKVVNELISKYKLKTGNPARDDLTLSRIAAAFAGWTCQAAEYVQDYLPVTGRAMDALSDKYPRALMHPSFAGLIDPTLPDDAVKDIVHAHCLFMIQFSKTINPSLRSSTKTEIVNSFDRPMQAAINSPFLTAENRRAMLTTLGVINSNLKPSAAVVAAAKAYRKL

SEQ ID NO: 852 - protein, 243 aa, Artificial Sequence
  derived and/or modified protein sequence (wt) from Campana virus(VP-334K)__KP272042.1__N
MSYEEIAIQFASESVDATTIAAWVSEFAYQGFDARQVINLVKQRGGDDWKEDVKKMIVLSLTRGNKPSRMVTKMSESGQKIVNDLISKYKLKSGNPGRNDLTLSRVAAAFAGWTCQAAEVVQDYLPVTGRAMDALSDKFPRAIMHPSFAGLIDPTLPENVVEDIVHAHCLFMIQFSKTINPSLRSSSKSEVVSSFDRPMQAAINSPFLTAANRRDMLMSLGLISSNLKPSAAVTAAAKAYRKL

SEQ ID NO: 853 - protein, 245 aa, Artificial Sequence
  derived and/or modified protein sequence (wt) from RVFV(ZH-548)__DQ380151.1__N
MDNYQELAIQFAAQAVDRNEIEQWVREFAYQGFDARRVIELLKQYGGADWEKDAKKMIVLALTRGNKPRRMMMKMSKEGKATVEALINKYKLKEGNPSRDELTLSRVAAALAGWTCQALVVLSEWLPVTGTTMDGLSPAYPRHMMHPSFAGMVDPSLPGDYLRAILDAHSLYLLQFSRVINPNLRGRTKEEVAATFTQPMNAAVNSNFISHEKRREFLKAFGLVDSNGKPSAAVMAAAQAYKTAA

SEQ ID NO: 854 - protein, 245 aa, Artificial Sequence
  derived and/or modified protein sequence (wt) from RVFV(OV 35/74)__EF530207.1__N
MDNYQELAIQFAAQAVDRNEIEQWVREFAYQGFDARRVIELLKQYGGADWEKDAKKMIVLALTRGNKPRRMMMKMSKEGKATVEALINKYKLKEGNPSRDELTLSRVAAALAGWTCQALVVLSEWLPVTGTTMDGLSPAYPRHMMHPSFAGMVDPSLPEDYLRAILDAHSLYLLQFSRVINPNLRGRTKEEVAATFTQPMNAAVNSNFISHEKRREFLKAFGLVDSNGKPSAAVMAAAQAYKTAA

SEQ ID NO: 855 - protein, 253 aa, Artificial Sequence
  derived and/or modified protein sequence (wt) from SFNV(Toscana)__NC_006318.1__N
MSDENYRDIALAFLDESADSGTINAWVNEFAYQGFDPKRIVQLVKERGTAKGRDWKKDVKMMIVLNLVRGNKPEAMMKKMSEKGASIVANLISVYQLKEGNPGRDTITLSRVSAAFVPWTVQALRVLSESLPVSGTTMDAIAGVTYPRAMMHPSFAGIIDLDLPNGAGATIADAHGLFMIEFSKTINPSLRTKQANEVAATFEKPNMAAMSGRFFTREDKKKLLIAVGIIDEDLVLASAVVRSAEKYRAKVGK

SEQ ID NO: 856 - protein, 253 aa, Artificial Sequence
  derived and/or modified protein sequence (wt) from SFNV__HM566170.1__N
MSEENYREIALAFLDEAADSGTITAWVNEFAYQGFDPKRIVQLVKERGTAKGRDWKKDVKMMIVLNLVRGNKPEAMMKKMSEKGAGIVAQLISVYQLKEGNPGRDTITLSRVSAAFVPWTIQALRVLSDSLPVTGTTMDAIAGVTYPRAMMHPSFAGIIDLDLPNRAGEVIADAHGLFMLEFSKTINPSLRTKQPNEIAATFEKPNMAAMSGRFFTREDKKKLLMAVGILNEDLVLTPAIVKCAEKYCSKVGK

SEQ ID NO: 857 - protein, 244 aa, Artificial Sequence; identical to SEQ ID NO: 846
  derived and/or modified protein sequence (wt) from SFNV(Namru)__HM566168.1__N

SEQ ID NO: 858 - protein, 253 aa, Artificial Sequence
  derived and/or modified protein sequence (wt) from SFNV(NAMRU 840055)__EF201828.1__N
MSEENYREIALAFLDEAADSGTITAWVNEFAYQGFDPKRIVQLVKERGTAKGRDWKKDVKMMIVLNLVRGNKPEAMMKKMSEKGAGIVAQLISVYQLREGNPGRDTITLSRVSAAFVPWTIQALKVLSDSLPVTGTTMDAIAGVVYPRAMMHPSFAGIIDLDLPNRAGEAIADAHGLFMLEFSKTINPSLRTKQPNEIAATFEKPNMAAMSGRFFTREDKKKLLMAVGILNEDLVLTPAIVKCAEKYRSKVGK

SEQ ID NO: 859 - protein, 253 aa, Artificial Sequence
  derived and/or modified protein sequence (wt) from SFNV(NAMRU 840055)__EF201829.1__N
MSEENYREIALAFLDEAADSGTITAWVNEFAYQGFDPKRIVQLVKERGTAKGRDWKKDVKMMIVLNLVRGNKPEAMMKKMSEKGAGIVAQLISVYQLKEGNPGRDTITLSRVSAAFVPWTIQALRVLSDSLPVTGTTMDAIAGVTYPRAMMHPSFAGIIDLDLPNRAGEAIADAHGLFMLEFSKTINPSLRTKQPNEIAATFEKPNMAAMSGRFFTREDKKKLLMAVGILNEDLVLTPAIVKCAEKYCSKVGK

SEQ ID NO: 860 - protein, 253 aa, Artificial Sequence
  derived and/or modified protein sequence (wt) from SFNV(P-7101795)__EF201830.1__N
MSEENYREIALAFLNEAADSGTITAWVNEFAYQGFDPKRIVQLVKERGTAKGRDWKKDVKMMIVLNLVRGNKPETMMKKMSEKGAGIVAQLISVYQLKEGNPGRDTITLSRVSAAFVPWTVQALRVLSDSLPVTGTTMDAIAGVTYPRAMMHPSFAGIIDLDLPNRAGETIADAHGLFMLEFSKTINPSLRTKQPNEIAATFEKPNMAAMSGRFFTREDKKKLLMAVGVLNEDLVLTPAIVKCAEKYRSKVGK

SEQ ID NO: 861 - protein, 253 aa, Artificial Sequence
  derived and/or modified protein sequence (wt) from SFNV(P-7101795)__EF201832.1__N
MSEENYREIALAFLDEAADSGTITAWVNEFAYQGFDPKRIVQLVKERGTAKGRDWKKDVKMMIVLNLVRGNKPEAMMKKMSEKGAGIVAQLISVYQLREGNPGRDTITLSRVSAAFVPWTIQALKVLSDSLPVTGTTMDAIAGVMYPRAMMHPSFAGIIDLDLPNRAGEAIADAHGLFMLEFSKTINPSLRTKQPNEIAATFEKPNMAAMSGRFFTREDKKKLLMAVGILNEDLVLTPAIIKCAEKYRSKVGK

SEQ ID NO: 862 - protein, 253 aa, Artificial Sequence
  derived and/or modified protein sequence (wt) from Arrabida virus(PoSFPhlebV/126/2008)__KP863801.1__N
MSEDNYRTIALAFLDESADSTTINAWVNEFAYQGFDPKRIVQLVKERGTAKGRDWKKDVKMMIVLNLVRGNKPESMMKKMSEKGAAIVTQLISTYQLKEGNPGRDTITLSRVSAAFVPWTVQALKTLSESLPVTGTTMDSIAGTTYPRCMMHPSFAGIIDLELPNNTGAMLADAHGLFMLEFSKTINPSLRTKQPNEIAATFEKPNMAAMTGRFFTRDDKKKLLIAIGVLDEDLVPNPAIEKCAEKYKAKVGK

SEQ ID NO: 863 - protein, 254 aa, Artificial Sequence
  derived and/or modified protein sequence (wt) from Gordil virus(Dak ANBr 496d)__KF297902.1__N
MSEENYREIAMAFANDSADFNMISVWANDFAYQGFDPKRIVELVRQRGLAKARNWKQDVKMMIVLNLMRGNKPEAMVRKMQEKGQRIVLELISVYELKEGNPGRDTITLSRVSAAFVPWTIMALRQLAENIPVTGSIMDSILDGAVYPRAMMHPSFAGIIDLELPEGRGAELADAHGLFMIEFSKTINPSLRTKSAIEIAASFEKPNMAAMTGNFFTKDDKRKLLKQIGILDSDLKLTPVIEKAAALYRSKTNK

SEQ ID NO: 864 - protein, 253 aa, Artificial Sequence
  derived and/or modified protein sequence (wt) from Granada virus(GR25)__GU135608.1__N
MSEDNYRTIALAFLDESADSTTINAWVNEFAYQGFDPKRIVQLVKERGTAKGRDWKKDVKMMIVLNLVRGNKPESMMKKMSEKGAAIVTQLISTYQLKEGNPGRDTITLSRVSAAFVPWTVQALKTLSESLPVTGTTMDSIAGTTYPRCMMHPSFAGIIDLELPNNTGAMLADAHGLFMLEFSKTINPSLRTKQPNEIAATFEKPNMAAMTGRFFTRDDKKKLLIAIGVLNEDLVPNPAIEKCAEKYKAKVGK

SEQ ID NO: 865 - protein, 253 aa, Artificial Sequence
  derived and/or modified protein sequence (wt) from Massilia virus(127)__KT906102.1__N
MSEDNYRTIALSFLDETAVSTSINACVNEFAYQGFDPKRIVQLVKERGTAKGRDWKKDVKMMIVLNLVRGNKPESMMKKMSEKGAAIVTQLISTYQLKEGNPGRDTITLSRVSAAFVPWTVQALKTLSESLPVTGTTMDSIAGTTYPRCMMHPSFAGIIDLELPNNTGAMLADAHGLFMLEFSKTINPSLRTKQPNEIAATFEKPNMAAMTGRFFTRDDKKKLLIAIGVLDEDLVPNPAIEKCAEKYKAKVGK

SEQ ID NO: 866 - protein, 253 aa, Artificial Sequence
  derived and/or modified protein sequence (wt) from Massilia virus(130)__KT906103.1__N
MSEDNYRTIALSFLDETADSTSINACVNEFAYQGFDPKRIVQLVKERGTAKGRDWKKDVKMMIVLNLVRGNKPESMMKKMSEKGAAIVTQLISTYQLKEGNPGRDTITLSRVSAAFVPWTVQALKTLSESLPVTGTTMDSIAGTTYPRCMMHPSFAGIIDLELPNNTGAMLADAHGLFMLEFSKTINPSLRTKQPNEIAATFEKPNMAAMTGRFFTRDDKKKLLIAIGVLDEDLVPNPAIEKCAEKYKAKVGK

SEQ ID NO: 867 - protein, 253 aa, Artificial Sequence
  derived and/or modified protein sequence (wt) from Naples virus(Yu 8/76)__JF920141.1__N
MSEDDYHKIALAFAEESADVSTIESWVNDFAYQGFDPRRIVQLVKERGTAKGRDWKKDVKMMIVLNLVRGNKPEAMMKKMSEKGAAIVAQLISVYQLKEGNPGRDTITLSRVSAAFVPWTVQALRVLSDHLPVTGTTMDAIAGVTYPRAMMHPSFAGIVDLELPRKTGEMIADAHGLFMLEFSKTINPSLRTKQPNEIATTFEKPNMAAMSGKFFSREDKKKLLMSVGIINDDLLLTASVVKCAEKYRAKTGK

SEQ ID NO: 868 - protein, 253 aa, Artificial Sequence
  derived and/or modified protein sequence (wt) from Punique virus(P1_B4_2008)__FJ848987.1__N
MSEENYREIALAFLDESADSGTISTWVNDFAYQGFDPKRIVQLVKERGTAKGRDWKKDVKMMIVLNLVRGNKPESMMKKMSEKGAAIVAQLIAAYQLKEGNPGRDTITLSRVSAAFVPWTVQALRSLSDSLPVTGTTMDSIAGVTYPRCMMHPSFAGIIDLDLPNDTGAMLADAHGLFMLEFSKTINPSLRTKQANEIAATFEKPNMAAMNGRFFTREDKKKLLIAIGVLNEDLIPVSAIAKCAEKYRAKVGK

SEQ ID NO: 869 - protein, 253 aa, Artificial Sequence
  derived and/or modified protein sequence (wt) from Saint Floris virus(Dak ANB512)__JF920138.1__N
MSEETYAQLAMAFLAEPADWSTLSVWVNEFAYQGFDPKRIVELIMERGKKFNREWKKDVKMMITLNLIRGNKPEAMMRKMSDKGRSIVSELISVYELKEGNPGRDTITLSRVSAAFVPWTVRALVALQNDLPVTGAAMDSICGVTYPRAMMHPSFAGVIDLELPNGVGAQLADAHGLFMLEFSKTINPGLRTKQPNEIAATFEKPNLAAMTGKFFTKEDKRKVLISVGVINSDLQPNSVVKTCAELYRARVMK

SEQ ID NO: 870 - protein, 253 aa, Artificial Sequence
  derived and/or modified protein sequence (wt) from Tehran virus(I-47)__JF939848.1__N
MSEEDYRAIALSFSDESADVGIITTWVNEFAYQGFDPKRIVQLVKERGQAKGRDWKKDVKMMIVLNLIRGNKPDAMMKKMSEKGAATVAQLVSVYQLKEGNPGRDTITLSRVSAAFVPWTVQALKVLSESLPVTGTTMDTVAGVTYPRAMMHPSFAGIIDLELPGRAGEAIADAHGLFMLEFSKTINPSLRTKQPNEIAATFEKPNMAAMTGRFFTREDKKKLLIAVGIINDDLLLTPSIAKCAEKYRAKVGK

SEQ ID NO: 871 - protein, 253 aa, Artificial Sequence
  derived and/or modified protein sequence (wt) from Zerdali virus(37)__KP966618.1__N
MSEEDYRAIALSFSDEAADVGTITAWVNEFAYQGFDPKRIVQLVRERGIAKGRDWKKDVKMMIVLNLIRGNKPDAMMKKMSEKGAATVAQLVSVYQLKEGNPGRDTITPSRVSAAFVPWTVQALKVLSESLPVTGTTMDTIAGVSYPRAMMHPSFAGIIDLELPRRAGEVIADAHGLFMLEFSKTINPSLRTKQPNEIAATFEKPNMAAMTGRFFTREDKKKLLIAVGIINDDLLLAPSVAKCAEKYRAKVGK

SEQ ID NO: 872 - protein, 253 aa, Artificial Sequence; identical to SEQ ID NO: 855
  derived and/or modified protein sequence (wt) from TOSV(9028)__KU904263.1__N

SEQ ID NO: 873 - protein, 253 aa, Artificial Sequence
  derived and/or modified protein sequence (wt) from TOSV(SI-121283)__JF330274.1__N
MSDENYRDIALAFLDESADSGTINAWVNEFAYQGFDPKRIVQLVKERGTAKGRDWKKDVKMMIVLNLVRGNKPEAMMKKMSEKGASIVANLISVYQLKEGNPGRDTITLSRVSAAFVPWTVQALRVLSESLPVSGTTMDAIAGVTYPRAMMHPSFAGIIDLDLPNGAGATIADAHGLFMIEFSKTINPSLRTKQANEVAATFENPNMAAMSGRFFTREDKKKLLIAVGIIDEDLVLASAVVRSAEKYRAKVGK

SEQ ID NO: 874 - protein, 253 aa, Artificial Sequence
  derived and/or modified protein sequence (wt) from TOSV(5963930705)__KU935733.1__N
MSDENYRDIALAFLDESADSGTINAWVNEFAYQGFDPKRIVQLVKERGTAKGRDWKKDVKMMIVLNLVRGNKPEAMMKKMSEKGASIVANLISVYQLKEGNPGRDTITLSRVSAAFVPWTVQALRVLSESLPVSGTTMDAIAGVTYPRAMMHPSFAGIIDLDLPNGAGATIADAHGLFMVEFSKTINPSLRTKQANEVAATFEKPNMAAMSGRFFTREDKKKLLIAVGIIDEDLVLASAVVRSAEKYRAKVGK

SEQ ID NO: 875 - protein, 253 aa, Artificial Sequence
  derived and/or modified protein sequence (wt) from TOSV(MRS2010-4319501)__KC776214.1__N
MSDENYRDIALAFLDESADSGTINAWVNEFAYQGFDPKRIVQLVKERGTAKGRDWKKDVKMMIVLNLVRGNKPEAMMKKMSEKGASIVANLISVYQLKEGNPGRDTITLSRVSAAFVPWTVQALRVLSESLPVSGTTMDAIAGVTYPRAMMHPSFAGIIDLHLPNGAGATIADAHGLFMIEFSKTINPSLRTKQANEVAATFEKPNMAAMSGRFFTREDKKKLLIAVGIIDEDLVLASAVVRSAEKYRAKVGK

SEQ ID NO: 876 - protein, 253 aa, Artificial Sequence
  derived and/or modified protein sequence (wt) from TOSV(TOSV/Firenze.ITA/1983/2)__KM275765.1__N
MSDENYRDIALAFLDECADSGTINAWVNEFAYQGFDPKRIVQLVKERGTAKGRDWKKDVKMMIVLNLVRGNKPEAMMKKMSEKGASIVANLISVYQLKEGNPGRDTITLSRVSAAFVPWTVQALRVLSESLPVSGTTMDAIAGVTYPRAMMHPSFAGIIDLDLPNGAGATIADAHGLFMIEFSKTINPSLRTKQANEVAATFEKPNMAAMSGRFFTREDKKKLLIAVGIIDEDLVLASAVVRSAEKYRAKVGK

SEQ ID NO: 877 - protein, 245 aa, Artificial Sequence
  derived and/or modified protein sequence (wt) from SFTSV(HB29)__NC_018137.1__N
MSEWSRIAVEFGEQQLNLTELEDFARELAYEGLDPALIIKKLKETGGDDWVKDTKFIIVFALTRGNKIVKASGKMSNSGSKRLMALQEKYGLVERAETRLSITPVRVAQSLPTWTCAAAAALKEYLPVGPAVMNLKVENYPPEMMCMAFGSLIPTAGVSEATTKTLMEAYSLWQDAFTKTINVKMRGASKTEVYNSFRDPLHAAVNSVFFPNDVRVKWLKAKGILGPDGVPSRAAEVAAAAYRNL

SEQ ID NO: 878 - protein, 245 aa, Artificial Sequence
  derived and/or modified protein sequence (wt) from SFTSV(111S)__KP339904.1__N
MSEWSRIAVEFGEQQLNLTELEDFARELAYEGLDRALIIKKLKETGGDDWVKDTKFIIVFALTRGNKIVKASGKMSNSGSKRLMALQEKYGLVERAETRLSITPVRVAQSLPTWTCAAAAALKEYLPVGPAVMNLKVENYPPEMMCMAFGSLIPTAGVSEATTKTLMEAYSLWQDAFTKTINVKMRGASKTEVYNSFRDPLHAAVNSVFFPNDVRVKWLKAKGILGPDGVPSRAAEVAAAAYRNL

SEQ ID NO: 879 - protein, 245 aa, Artificial Sequence
  derived and/or modified protein sequence (wt) from SFTSV(116S)__KP339905.1__N
MSEWSRIAVEFGEQQLNLTELEDFARELAYEGLDPALIIKKLKETGGDDWVKDTKFIIVFALTRGNKIVKASGKMSNSGSKRLMALQEKYGLVERAETRLSITPVRVAQSLPTWTCAAAAALKEYLPVGPAVMNLKVENYPPEMMCMAFGSLIPTAGVSEATTKTLMEAYSLWQDAFTKTINVKMRGASKTEIYNSFRDPLHAAVNSVFFPNDVRVKWLKAKGILGPDGVPSRAAEVAAAAYRNL

SEQ ID NO: 880 - protein, 245 aa, Artificial Sequence
  derived and/or modified protein sequence (wt) from SFTSV(132S)__KP339912.1__N
MSEWSRIAVEFGEQQLNLTELEDFARELAYEGLDPALIIKKLKETGGDDWVKDTKFISVFALTRGNKIVKASGKMSNSGSKRLMALQEKYGLVERAETRLSITPVRVAQSLPTWTCAAAAALKEYLPVGPAVMNLKVENYPPEMMCMAFGSLIPTAGVSEATTKTLMEAYSLWQDAFTKTINVKMRGASKTEVYNSFRDPLHAAVNSVFFPNDVRVKWLKAKGILGPDGVPSRAAEVAAAAYRNL

SEQ ID NO: 881 - protein, 245 aa, Artificial Sequence
  derived and/or modified protein sequence (wt) from SFTSV(2014045S)__KR075923.1__N
MSEWSRIAVEFGEQQLNLTELEDFARELAYEGLDPALIIKKLKETGGDDWVKDTKFIIVFALTRGNKIVKASGKMSNSGSKRLMALQEKYGLVERAETRLSITPVRVAQSLPTWTCAAAAALKEYLPVGPAVMNLKVENYPPEMMCMAFGSLIPTAGVSEATTKTLMEAYSLWQDAFTKTINVKMRGASKTEVYNSFRDPLHAAVNSVFFPNDVRVKWLKAKGILGPDGAPSRAAEVAAAAYRNL

SEQ ID NO: 882 - protein, 245 aa, Artificial Sequence
  derived and/or modified protein sequence (wt) from SFTSV(2014193S)__KR075916.1__N
MSEWSRIAVEFGEQQLNLTELEDFARELAYEGLDPALIIKKLKETGGDDWVKDTKFIIVFALTRGNKIVKASGKMSNSGSKRLMALQEKYGLVERAETRLSVTPVRVAQSLPTWTCAAAAALKEYLPVGPAVMNLKVENYPPEMMCMAFGSLIPTAGVSEATTKTLMEAYSLWQDAFTKTINVKMRGASKTEVYNSFRDPLHAAVNSVFFPNDVRVKWLKAKGILGPDGVPSRAAEVAAAAYRNL

SEQ ID NO: 883 - protein, 245 aa, Artificial Sequence
  derived and/or modified protein sequence (wt) from SFTSV(2015SH232S)__KT736097.1__N
MSEWSRIAVEFGEQQLNLTELEDFARELAYEGLDPALIIKKLKETGGDDWVKDTKFIIVFALTRGNKIVKASGKMSNSGSKRLMALQEKYGLVERAETRLSITPVRVAQSLPTWTCAAAAALKEYLPVGPAVMNLKVENYPPEMMCMAFGSLIPTAGVSEATTKTLMEAYSLWQDAFTKTINVKMRGASKTEVYNSFRDPLHAAVNSVFFPNDVRVRWLKAKGILGPDGVPSRAAEVAAAAYRNL

SEQ ID NO: 884 - protein, 245 aa, Artificial Sequence; identical to SEQ ID NO: 877
  derived and/or modified protein sequence (wt) from SFTSV(2015SYSH33)__KT380653.1__N

SEQ ID NO: 885 - protein, 245 aa, Artificial Sequence
  derived and/or modified protein sequence (wt) from SFTSV(2015SYSH86)__KT380657.1__N
MSEWSRIAVEFGEQQLNLTELEDFARELAYEGLDPALIIKKLKETGGDDWVKDTKFIIVFALTRGNKIIKASGKMSNSGSKRLMALQEKYGLVERAETRLSITPVRVAQSLPTWTCAAAAALKEYLPVGPAVMNLKVENYPPEMMCMAFGSLIPTAGVSEATTKTLMEAYSLWQDAFTKTINVKMRGASKTEVYNSFRDPLHAAVNSVFFPNDVRVKWLKAKGILGPDGVPSRAAEVAAAAYRNL

SEQ ID NO: 886 - protein, 245 aa, Artificial Sequence
  derived and/or modified protein sequence (wt) from SFTSV(67S)__KP339890.1__N
MSEWSRIAVEFAEQQLNLTELEDFARELAYEGLDPALIIKKLKETGGDDWVKDTKFIIVFALTRGNKIVKASGKMSNSGSKRLMALQEKYGLVERAETRLSITPVRVAQSLPTWTCAAAAALKEYLPVGPAVMNLKVENYPPEMMCMAFGSLIPTAGVSEATTKTLMEAYSLWQDAFTKTINVKMRGASKTEVYNSFRDPLHAAVNSVFFPNDVRVKWLKAKGILGPDGVPSRAAEVAAAAYRNL

SEQ ID NO: 887 - protein, 245 aa, Artificial Sequence
  derived and/or modified protein sequence (wt) from SFTSV(6S)__KP339927.1__N
MSEWSRIAVEFGEQQLNLTELEDFARELAYEGLDPALIIKKLKETGGDDWVKDTKFIIVFALTRGNKIVKASGKMSNSGSKRLMALQEKYGLVERAETRFSITPVRVAQSLPTWTCAAAAALKEYLPVGPAVMNLKVENYPPEMMCMAFGSLIPTAGVSEATTKTLMEAYSLWQDAFTKTINVKMRGASKTEVYNSFRDPLHAAVNSVFFPNDVRVKWLKAKGILGPDGVPSRAAEVAAAAYRNL

SEQ ID NO: 888 - protein, 245 aa, Artificial Sequence
  derived and/or modified protein sequence (wt) from SFTSV(72S)__KP339891.1__N
MSEWSRIAVEFGEQQLTLTELEDFARELAYEGLDPALIIKKLKETGGDDWVKDTKFIIVFALTRGNKIVKASGKMSNSGSKRLMALQEKYGLVERAETRLSITPVRVAQSLPTWTCAAAAALKEYLPVGPAVMNLKVENYPPEMMCMAFGSLIPTAGVSEATTKTLMEAYSLWQDAFTKTINVKMRGASKTEVYNSFRDPLHAAVNSVFFPNDVRVRWLKAKGILGPDGVPSRAAEVAAAAYRNL

SEQ ID NO: 889 - protein, 245 aa, Artificial Sequence
  derived and/or modified protein sequence (wt) from SFTSV(AP01-Korea-13)__KR612072.1__N
MSEWSRIAVEFGEQQLNLTELEDFARELAYEGLDPALIIKKLKETGGDDWVRDTKFIIVFALTRGNKIVKASGKMSNSGSKRLMALQEKYGLVERAETRLSITPVRVAQSLPTWTCAAAAALKEYLPVGPAVMNLKVENYPPEMMCMAFGSLIPTAGVSEATTKTLMEAYSLWQDAFTKTINVKMRGASKTEVYNSFRDPLHAAVNSVFFPNDVRVKWLKAKGILGPDGVPSRAAEVAAAAYRNL

SEQ ID NO: 890 - protein, 245 aa, Artificial Sequence
  derived and/or modified protein sequence (wt) from SFTSV(JP03-Korea-13)__KR612079.1__N
MSEWSRIAVEFGEQQLNLTELEDFARELAYEGLDPALIIKKLKETGGDDWVRDTKFIIVFALTRGNKIVKASGKMSNSGSKRLMALQEKYGLVERAETRLSITPVRVAQSLPTWTCAAAAALKEYLPVGPAVMNLKVENYPPEMMCMAFGSLIPTAGVSEATTKTLMEAYSLWQDAFTKTINVKMRGASKTEVYNSFRDPLHAAVNSVFFPNDVRVKWLKAKGILGPDGIPSRAAEVAAAAYRNL

SEQ ID NO: 891 - protein, 245 aa, Artificial Sequence
  derived and/or modified protein sequence (wt) from SFTSV(JP07-Korea-13)__KR612088.1__N
MSEWSRIAVEFGEHQLNLTELEDFARELAYEGLDPALIIKKLKETGGDDWVRDTKFIIVFALTRGNKIVKASGKMSNSGSKRLMALQEKYGLVERAETRLSITPVRVAQSLPTWTCAAAAALKEYLPVGPAVMNLKVENYPPEMMCMAFGSLIPTAGVSEATTKTLMEAYSLWQDAFTKTINVKMRGASKTEVYNSFRDPLHAAVNSVFFPNDVRVKWLKAKGILGPDGVPSRAAEVAAAAYRNL

SEQ ID NO: 892 - protein, 245 aa, Artificial Sequence
  derived and/or modified protein sequence (wt) from SFTSV(JS2011-13-2)__KR230790.1__N
MSEWSRIAVEFGEQQLNLTELEDFARELAYEGLDPALIIKKLKETGGDDWVKDTKFIIVFALTRGNKIVKASGKMSSSGSKRLMALQEKYGLVERAETRLSITPVRVAQSLPTWTCAAAAALKEYLPVGPAVMNLKVENYPPEMMCMAFGSLIPTAGVSEATTKTLMEAYSLWQDAFTKTINVKMRGASKTEVYNSFRDPLHAAVNSVFFPNDVRVKWLKAKGILGPDGVPSRAAEVAAAAYRNL

SEQ ID NO: 893 - protein, 245 aa, Artificial Sequence
  derived and/or modified protein sequence (wt) from SFTSV(JS2014-15)__KR230799.1__N
MSEWSRIAVEFGEQQLNLTELEDFARELAYEGLDPALIIKKLKETGGDDWVKDTKFIIVFALTRGNKIVKASGKMSNSGSKRLMALQEKYGLVERAETRLSITPVRVAQSLPTWTCAAAAALKEYLLVGPAVMNLKVENYPPEMMCMAFGSLIPTAGVSEATTKTLMEAYSLWQDAFTKTINVKMRGASKTEVYNSFRDPLHAAVNSVFFPNDVRVKWLKAKGILGPDGVPSRAAEVAAAAYRNL

SEQ ID NO: 894 - protein, 245 aa, Artificial Sequence
  derived and/or modified protein sequence (wt) from SFTSV(KASJH)__KP663733.1__N
MSEWSRIAVEFGEQQLNLSELEDFARELAYEGLDPALIIKKLKETGGDDWVKDTKFIIVFALTRGNKIVKASGKMSNSGSKRLMALQEKYGLVERAETRLSITPVRVAQSLPTWTCAAAAALKEYLPVGPAVMNLKVENYPPEMMCMAFGSLIPTAGVSEATTKTLMEAYSLWQDAFTKTINVKMRGASKTEVYNSFRDPLHAAVNSVFFPNDVRVKWLKAKGILGPDGVPSRAAEVAAAAYRNL

SEQ ID NO: 895 - protein, 245 aa, Artificial Sequence
  derived and/or modified protein sequence (wt) from SFTSV(YSH116)__KT721303.1__N
MSEWSRIAVEFGEQQLNLTELEDFARELAYEGLDPALIIKKLKETGGDDWVKDTKFIIVFALTRGNKIVKASGKMSNSGSKRLMALQEKYGLVERAETRLSITPVRVAQSLPTWTCAAAAALKEYLPVGPAVMNLKVENYPPEMMCMAFGSLIPTAGVSEATTKTLMEAYSLWQDVFTKTINVKMRGASKTEVYNSFRDPLHAAVNSVFFPNDVRVKWLKAKGILGPDGVPSRAAEVAAAAYRNL

SEQ ID NO: 896 - protein, 245 aa, Artificial Sequence
  derived and/or modified protein sequence (wt) from SFTSV(AH-YTY/China/05/2012)__KR017811.1__N
MSEWSRIAVEFGEQQLNLTELEDFARELAYEGLDPALIIKKLKETGGDDWVKDTKFIIVFALTRGNKIVKASGKMSNSGSKRLMALQEKYGLVERAETRLSITPVRVAQSLPTWTCAAAAALKEYLPVGPAVMNLKVENYPPEMMCMAFGSLIPTTGVSEATTKTLMEAYSLWQDAFTKTINVKMRGASKTEVYNSFRDPLHAAVNSVFFPNDVRVKWLKAKGILGPDGVPSRAAEVAAAAYRNL

SEQ ID NO: 897 - protein, 245 aa, Artificial Sequence
  derived and/or modified protein sequence (wt) from SFTSV(DS02/CHN/2013)__KR698319.1__N
MSEWSRIAVEFGEQQLNLTELEDFARELAYEGLDPALIIKKLKETGGDDWVRDTKFIIVFALTRGNKIVKASGKMSNSGSKRLMALQEKYGLVEKAETRLSITPVRVAQSLPTWTCAAAAALKEYLPVGPAVMNLKVENYPPEMMCMAFGSLIPTAGVSEATTKTLMEAYSLWQDAFTKTINVKMRGASKTEVYNSFRDPLHAAVNSVFFPNDVRVKWLKAKGILGPDGVPSRAAEVAAAAYRNL

SEQ ID NO: 898 - protein, 245 aa, Artificial Sequence
  derived and/or modified protein sequence (wt) from SFTSV(HB2014-13)__KU738908.1__N
MSEWSRIAVEFGEQQLNLTELEDFARELAYEGLDPALIIKKLKETGGDDWVKDTKFIIVFALTRGNKIVKASGKMSNSGSKRLMALQEKYGLVERAETRLSITPVRVAQSLPTWTCAAAAALKEYLPVGPAVMNLKVENYPPEMMCMAFGSLIPTTGVSEATTKTLMEAYSLWQDAFTKTINVKMRGASKTEVYNSFRDPLHAAVNSVFFPNDVRVRWLKAKGILGPDGVPSRAAEVAAAAYRNL

SEQ ID NO: 899 - protein, 245 aa, Artificial Sequence
  derived and/or modified protein sequence (wt) from SFTSV(HB2014-20)__KU738910.1__N
MSEWSRIAVEFGEQQLNLTELEDFARELAYEGLDPALIIKKLKETGGDDWVKDTKFIIVFALTRGNKIVKASGKMSNSGSKRLMTLQEKYGLVERAETRLSITPVRVAQSLPTWTCAAAAALKEYLPVGPAVMNLKVENYPPEMMCMAFGSLIPTAGVSEATTKTLMEAYSLWQDAFTKTINVKMRGASKTEVYNSFRDPLHAAVNSVFFPNDVRVKWLKAKGILGPDGVPSRAAEVAAAAYRNL

SEQ ID NO: 900 - protein, 245 aa, Artificial Sequence
  derived and/or modified protein sequence (wt) from SFTSV(LN2012-14)__KF887431.1__N
MSERSRIAVEFGEQQLNLTGLEDFARELAYEGLDPALIIKKLKETGGDDWVKDTKFIIVFALTRGNKIVKASGKMSNSGSKRLMALQEKYGLVERAETRLSITPVRVAQSLPTWTCAAAAALKEYLPVGPAVMNLKVENYPPEMMCMAFGSLIPTAGVSEATTRTLMEAYSLWQDAFTKTINVKMRGASKTEVYNSFRDPLHAAVNSVFFPNDVRVKWLKAKGILGPDGVPSRAAEVAAAAYRNL

SEQ ID NO: 901 - protein, 245 aa, Artificial Sequence
  derived and/or modified protein sequence (wt) from SFTSV(NB31/CHN/2013)__KR698325.1__N
MSEWSRIAVEFGEQQLNLIELEDFARELAYEGLDPALIIKKLKETGGDDWVRDTKFIIVFALTRGNKIVKASGKMSNSGSKRLMALQEKYGLVEKAETRLSITPVRVAQSLPTWTCAAAAALKEYLPVGPAVMNLKVENYPPEMMCMAFGSLIPTAGVSKPTTKTLMEAYSLWQDAFTKTINVKMRGASKTEVYNSFRDPLHAAVNSVFFPNDVRVKWLKAKGILGPDGVPSRAAEVAAAAYRNL

SEQ ID NO: 902 - protein, 245 aa, Artificial Sequence
  derived and/or modified protein sequence (wt) from SFTSV(QD7)__KR706565.1__N
MSEWSRIAVEFGVQQLNLTELEDFARELAYEGLDPALIIKKLKETGGDDWVKDTKFIIVFALTRGNKIVKASGKMSNSGSKRLMALQEKYGLVERAETRLSITPVRVAQSLPTWTCAAAAALKEYLPVGPAVMNLKVENYPPEMMCMAFGSLIPTAGVSEATTKTLMEAYSLWQDAFTKTINVKMRGASKTEVYNSFRDPLHAAVNSVFFPNDVRVKWLKAKGILGPDGVPSRAAEVAAAAYRNL

SEQ ID NO: 903 - protein, 245 aa, Artificial Sequence
  derived and/or modified protein sequence (wt) from SFTSV(SDLZP06/2011)__JQ693009.1__N
MSEWSRTAVEFGEQQLNLTELEDFARELAYEGLDPALIIKKLKETGGDDWVKDTKFIIVFALTRGNKIVKASGKMSNSGSKRLMALQEKYGLVERAETRLSITPVRVAQSLPTWTCAAAAALKEYLPVGPAVMNLKVENYPPEMMCMAFGSLIPTAGVSEATTKTLMEAYSLWQDAFTKTINVKMRGASKTEVYNSFRDPLHAAVNSVFFPNDVRVKWLKAKGILGPDGVPSRAAEVAAAAYRNL

SEQ ID NO: 904 - protein, 245 aa, Artificial Sequence
  derived and/or modified protein sequence (wt) from SFTSV(ZJZHSH-FDE/China/06/2012)__KR017821.1__N
MSEWSRIAVEFGEQQLNLTELEDFARELAYEGLDPALIIKKLKETGGDDWVRDTKFIIVFALTRGNKIVKASGKMSNSGSKRLMALQEKYGLVEKAETRLSITPVRVAQSLPTWTCAAAAALKEYLPVGPAVMNLKVENYPPEMMCMAFGSLIPTAGVSEATTKTLMEAYSLWQDAFTKTINVKMRGASKTEVYNSFRDPLHAAVNSVLFPNDVRVKWLKAKGILGPDGVPSRAAEVAAAAYRNL

SEQ ID NO: 905 - protein, 245 aa, Artificial Sequence
  derived and/or modified protein sequence (wt) from SFTSV(ZJZHSH-FZHR/China/07/2013)__KR017824.1__N
MSEWSRIAVEFGEQQLNLTELEDFARELAYEGLDPALIIKKLKETGGDDWMKDTKFIIVFALTRGNKIVKASGKMSNSGSKRLMALQEKYGLVERAETRLSITPVRVAQSLPTWTCAAAAALKEYLPVGPAVMNLKVENYPPEMMCMAFGSLIPTAGVSEATTKTLMEAYSLWQDAFTKTINVKMRGASKTEVYNSFRDPLHAAVNSVFFPNDVRVKWLKAKGILGPDGVPSRAAEVAAAAYRNL

SEQ ID NO: 906 - protein, 245 aa, Artificial Sequence
  derived and/or modified protein sequence (wt) from SFTSV(ZJZHSH-HYC/China/05/2012)__KR017809.1__N
MSEWSRIAVEFGEQQLNLTELEDFARELAYEGLDPALIIKKLKETGGDDWVRDTKFIIVFALTRGNKIVKASGKMSNSGSKRLMALQEKYGLVEKAETRLSITPVRVAQSLPTWTCAAAAALKEYLPVGPAVMNLKVENYPPEMMCMAFGSLIPTVGVSEATTKTLMEAYSLWQDAFTKTINVKMRGASKTEVYNSFRDPLHAAVNSVFFPNDVRVKWLKAKGILGPDGVPSRAAEVAAAAYRNL

SEQ ID NO: 907 - protein, 245 aa, Artificial Sequence
  derived and/or modified protein sequence (wt) from SFTSV(SPL003A)__AB817996.1__N
MSEWSRIAVEFGEQQLNLTELEDFARELAYEGLDPALIIKKLKETGGDDWVRDTKFIIVFALTRGNKIVKASGKMSNSGSKRLMALQEKYGLVERAETRLSITPVRVAQSLPTWTCAAAAALKEYLPVGPAVMNLKVENYPPEMMCMAFGSLIPTAGVSEATTKTLMEAYSLWQDAFTKTINVKMRGASKTEVYNSFRDPLHAAVNSVFFPNDVRVKWLKAKGILGPDGAPSRAAEVAAAAYRNL

SEQ ID NO: 908 - protein, 245 aa, Artificial Sequence
  derived and/or modified protein sequence (wt) from SFTSV(SPL077A)__AB985536.1__N
MSEWPRIAVEFGEQQLNLTELEDFARELAYEGLDPALIIKKLKETGGDDWVRDTKFIIVFALTRGNKIVKASGKMSNSGSKRLMALQEKYGLVERAETRLSITPVRVAQSLPTWTCAAAAALKEYLPVGPAVMNLKVENYPPEMMCMAFGSLIPTAGVSEATTKTLMEAYSLWQDAFTKTINVKMRGASKTEVYNSFRDPLHAAVNSVFFPNDVRVKWLKAKGILGPDGVPSRAAEVAAAAYRNL

SEQ ID NO: 909 - protein, 245 aa, Artificial Sequence
  derived and/or modified protein sequence (wt) from SFTSV(SPL106A)__AB985548.1__N
MSDWSRIAVEFGEQQLNLTELEDFARELAYEGLDPALIIKKLKETGGDDWVRDTKFIIVFALTRGNKIVKASGKMSNSGSKRLMALQEKYGLVERAETRLSITPVRVAQSLPTWTCAAAAALKEYLPVGPAVMNLKVENYPPEMMCMAFGSLIPTAGVSEATTKTLMEAYSLWQDAFTKTINVKMRGASKTEVYNSFRDPLHAAVNSVFFPNDVRVKWLKAKGILGPDGVPSRAAEVAAAAYRNL

SEQ ID NO: 910 - protein, 245 aa, Artificial Sequence
  derived and/or modified protein sequence (wt) from SFTSV(SPL114A)__AB985552.1__N
MSEWSRIAVEFGEQQLNLTELEDFARELAYEGLDPALIIKKLKETGGDDWVRDTKFIIVFALTRGNKIVKAPGKMSNSGSKRLMALQEKYGLVERAETRLSITPVRVAQSLPTWTCAAAAALKEYLPVGPAVMNLKVENYPPEMMCMAFGSLIPTAGVSEATTKTLMEAYSLWQDAFTKTINVKMRGASKTEVYNSFRDPLHAAVNSVFFPNDVRVKWLKAKGILGPDGVPSRAAEVAAAAYRNL

SEQ ID NO: 911 - protein, 245 aa, Artificial Sequence
  derived and/or modified protein sequence (wt) from SFTSV(SPL125A)__AB985557.1__N
MSEWSGVAVEFGEQQLNLTELEDFARELAYEGLDPALIIKKLKETGGDDWVRDTKFIIVFALTRGNKIVKASGKMSNSGSKRLMALQEKYGLVERAETRLSITPVRVAQSLPTWTCAAAAALKEYLPVGPAVMNLKVENYPPEMMCMAFGSLIPTAGVSEATTKTLMEAYSLWQDAFTKTINVKMRGASKTEVYNSFRDPLHAAVNSVFFPNDVRVKWLKAKGILGPDGVPSRAAEVAAAAYRNL

SEQ ID NO: 912 - protein, 245 aa, Artificial Sequence
  derived and/or modified protein sequence (wt) from SFTSV(SPL160A)__AB985571.1__N
MSEWSRIAVEFGEQQLNLTELEDFARELAYEGLDPALIITKLKETGGDDWVRDTKFIIVFALTRGNKIVKASGKMSNSGSKRLMALQEKYGLVERAETRLSITPVRVAQSLPTWTCAAAAALKEYLPVGPAVMNLKVENYPPEMMCMAFGSLIPTAGVSEATTKTLMEAYSLWQDAFTKTINVKMRGASKTEVYNSFRDPLHAAVNSVFFPNDVRVKWLKAKGILGPDGVPSRAAEVAAAAYRNL

SEQ ID NO: 913 - protein, 245 aa, Artificial Sequence
  derived and/or modified protein sequence (wt) from SFTSV(SPL163A)__AB985573.1__N
MSEWSRIAVEFGEQQLNLTELEDFARELAYEGLDPALIIKKLKETGGDDWVRDTKFIIVFPLTRGNKIVKASGKMSNSGSKRLMALQEKYGLVERAETRLSITPVRVAQSLPTWTCAAAAALKEYLPVGPAVMNLKVENYPPEMMCMAFGSLIPTAGVSEATTKTLMEAYSLWQDAFTKTINVKMRGASKTEVYNSFRDPLHAAVNSVFFPNDVRVKWLKAKGILGPDGVPSRAAEVAAAAYRNL

SEQ ID NO: 914 - protein, 245 aa, Artificial Sequence
  derived and/or modified protein sequence (wt) from SFTSV/FTLSV(2011YPQ12)__KF711915.1__N
MSKWSRIAVEFGEQQLNLTELEDFARELAYEGLDPALIIKKLKETGGDDWVKDTKFIIVFALTRGNKIVKASGKMSNSGSKRLMALQEKYGLVERAKTRLSITPVRVAQSLPTWTCAAAAALKEYLPVGPAVMNLKVENYPPEMMCMAFGSLIPTAGVSEATTKTLMEAYSLWQDAFTKTINVKMRGASKTEVYNSFRDPLHAAVNSVFFPNDVRVKWLKAKGILGPDGVPSKAAEVAAAAYRNL

SEQ ID NO: 915 - protein, 245 aa, Artificial Sequence
  derived and/or modified protein sequence (wt) from SFTSV/FTLSV(2011YXX9)__KF711898.1__N
MSEWSRIAVEFGEQQLNLTELEDFARELAYEGLDPALIIKKLKETGGDDWVKDTKFIIVFALTRGNKIVKASGKMSNSGSKRLMALQEKYGLVERAETRLSITPVRVAQSLPTWTCAAAAALKEYLPVGPAVMNLKVENYPPEMMCMAFGSLIPTAGVSEATTKTLVEAYSLWQDAFTKTINVKMRGASKTEVYNSFRDPLHAAVNSVFFPNDVRVKWLKAKGILGPDGVPSRAAEVAAAAYRNL

SEQ ID NO: 916 - protein, 245 aa, Artificial Sequence
  derived and/or modified protein sequence (wt) from SFTSV/FTLSV(YPQ2)__KF356519.1__N
MSEWSRIAVEFGEQQLNLTELEDFARELAYEGLDPALIIKKLKETGGDDWVKDTKFIIVFALTRGNKIVKASGKMSNSGSKRLMALQEKYGLVERAETRLSITPVRVAQSLPTWTCAAAAALKEYLPVGPAVMNLKVENYPPEMMCMAFGSLIPTAGVSEATTKTLMEAYSLWQDAFTKTINVKMRGASKTEVYNSFRDPLHAAVNSVFFPNDVRVKWLKAKGILGPNGVPSRAAEVAAAAYRNL

SEQ ID NO: 917 - protein, 245 aa, Artificial Sequence
  derived and/or modified protein sequence (wt) from SFTSV/Guertu virus(DXM)__KT328591.1__N
MSEWSKIAVEFGEQQLNVIELEEFARELAYEGLDPALIIKKLKEVGGDDWMRDTKFIIVFALTRGNKILKAAGKMSNSGSKRIMALQEKYGLVERAETRLSITPVRVAQSLPTWTCSAAAALQEYLPVGPAVMSLKVSNFPPEMMCMAFGSLIPATGVPESTTKILMEAYSLWQDAFTKTINVKMRGASKAEVYNSFRDPLHAAVNSVFFPNDVRLRWLKSKGILGPDGLPSKAVETAAAAYRNL

SEQ ID NO: 918 - protein, 245 aa, Artificial Sequence
  derived and/or modified protein sequence (wt) from SFTSV/Huaiyangshan virus(2010-FQM)__HQ419240.1__N
MSEWSRIAVKFGEQQLNLTELEDFARELAYEGLDPALIIKKLKETGGDDWVKDTKFIIVFALTRGNKIVKASGKMSNSGSKRLMALQEKYGLVERAETRLSITPVRVAQSLPTWTCAAAAALKEYLPVGPAVMNLKVENYPPEMMCMAFGSLIPTAGVSEATTKTLMEAYSLWQDAFTKTINVKMRGASKTEVYNSFRDPLHAAVNSVFLPNDVRVKWLKAKGILGPDGVPSRAAEVAAAAYRNL

SEQ ID NO: 919 - protein, 245 aa, Artificial Sequence
  derived and/or modified protein sequence (wt) from SFTSV/Huaiyangshan virus(2010-ZGQ)__HQ419241.1__N
MSEWSRIAVEFGEQQLNLTELEDFARELAYEGLDPALIIKKLKETGGDDWVKDTKFIIVFALTRGNKIVKASGKMSNSGSKRLMSLQEKYGLVERAETRLSITPVRVAQSLPTWTCAAAAALKEYLPVGPAVMNLKVENYPPEMMCMAFGSLIPTAGVSEATTRTLMEAYSLWQDAFTKTINVKMRGASKTEVYNSFRDPLHAAVNSVFFPNDVRVKWLKAKGILGPDGVPSRAAEVAAAAYRNL

SEQ ID NO: 920 - protein, 245 aa, Artificial Sequence
  derived and/or modified protein sequence (wt) from SFTSV/Huaiyangshan virus(S-HGX)__HQ171192.1__N
MSEWSRIAVEFGEQQLNLTELEDFARELAYEGLDPALIIKKLKETGGDDWVKDTKFIIVFALTRGNKIVKASGKMSNSGSKRLMALQEKYGLVERAETRLSITPVRVAQSLPTWTCTAAAALKEYLPVGPAVMNLKVENYPPEMMCMAFESLIPTAGVSEATTKTLMEAYSLWQDAFTKTINVEMRGASKTEVYNSFRDPLHAAVNSVFFPNDVRVKWLKAKGILGPDGVPSRAAEVAAAAYRNL

SEQ ID NO: 921 - protein, 245 aa, Artificial Sequence
  derived and/or modified protein sequence (wt) from SFTSV/Huaiyangshan virus(S-HZM)__HQ171193.1__N
MSEWSRIAVEFGEQQLNLTELEDFARELAYEGLDPALIIKKLKETGGDDWVKDTEFIIVFALTRGNKIVKASGKMSNSGSKRLMALQEKYGLVERAETRLSITPVRVAQSLPTWTCAAAAALKEYLPVGPAVMNLKVENYPPEMMCMAFGSLIPTTGVSEATTKTLMEAYSLWQDAFTKTINVKMRGASKTEVYNSFRDPLHAAVNSVFFPNDLRVKWLKAKGILGPDGVPSRAAEVAAAAYRNL

SEQ ID NO: 922 - protein, 245 aa, Artificial Sequence
  derived and/or modified protein sequence (wt) from SFTSV/Huaiyangshan virus(S-WJ)__HQ171191.1__N
MSEWSRIAVEFGEQQLNLTELEDFARELAYEGLGPALIIKKLKETGGDDWVKDTKFIIVFALTRGNKIVKASGKMSNSGSKRLMALQEKYGLVERAETRLSITPVRVAQSLPTWTCAAAAALKEYLPVGPAVMNLKVENYPPEMMCMAFGSLIPTAGVSEATTKTLMEAYSLWQDAFTKTINVKMRGASKTEVYNSFRDPLHAAVNSVFFPNDVRVKWLKAKGILGPDGVPSRAAEVAAAAYRNL

SEQ ID NO: 923 - protein, 245 aa, Artificial Sequence
  derived and/or modified protein sequence (wt) from SFTSV/Phlebovirus(JS2010-019)__JQ317180.1__N
MSEWSRIAVEFGEQQLNLTELEDFARELAYEGLDPALIIKKLKETGGDDWVKDTKFIIVFALTRGNKIVKASGKMSNSGSKRLMALQEKYGLVERAETRLSITPVRVAQSLPTWTCAAAAALKEYLPVGPAVMNLKVENYPPEMMCMAFGSLIPTAGVSEATTKTLMEAYSLWQDAFTKTINVKMRGASKTEVYNSFRDPLHAAVNSVFFPNDVRVKWLKAKGILGPDGVPSRAAEAAAAAYRNL

SEQ ID NO: 924 - protein, 245 aa, Artificial Sequence
  derived and/or modified protein sequence (wt) from SFTSV/Phlebovirus(SD24/China/2010 strain SD24)__HM802205.1__N
MSEWSRIAVEFGEQQLNLTELEDFARELAYEGLDPALIIKKLKETGGDDWVKDTKFIIVFALTRGNKIVKASGKMSNSGSKRLMALQEKYGLVERAETRLSITPVRVAQSLPTWTCAAAAALKEYLPVGPAVMNLKVENYPPEMMCMAFGSLIPTAGVTEATTKTLMEAYSLWQDAFTKTINVKMRGASKTEVYNSFRDPLHAAVNSVFFPNDVRVKWLKAKGILGPDGVPSRAAEVAAAAYRNL

SEQ ID NO: 925 - protein, 245 aa, Artificial Sequence
  derived and/or modified protein sequence (wt) from SFTSV/Phlebovirus(ZJ1/China/2011)__HE663216.1__N
MSEWSRIAVEFGEQQLNLTELEDFARELAYEGLDPALIIKKLKETGGDDWVRDTKFIIVFALTRGNKIVKASGKMSNSGSKRLMALQEKYGLVEKAETRLSITPVRVAQSLPTWTCAAAAALKEYLPVGPAVMNLKVENYPPEMMCMAFGSLIPTAGVSEATTKALMEAYSLWQDAFTKTINVKMRGASKTEVYSSFRDPLHAAVNSVFFPNDVRVKWLKAKGILGPDGVPSRAAEVAAAAYRNL

SEQ ID NO: 926 - protein, 1138 aa, Artificial Sequence
  derived and/or modified protein sequence (wt) from ANDV(Chile-9717869)__AF291703.2__GP
MEGWYLVVLGVCYTLTLAMPKTIYELKMECPHTVGLGQGYIIGSTELGLISIEAASDIKLESSCNFDLHTTSMAQKSFTQVEWRKKSDTTDTTNAASTTFEAQTKTVNLRGTCILAPELYDTLKKVKKTVLCYDLTCNQTHCQPTVYLIAPVLTCMSIRSCMASVFTSRIQVIYEKTHCVTGQLIEGQCFNPAHTLTLSQPAHTYDTVTLPISCFFTPKKSEQLKVIKTFEGILTKTGCTENALQGYYVCFLGSHSEPLIVPSLEDIRSAEVVSRMLVHPRGEDHDAIQNSQSHLRIVGPITAKVPSTSSTDTLKGTAFAGVPMYSSLSTLVRNADPEFVFSPGIVPESNHSTCDKKTVPITWTGYLPISGEMEKVTGCTVFCTLAGPGASCEAYSENGIFNISSPTCLVNKVQRFRGSEQKINFICQRVDQDVVVYCNGQKKVILTKTLVIGQCIYTFTSLFSLMPDVAHSLAVELCVPGLHGWATVMLLSTFCFGWVLIPAVTLIILKCLRVLTFSCSHYTNESKFKFILEKVKIEYQKTMGSMVCDVCHHECETAKELESHRQSCINGQCPYCMTITEATESALQAHYSICKLTGRFQEALKKSLKKPEVKKGCYRTLGVFRYKSRCYVGLVWCLLLTCEIVIWAASAETPLMESGWSDTAHGVGEIPMKTDLELDFSLPSSSSYSYRRKLTNPANKEESIPFHFQMEKQVIHAEIQPLGHWMDATFNIKTAFHCYGACQKYSYPWQTSKCFFEKDYQYETGWGCNPGDCPGVGTGCTACGVYLDKLKSVGKAYKIISLKYTRKVCIQLGTEQTCKHIDANDCLVTPSVKVCIVGTVSKLQPSDTLLFLGPLEQGGIILKQWCTTSCAFGDPGDIMSTPSGMRCPEHTGSFRKICGFATTPVCEYQGNTISGYKRMMATKDSFQSFNLTEPHITTNKLEWIDPDGNTRDHVNLVLNRDVSFQDLSDNPCKVDLHTQAIEGAWGSGVGFTLTCTVGLTECPSFMTSIKACDLAMCYGSTVTNLARGSNTVKVVGKGGHSGSSFKCCHDTDCSSEGLLASAPHLERVTGFNQIDSDKVYDDGAPPCTFKCWFTKSGEWLLGILNGNWIVVVVLVVILILSIIMFSVLCPRRGHKKTV

SEQ ID NO: 927 - protein, 1138 aa, Artificial Sequence
  derived and/or modified protein sequence (wt) from ANDV(AH-1)__AF324901.2__GP
MEGWYLVALGVCYTLTLAMPKTIYELKMECPHTVGLGQGYIIGSTELGLISIEAASDIKLESSCNFDLHTTSMAQKSFTQVEWRKKSDTTDTTNAASTTFEAQTKTVNLRGTCILAPELYDTLKKVKKTVLCYDLTCNQTHCQPTVYLIAPVLTCMSIRSCMASVFTSRIQVIYEKTHCVTGQLIEGQCFNPAHTLTLSQPAHTYDTVTLPISCFFTPKKSEQLKVIKTFEGILTKTGCTENALQGYYVCFLGSHSEPLIVPSLEDIRSAEVVSRMLVHPIGEDHDAIQNSQSYLRIVGPITAKVPSTSSTDTLKGIAFAGVPMYSSFSTLVRNADPEFVFSPGIIPESNHSVCDKKTVPITWTGYLPISGEMEKVTGCTVFCTLAGPGASCEAYSENGIFNISSPTCLVNKVQRFRGSEQKINFICQRVDQDVVVYCNGQKKVILTKTLVIGQCIYTFTSLFSLMPDVAHSLAVELCVPGLHGWATVMLLSTFCFGWVLIPAVTLIILKCLRVLTFSCSHYTNESKFKFILEKVKVEYQKTMGSMVCDVCHHECETAKELESHRQSCINGQCPYCMTITEATESALQAHYSICKLTGRFQEALKKSLKKPEVKKGCYRTLGVFRYKSRCYVGLVWCLLLTCEIVIWAASAETPLMESGWSDTAHGVGEIPMKTDLELDFSLPSSSSYSYRRKLTNPANKEESIPFHFQMEKQVIHAEIQPLGHWMDATFNIKTAFHCYGACQKYSYPWQTSKCFFEKDYQYETGWGCNPGDCPGVGTGCTACGVYLDKLKSVGKAYKIISLKYTRKVCIQLGTEQTCKHIDANDCLVTPSVKVCIVGTVSKLQPSDTLLFLGPLEQGGIILKQWCTTSCAFGDPGDIMSTPSGMRCPEHTGSFRKICGFATTPVCEYQGNTVSGYKRMMATKDSFQSFNLTEPHITTNKLEWIDPDGNTRDHVNLVLNRDVSFQDLSDNPCKVDLHTQAIEGAWGSGVGFTLTCTVGLTECPSFMTSIKACDLAMCYGSTVANLARGSNTVKVVGKGGHSGSSFKCCHDTDCSSEGLLASAPHLERVTGFNQIDSDKVYDDGAPPCTFKCWFTKSGEWLLGILNGNWIVVVVLVVILILSIIMFSVLCPRRGHKKTV

SEQ ID NO: 928 - protein, 1138 aa, Artificial Sequence
  derived and/or modified protein sequence (wt) from ANDV(CHI-7913)__AY228238.1__GP
MEGWYLVALGICYTLTLAMPKTTYELKMECPHTVGLGQGYIIGSTELGLISIEAASDIKLESSCNFDLHTTSMAQKSFTQVEWRKKSDTTDTTNAASTTFEAQTKTVNLRGTCILAPELYDTLKKVKKTVLCYDLTCNQTHCQPTVYLIAPVLTCMSIRSCMARVFTSRIQVIYEKTHCVTGQLIEGQCFNPAHTLTLSQPAHTYDTVTLPISCFFTPKESEQLKVIKTFEGILTKTGCTENALQGYYVCFLGSHSEPLIVPSLEDIRSAEVVSRMLVHPRGEDHDAIQNSQSHLRIVGPITAKVPSTSSTDTLKGTAFAGVPMYSSLSTLVKNADPEFVFSPGIIPESNHSVCDKKTVPITWTGYLPISGEMEKVTGCTVFCTLAGPGASCEAYSENGIFNISSPTCLVNKVQRFRGSEQKINFICQRVDQDVVVYCNGQKKVILTKTLVIGQCIYTFTSLFSLMPDVAHSLAVELCVPGLHGWATVMLLSTFCFGWVLIPAVTLIILKCLRVLTFSCSHYTNESKFKFILEKVKVEYQKTMGSMVCDVCHHECETAKELESHRQSCINGQCPYCMTITEATESALQAHYSICKLTGRFQEALKKSLKKPEVKKGCYRTLGVFRYKSRCYVGLVWCLLLTCEIVIWAASAETPLMESGWSDTAHGVGEIPMKTDLELDFSLPSSSSYSYRRKLTNPANKEESISFHFQMEKQVIHAEIQPLGHWMDATFNTKTAFHCYGACQKYSYPWQTSKCFFEKDYQYETGWGCNPGDCPGVGTGCTACGVYLDKLKSVGKAYKIISLKYTRKVCIQLGTEQTCKHIDANDCLVTPSVKVCIVGTVSKLQPSDTLLFLGPLEQGGVILKQWCTTSCAFGDPGDIMSTPSGMRCPEHTGSFRKICGFATTPVCEYQGNTISGYKRMMATKDSFQSFNLTEPHITANKLEWIDPDGNTRDHVNLVLNRDVSFQDLSDNPCKVDLHTQAIEGAWGSGVGFTLTCTVGLTECPSFMTSIKACDLAMCYGSTVANLARGSNTVKVVGKGGHSGSSFKCCHDTDCSSEGLLASAPHLERVTGFNQIDSDKVYDDGAPPCTFKCWFTKSGEWLLGILNGNWIVVVVLVVILILSIIMFSVLCPRRGHKKTV

SEQ ID NO: 929 - protein, 1138 aa, Artificial Sequence
  derived and/or modified protein sequence (wt) from Hu39694(Hu39694)__AF028023.1__GP
MEGWYLIVLGVCSTLTLAMPRTIYELRMECPHTVGLGQGYIIGSTELGLIPIETVSDLKLESSCNFDLHTTSMTQKSYTQVEWRKKSDTTDTTNAASTTFEAQTKTVNLRGTCVLASELYDTLKKIKKTVLCYDLTCNQTHCQPTVYLIAPVSTCMSIRSCMASVFTNRIQVIYEKTHCVTGQLVEGQCFNPAHTLTLSQPAHTYEMVTLPVTCFFTPKKSDQLKLIKTFEGIISKTGCTENALQGYYVCFLGSHSEPLHVPSLEDIRSVEVFSRMIIHPRGEDHDPIQNSQGFLRIVGPITAKVPSTSSTDTLKGTAFAGVPMYSSLSTLVRTTDPEYVFSPGIIPESNHSTCDKKTIPLTWTGYLPIAGEMEKVTGCTVFCTLAGPGASCEAYSEHGIFNISSPTCLVHKVQKFRGSEQKINFICQRVDQDVVVYCNGQKKVILTKDLVIGQCIYTFTSLFSLMPDVAHSLAVELCVPGLHGWATVMLLSTFCFGWILIPAITLVVLKFLKMATFSCSHYTNESKFKFILEKVKVEYQKTMGSMVCDICHHECETAKELESHKQSCINGQCPYCMTMTEATESALQAHYSICKLTGRFQEALKKSLKRPEVKKGCYRTLGVFRYKSRCYVGLVWCVLLTCELIVWAASAETPLLESGWSDTAHGVGEVPMKTDLELDFSLPSSSSYSYRRKLTNPANKEESIPFHFQMEKQVIHAEIQTLGHWMDATFNIKTAFHCYGACQKYSYPWQTAKCFFEKDYQYETGWGCNPGDCPGFGTGCTACGVYLDKLKSVGKAYKIISLKYTRKVCIQLGTEQTCKHIDANDCLVTPSVKVCIIGTVSKLQPSDTLLFLGPLEQGGILLKQWCTTSCAFGDPGDIMSTTSGMRCPEHTGSFRKICGFATTPVCEYQGNTISGYKRMMATKDSFQSFNLTDPHITTNKLEWIDPDGNTRDHVNLVLNRDVSFQDLSDNPCKVDLHTQAIEGAWGSGVGFTLTCTVGLTECPSFITSIKACDMAMCYGSTVSNLARGSNTVKVVGKGGHSGLHSRCCHDTDCSSEGLVASAPHLERVTGFNQIDSDKVYDDGAPPCTFKCWFTKSGEWLLGILNGNWIVVVVLVVVLIFSIILFNILCPRRGHKKTV

SEQ ID NO: 930 - protein, 1138 aa, Artificial Sequence
  derived and/or modified protein sequence (wt) from LECV(Of22819)__AF028022.1__GP
MEGWYLIVLGVCSTLTLAMPKTIYELKMECPHTVGLGQGIIVGSTELGLIPIETASDLKLESSCNFDLHTTSMTQKSYTQVEWRKKSDTTDTTNAAATTFESQAKTVNLRGTCVLAAELYDTLKKVKKTVLCYDLTCNQTHCQPTVYLIAPVITCMSIRSCMASVFISRIQIIYEKTHCVTGQLIEGQCFNPAHTLTLAQPAHTYETVTLPVTCFFTPKKSDQLKLIKTFEGIISKTGCTENALQGYYVCFLGSHSEPLHVPSLKDIRSAEVVTRMIVHPRGEDHDPIQNSQGYLRIVGPLTAKVPSTSSSDTLQGTAFAGVPMYSSLSTLVRNTDPEFVFSPGIIPESNHSACDKKTIPLTWTGYLPISGEMEKVTGCTVFCTLAGPGASCEAYSESGIFNISSPTCLVNKVQKFRGSEQKINFICQRVDQDVVVYCNGQKKVILTKTLVIGQCIYTFTSLFSLMPDVAHSLAVELCVPGLHGWATVMLLSTFCFGWILIPAITLVVLKVLKVATFSCSHYTNESKFKFILEKVKVEYQKTMGSMVCDICHHECETAKELESHKQSCINGQCPYCMTMTEATESALQAHFAICKLTGRFQEALKKSLKKPEVRKGCYRTLGVFRYKSRCYVGLVWCVLLTCELIVWAASAETPLLESGWSDTAHGVGEVPMKTDLELDFSLPSSSSYSYRRKLTNPANKEESIPFHFQMEKQVIHAEIQNLGHWMDATFNIKTAFHCYGACQKYSYPWQTAKCFFEKDYQYETGWGCNPGDCPGVGTGCTACGVYLDKLKSVGKAYKIISLKYTRKVCIQLGTEQTCKHIDANDCLVTPSVKVCIVGTVSKLQPSDTLLFLGPLEQGGIILKQWCTTSCAFGDPGDIMSTTSGMRCPEHTGSFRKICGFATTPVCEYQGNTISGYKRMMATKDSFQSFNLTDPHITTNKLEWIDPDGNTRDHVNLVLNRDVSFQDLSDNPCKVDLHTQAIEGAWGSGVGFTLTCTVGLTECPSFMTSIKACDLAMCYGSTVHNLARGSNTVKVVGKGGHSGSSFKCCHDTDCSSEGLVASAPHLERVTGFNQIDSDKVYDDGAPPCTFKCWFTKSGEWLLGILNGNWIVVVVLVVVLIFSIILFSILCPRRGHKKTV

SEQ ID NO: 931 - protein, 1138 aa, Artificial Sequence
  derived and/or modified protein sequence (wt) from ORNV(Ol22996)__AF028024.1__GP
MEGWYLIVLGVCSTVTLAMPKTIYELKMECPHTVGLGQGYIIGSTELNLIPIGAASDLKLESSCDFDLYTTPMTQKSYTQVEWRKKSETTDTTNAAATTFESQTKTVNLRGTCILASELYDTLNKIKKPVLCYDLNCNQTRCQPTVYLIAPVITCMSIRSCMASVSNSRIQIIYEKTHCVTGQLVEGQCFNPSHTLTLAQPAHTYETVTLPVTCFFTPKKSDQLKLVKTFEGIITKTGCTENALQGYYVCFLGSHSEPLHVPSLEDIRSAEVVSRMIVHPRGEDHDPIQNSQGHLRIVGPITAKVPSTSSSDTLQGTAFSGVPMYSSLSTLVRSADPEFVFSPGILPESNHSVCDKKTLPLTWTGYLPISGEMEKVTGCTVFCTLAGPGASCEAYSENGIFNISSPTCLVNKVQKFRGSEQKINFICQRMDQDVVVYCNGQKKVILTKTLVIGQCIYTFTSLFSLMPDVAHSLAVELCVPGLHGWATVMLLSTFCFGWILIPAITLVVLKFLKMATFSCSHYTNESKFKLILEKVKVEYQKTMGSMVCDICHHECETAKVLESHKQSCINGQCPYCMTMTEATESALQAHYSICKLTGRFQEALKKSLKKPEVKRGCYRTLGVFRYKSRCYVGLVWCVLLTCELIVWAASAETPLLESGWSDTAHGVGEIPMKTDLELDFSLPSSSSYSYRRKLTNPANKEESIPFHFQMEKQVIHAEIQTLGHWMDATFNIKTAFHCYGACQKYSYPWQTAKCFFEKDYQYETGWGCNPGDCPGVGTGCTACGVYLDKLKSVGKAYKIISLKYTRKVCIQLGTEQTCKHIDANDCLVTPSVKVCIVGTVSKLQPSDTLLFLGPLEQGGIILKQWWTTSCAFGDPGDIMSTTSGMRCPEHTGSFRKICGFATTPVCEYQGNTISGYKRMMATKDSFQSFNLTDPHITTNKLEWIDPDGNTRDHVNLVLNRDVSFQDLSDNPCKVDLHTQAIEGAWGSGVGFTLTCTVGLTECPSFMTSIKACDLAMCYGSTVTNLARGSNTVKVVGKGGHSGSSFKCCHDTDCSSEGLVASAPHLERVTGFNQIDSDKVYDDGAPPCTFRCWFTKSGEWLLGILNGNWIVVVVLIVVLIFSIVLFSILCPRRGHKKAV

SEQ ID NO: 932 - protein, 1141 aa, Artificial Sequence
  derived and/or modified protein sequence (wt) from BCCV__L39950.1__GP
MGRLYLIVLGVLITATAGFPRSVHELKIECPHTVVLGQGYVTGSVELGFIALDQVTDLKIESSCSFDHHAAPTTTQNFTQLKWAKTASTTDTTNAAETTFESKSTEVHLKGVCTIPSNVLDGPSRPVTGRKTVVCYDLACNQTHCQPTVHLLAPIQTCMSVRSCMISLLASRIQVVYEKTYCVTGQLIEGLCFNPVPNLALTQPGHTYDTFTLPITCFLVAKKGANLKIAVELEKLTTKTGCAENALQAYYICFIGQHSEPLTVPMLEDYRSAEIFTRIMMNPKGEDHDMEQSSQGALRIVGPIKGKVPPTETSDTVQGIAFAGLPMYSSFSSLVRKAEPEYLFSPGIIAESNHSSCDKKTLPLTWRGFLSMSGEIERITGCNVFCTLAGPGASCEAYSENGIFNISSPTCLVNKVQKFRGSEQRINFISQRIDQDVIVYCNGQKKVILTKTLVIGQCIYTFTSIFSLIPSVAHSLAVELCVPGIHGWATIALVITFCFGWLLIPTTTMVVLKCLRLLTYSCSHYSTESKFKVILEKVKVEYQKTMGSMVCDICHHECETAKELESHKKSCADGQCPYCMTITEATESALQAHYAVCKLTGRFHEALKKSLKKPEVQRGCYRTLGVFRYKSRCYVGLVWMCLLTLELIVWAASADTPLLEPGWSDTAHGVGDIPMKTDLELDFAIPSSSSYSYRRRLVNPANSDETVPFHFQLERQVIHAEIQSLGHWMDATFNIISAFHCYGECKKYSYPWQTAKCFFEKDYQYETSWSCNPPDCPGVGTGCTACGIYLDKLKSVGKAYKVITLKYARKVCIQLGTEQTCKNIDVNDCLVTSSIKVCMIGTISKFQPGDTLLFLGPLEEGGLVLKQWCTTTCSFGDPGDIMSTTSGMRCPEHTGSFRKICGFATTPVCEYQGNTVSGFKRLMATKDSFQSFNVSEVHITTTKLEWSDPDSNIKDHINLILNRDVSFQDLSDNPCKVDLSTQAIDGAWGSGVGFTLTCIVGLTECSSFMTSIKVCDMAMCYGASVVNLVRGSNTVKIVGKGGHSGSTFRCCHDKDCTSNGLLASAPHLERVTGFNQIDSDKVYDDGAPPCSIKCWFAKSGEWLLGILNGNWVVVAVLVIILLISIFLFSFFCPIRSHKKQL

SEQ ID NO: 933 - protein, 1135 aa, Artificial Sequence
  derived and/or modified protein sequence (wt) from DOBV(DOBV/Ano-Poroia/Afl9/1999)__NC_005234.1__GP
MIMWGLLLTMILIDFGASLRNVYDMKIECPHSINFGESSVTGKVELPPLLLTDAEALVPESSCNMDNHQSMSIIQKVTKVSWRKKADKAQAAKDSFETTSSEVNLKGTCALSHRMVEESYRNRRSVICYDLSCNSTHCKPTMHMIVPVHSCNMMKSCLVGLGPYRIQIVYERTYCTTGILTEGKCFVPDQSIVNVIKNGVFDIASVSIVCFFIRVKGTNYKIMASIKTATANNCNDTDNKVQGYYLCIVGGNSSPVYAPSTTDFRSMEALASLLRAPHGEDHDLSGEEVATYSIAGQIEGKIPHTANAANMLFTAFSGIPSYSSLSVFIGSQDGPVIYSPGLFPRLNQSSCDKIALPLIWEGYIDLPGYYETVHPCNVFCVLSGPGASCEAFSEGGIFNITSPTCLVSKQNRFRAAEQQVNFVCQRVDQDIVIYCNGQKKTILTKTLVIGQCIYSVTSLFSIMPGVAHSIAIELCVPGFHGWATAALLTTFCFGWILILSITLAVLVVLKFFAAILHNSSQENRFKIILRKIKEEFEKTKGSMVCEVCKYECETGKELKAHNLSCPQSQCPYCFTHCEPTESAFQAHYKVCQATHRFRDDLKKTITPQSTSPGCYRTLNLFRYKSRCYIFTVWVTLLIIESIMWAASASETVLEPSWNDNAHGVGVVPMHTDLELDFSLPSSSKYTYKRKLTSPLNQEQSVDLHIEIESQGISTSVHALGHWFDGRLNLKTSFHCYGACTKYEYPWHTAKCHFERDFEYENNWGCNPADCPGIGTGCTACGLYIDQLKPVGSAYKLITVRYSRKVCVQFGEENLCKTIDMNDCFVTRHVKVCIIGTVSKFSQGDTLVFLGPMEGGGLIFKDWCTSTCQFGDPGDIMSPKDKGFSCPDFTGHFRKKCNFATTPVCEYDGNMVSGYKKVMATIDSFQSFNTSSIHYTDERIEWKDPDGMLKDHLNILVTKDIDFENLGENPCKVGLQTSSIEGAWGSGVGFTLTCQISLTECSRFLTSIKACDMAICYGAQSVTLIRGQNTVKVSGKGGHSGSSFKCCHGTDCSQQGLQASAPHLDKVNGIVEQESEKVYDDGAPQCGISCWFVKSGEWITGIFNGNWIVIVVLVFFFILSLILLSLLCPIRKHKRS

SEQ ID NO: 934 - protein, 1135 aa, Artificial Sequence
  derived and/or modified protein sequence (wt) from DOBV(DOB/Saaremaa/160V)__AJ009774.2__GP
MIMWGLLLTMSLINLGASLRNVYDMKIECPHSINFGESSVTGKVELPPILLTDAEALVPESSCNMDNHQSLSITQKVTKVSWRKKADQVQAAKDSFETTSNEINLKGTCTLTHRMVEESYRNRKSVICYDLSCNSTHCKPTMHMIVPVHSCNMMKSCLVGLGPYRVQVVYERTYCTTGILTEGKCFVPDQSIISVIKNGVFDIASVSIVCFFIRVKGTSYKIMASIKTSNPNNCNDTDNKVQGYYLCIVGANSSPVYAPSTTDFRSTEALASLLRSPHGEDHDLSGEEVATYSIAGQIEGKIPHTANAANMAFTAFSGIPSYSSLSVFAGNQDGTIIFSPGLFPKLNQSSCDKVALPLIWEGYIDLPGYYETIHPCNVFCVLSGPGASCEAFSEGGIFNITSPTCLVSKQNRFRAAEQQINFVCQRVDQDIVIYCNGQKKTILTKTLVIGQCIYSVTSLFSIMPSVAHSIAIELCVPGFHGWATAALLTTFCFGWILIPSITLAVLIVLKFFAAILHNSSQENRFKIILRKIKEEFEKTKGSMVCEVCKYECETGKELKAHNLSCPQSQCPYCFTHCELTESAFQAHYRVCQATHRFRDDLKKTITPQSTSPGCYRTLNLFRYKSRCYIFTVWVVLLIIESILWAASASELVLEPNWNDNAHGVGIVPMHTDLELDFSLPSSSKYTYKRKLTSPINQEQSIDLHIEIESQGISTSVHALGHWFDGRLNLKTSFHCYGACTKYEYPWHTAKCHFERDFEYENNWSCNPPDCPGIGTGCTACGLYLDQLKPVGSAYKLITVRYSRKVCVQFGEENLCKTIDMNDCFVTRHVKVCIIGTVSKFSQGDTLVFLGPMEGGGLIFKDWCTTTCQFGDPGDIMSPKDKGFSCPDFTGHFRKKCNFATTPVCEYDGNMVSGYKKVMATIDSFQAFNTSYIHYTDEQIEWKDPDGMLKDHLNILVTKDIDFENLGENPCRVGLQTASIEGAWGSGVGFTLTCQISLTECSRFLTSIKACDMAICYGAQSVTLVRGQNTVKVSGKGGHSGSSFKCCHGNDCSQQGLQASAPHLDKVNGIVEQESTQVYDDGAPQCGISCWFIKSGEWIKGIFSGNWIVIVVLIVLFILSLILLSFLCPIRKHKRS

SEQ ID NO: 935 - protein, 1135 aa, Artificial Sequence
  derived and/or modified protein sequence (wt) from DOBV(East Slovakia/400Af/98)__AY168577.1__GP
MIMWGLLLTMILIDFGTSLRNVYDMKIECPHSINFGESSVTGKVELPPLLLTDAEALVPESSCNMDNHQSMSIIQKVTKVSWRKKADKAQAAKDSFETTSSEVNLKGTCTLSHRMVEESYRNRRSVICYDLSCNSTHCKPTMHMIVPVHSCNMMKSCLVGLGPYRIQVVYERTYCTTGILTEGKCFVPDQSIVNVIKNGVFDIASVSIVCFFIRVKGTNYKIMASIKTATANNCNDTDNKVQGYYLCIVGGNSSPVYAPSTTDFRSMEALASLLRAPHGEDHDLSGEEVATYSIAGQIEGKIPHTANAANMLFTAFSGIPSYSSLSVYIGSQDGPVVYSPGLFPKLNQSSCDKVALPLIWEGYIDLPGYYETVHPCNVFCVLSGPGASCEAFSEGGIFNITSPTCLVSKQNRFRAAEQQVNFVCQRVDQDIVIYCNGQKKTILTKTLVIGQCIYSVTSLFSIMPGVAHSIAIELCVPGFHGWATAALLTTFCFGWILIPSITLAVLVVLKFFAAILHNSSQENRFKIILRKIKEEFEKTKGSMVCEVCKYECETGKELKAHNLSCPQSQCPYCFTHCEPTESAFQAHYKVCQATHRFRDDLKKTITPQSTSPGCYRTLNLFRYKSRCYIFTVWVTLLIIESIMWAASASENVLEPSWNDNAHGVGVVPMHTDLELDFSLPSSSKYTYKRKLTSPLNQEQSVDLHIEIESQGISTSVHALGHWFDGRLNLKTSFHCYGACTKYEYPWHTAKCHFERDFEYENSWGCNPADCPGIGTGCTACGLYIDQLKPVGSAYKLITVRYSRKVCVQFGEENLCKTIDMNDCFVTRHVKVCIIGTVSKFSQGDTLVFLGPMEGGGLIFKDWCTSTCQFGDPGDIMSPKDKGFSCPDFTGHFRKKCNFATTPVCEYDGNMVSGYKKVMATIDSFQSFNTSSIHYTDERIEWKDPDGMLKDHLNILVTKDIDFENLGENPCKVGLQTSSIEGAWGSGVGFTLTCQISLTECSRFLTSIKACDMAICYGAQSVTLIRGQNTVKVSGKGGHSGSSFKCCHGTDCSQQGLQASAPHLDKVNGIVEQESEKVYDDGAPQCGISCWFVKSGEWITGIFNGNWIVIVVLIFFFILSLILLSLLCPIRKHKRS

SEQ ID NO: 936 - protein, 1135 aa, Artificial Sequence
  derived and/or modified protein sequence (wt) from DOBV(East Slovakia/862Aa/97)__AY168578.1__GP
MIMWGLLLTMSLINLGASLRNVYDLRIECPHSINFGESSVTGKVELPPIPLTDAETLVPESSCNMDNHQSLSITQKVTKVSWRKKADKVQAAKDSFETTSSEINLKGTCTLAHRMVEESYRNRKSVICYDLSCNSTHCKPTMYMIVPVHSCNMMKSCLVGLGPYRIQVVYERTYCTTGILIEGKCFVPDQSIISVIKNGVFDIASVSIVCFFIRIKGNSYKIMTNIKTANPNNCNDTDNKVQGYYLCIVGANSSPVYAPSTTDFRSMEVLASLLRSPHGEDHDLSGEEVATYSIAGQVEGKVPHTENAANMLFTAFSGIPSYSSLSVFAGNQDGTVIYSPGLFPKLNQSSCEKVALPLIWEGYIDLPGYYETIHPCNVFCVLSGPGASCEAFSEGGIFNITSPTCLVSKQNRFRAAEQQINFVCQRVDQDIVIYCNGQKKTILTKTLVIGQCIYSVTSLFSIMPGVAHSIAIELCVPGFHGWATAALLTTFCFGWILIPSITLAILIVLKFFAAILHNSSQENRFKVILRKIKEEFEKTKGSMVCEVCKYECETGKELKAHNLSCPQSQCPYCFTHCELTESAFQAHYRVCQATHRFRDDLKKTITPQSTSPGCYRTLNLFRYKSRCYIFTVWVVLLIIESILWAASASEIVLEPSWNDNAHGVGVVPMHTDLELDFSLPSSSKYTYKRKLTSPINQEQSVDLHIEIESQRISTSVHALGHWFDGRLNLKTSFHCYGACTKYEYPWHTARCHFERDFEYENSWSCNPADCPGIGTGCTACGLYLDQLKPVGSAYKLITVRYSRKVCVQFGEENLCKIIDMNDCFVSRHVKVCIIGTVSKFSQGDTLVFLGPMEGGGLIFKDWCTTTCQFGDPGDIMSPKDKGFSCPDFTGHFRKKCNFATTPVCEYDGNMVSGYKKVMATIDSFQAFNTSYIHYTDERIEWKDPDGMLKDHINILVTKDIDFENLGENPCKVGLQTASIEGAWGSGVGFTLTCQISLTECSRFLTSIKACDMAICYGAQSVTLVRGQNTVKVSGKGGHSGSSFKCCHGTDCSQQGLQASAPHLDKVNGIVEQESTQVYDDGAPQCGISCWFIKSGEWIKGIFNGNWIVIVVLIFFFILSLILLSFLCPIRKHKRS

SEQ ID NO: 937 - protein, 1135 aa, Artificial Sequence
  derived and/or modified protein sequence (wt) from DOBV(A35)__GU904036.1__GP
MIMWGLLLTLSLISLGASLRNVYDLRIECPHSINFGESSVTGKVELPPIPLTDAETLVPESSCNMDNHQSLSITQKVTKVSWRKKADKVQAAKDSFETTSSEINLKGTCTLAHRMVEESYRSRKSVICYDLSCNSTHCKPTMYMIVPVHSCNMMKSCLVGLGPYRIQVVYERTYCTTGILIEGKCFVPDQSIISVIKNGVFDIASVSIVCFFIRIKGNSYKIMTNIKTANPNNCNDTDNKVQGYYLCIVGANSSPVYAPSTTDFRSMEVLASLLRSPHGEDHDLSGEEVATYSIAGQVEGKVPHTENAANMLFTAFSGIPSYSSLSVFAGNQDGTVIYSPGLFPKLNQSSCEKVALPLIWEGYIDLPGYYETIHPCNVFCVLSGPGASCEAFSEGGIFNITSPTCLVSKQNRFRAAEQQINFVCQRVDQDIVIYCNGQKKTILTKTLVIGQCIYSVTSLFSIMPGVAHSIAIELCVPGFHGWATAALLTTFCFGWILIPSITLAILIVLKFFAAILHNSSQENRFKVILRKIKEEFEKTKGSMVCEVCKYECETGKELKAHNLSCPQSQCPYCFTHCELTESAFQAHYRVCQATHRFRDDLKKTITPQSTSPGCYRTLNLFRYKSRCYIFTVWVVLLIIESILWAASASEIVLEPSWNDNAHGVGVVPMHTDLELDFSLPSSSKYTYKRKLTSPINQEQSVDLHIEIESQRISTSVHALGHWFDGRLNLKTSFHCYGACTKYEYPWHTARCHFERDFEYENSWSCNPADCPGIGTGCTACGLYLDQLKPVGSAYKLITVRYSRKVCVQFGEENLCKIIDMNDCFVSRHVKVCIIGTVSKFSQGDTLVFLGPMEGGGLIFKDWCTTTCQFGDPGDIMSPKDKGFSCPDFTGHFRKKCNFATTPVCEYDGNMVSGYKKVMATIDSFQAFNTSYIHYTDERIEWKDPDGMLKDHINILVTKDIDFENLGENPCKVGLQTASIEGAWGSGVGFTLTCQISLTECSRFLTSIKACDMAICYGAQSVTLVRGQNTVKVSGKGGHSGSSFKCCHGTDCSQQGLQASAPHLDKVNGIVEQESTQVYDDGAPQCGISCWFIKSGEWIKGIFNGNWIVIVVLIFFFILSLILLSFLCPIRKHKRS

SEQ ID NO: 938 - protein, 1135 aa, Artificial Sequence
  derived and/or modified protein sequence (wt) from DOBV(A6)__GU904033.1__GP
MIMWGLLLTMILIDFGASLRNVYDMKIECPHSINFGESSVTGKVELPPLLLTDAEALVPESSCNMDNHQSMSIIQKVTKVSWRKKADKAQAAKDSFETTSSEVNLKGTCTLSHRMVEESYRNRRSVICYDLSCNSTHCKPTMHMIVPVHSCNMMKSCLVGLGPYRIQVAYERTYCTTGILTEGKCFVPDQSIVSVIKNGVFDIASVSIVCFFIRVKGTNYKIMASIKTATANNCNDTDNKVQGYYLCIVGGNSSPVYAPSTTDFRSMEALASLLRAPHGEDHDLSGEEVATYSIAGQIEGKIPHTANAANMLFTAFSGIPSYSSLSVFIGSQDGPIIYSPGLFPKLNQSSCDKVALPLIWEGYIDLPGYYETVHPCNVFCVLSGPGASCEAFSEGGIFNITSPTCLVSKQNRFRAAEQQVNFVCQRVDQDIIIYCNGQKKTILTKTLVIGQCIYSVTSLFSIMPGVAHSIAIELCVPGFHGWATAALLTTFCFGWILIPSITLAVLVVLKFFAAILHNSSQENRFKIILRKIKEEFEKTKGSMVCEVCKYECETGKELKAHNLSCPQSQCPYCFTHCEPTESAFQAHYKVCQATHRFRDDLKKTITPQSTSPGCYRTLNLFRYKSRCYIFTVWVTLLIIESIMWAASASENVLEPSWNDNAHGVGVVPMHTDLELDFSLPSSSKYTYKRKLTSPLNQEQSVDLHIEIESQGISTSVHALGHWFDGRLNLKTSFHCYGACTKYEYPWHTAKCHFERDFEYENSWGCNPADCPGIGTGCTACGLYIDQLKPVGSAYKLITVRYSRKVCVQFGEENLCKTIDMNDCFVTRHVKVCIIGTVSKFSQGDTLVFLGPMVGGGLIFKDWCTSTCQFGDPGDIMSPKDKGFSCPDFTGHFRKKCNFATTPVCEYDGNMVSGYKKVMATIDSFQSFNTSSIHYTDERIEWKDPDGMLKDHLNILVTKDIDFENLGENPCKVGLQTSSIEGAWGSGVGFTLTCQISLTECSRFLTSIKACDMAICYGAQSVTLIRGQNTVKVSGKGGHSGSSFKCCHGTDCSQQGLQASAPHLDKVNGIVEQDSEKVYDDGAPQCGISCWFVKSGEWITGIFNGNWIVIVVLVFFFILSLILLSLLCPIRKHKRS

SEQ ID NO: 939 - protein, 1135 aa, Artificial Sequence
  derived and/or modified protein sequence (wt) from DOBV(B13)__GU904034.1__GP
MIMWGLLLTMILIDFGASLRNVYDMKIECPHSINFGESSVTGKVELPPLLLTDAEALVPESSCNMDNHQSMSIIQKVTKVSWRKKADKAQAAKDSFETTSSEVNLKGTCTLSHRMVEESYRNRRSVICYDLSCNSTHCKPTMHMIVPVHSCNMMKSCLVGLGPYRIQVVYERTYCTTGILTEGKCFVPDQSIVSVIKNGVFDIASVSIVCFFIRVKGTNYKIMASIKTATANNCNDTDNKVQGYYLCIVGGNSSPVYAPSTTDFRSMEALASLLRAPHGEDHDLSGEEVATYSIAGQIEGKIPHTANAANMLFTAFSGIPSYSSLSVFIGSQDGPIIYSPGLFPKLNQSSCDKVALPLIWEGYIDLPGYYETVHPCNVFCVLSGPGASCEAFSEGGIFNITSPTCLVSKQNRFRAAEQQVNFVCQRVDQDIIIYCNGQKKTILTKTLVIGQCIYSVTSLFSIMPGVAHSIAIELCVPGFHGWATAALLTTFCFGWILIPSITLAVLVVLKFFAAILHNSSQENRFKIILRKIKEEFEKTKGSMVCEVCKYECETGKELKAHNLSCPQSQCPYCFTHCEPTESAFQAHYKVCQATHRFRDDLKKTITPQSTSPGCYRTLNLFRYKSRCYIFTVWVTLLIIESIMWAASASENVLEPSWNDNAHGVGVVPMHTDLELDFSLPSSSKYTYKRKLTSPLNQEQSVDLHIEIESQGISTSVHALGHWFDGRLNLKTSFHCYGACTKYEYPWHTAKCHFERDFEYENSWGCNPADCPGIGTGCTACGLYIDQLKPVGSAYKLITVRYSRKVCVQFGEENLCKTIDMNDCFVTRHVKVCIIGTVSKFSQGDTLVFLGPMVGGGLIFKDWCTSTCQFGDPGDIMSPKDKGFSCPDFTGHFRKKCNFATTPVCEYDGNMVSGYKKVMATIDSFQSFNTSSIHYTDERIEWKDPDGMLKDHLNILVTKDIDFENLGENPCKVGLQTSSIEGAWGSGVGFTLTCQISLTECSRFLTSIKACDMAICYGAQSVTLIRGQNTVKVSGKGGHSGSSFKCCHGTDCSQQGLQASAPHLDKVNGIVEQDSEKVYDDGAPQCGISCWFVKSGEWITGIFNGNWIVIVVLVFFFILSLILLSLLCPIRKHKRS

SEQ ID NO: 940 - protein, 1135 aa, Artificial Sequence
  derived and/or modified protein sequence (wt) from DOBV(Aa1854/Lipetsk-02)__EU188453.1__GP
MIMWGLLLTMALINPGATLRNVYDMRIECPHSINFGESSVTGKVELPPIPLADAETLVPESSCNMDNHQSLSITQKVTKVSWRKKADKVQAAKDSFETTSSEINLKGTCTLTHRMVEESYRNRKSVICYDLSCNSTHCKPTMHMIVPVHSCNMMKSCLVGLGPYRIQVVYERTYCTTGILTEGKCFVPDQSIVSVIKNGVFDIASVSIVCFFIRIKGNSYKIMASIKEANPNNCNDTDNKVQGYYLCIVGANSSPVYAPSTTDFRSVEALASLLRSPHGEDHDLSGEEVATYSIAGQVEGKVPHTANAANMLFTAFSGIPSHSSFSVFTGNQDGTVIYSPGLFPKLNQSACDKVALPLIWEGYIDLPGYYETIHPCNVFCVLSGPGASCEAFSEGGIFNITSPTCLVSKQNRFRAAEQQINFVCQRVDQDIVIYCNGQKKTILTKTLVIGQCIYSVTSLFSIMPGVAHSIAIELCVPGFHGWATAALLTTFCFGWILIPSITLAILIVLKFFAAILHNSSQENRFKIILRKIKEEFERTKGSMVCEVCKYECETGKELKAHNLSCPQSQCPYCFTHCELTESAFQAHYRVCQATHRFRDDLKKTITPQSTSPGCYRTLNLFRYKSRCYIFTVWVVLLIIESILWAASASETVLEPNWNDNAHGVGVVPMHTDLELDFSLPSSSKYTYKRKLTSPINQEQSVDLHIEVESQGISTSVHALGHWFDGRLNLKTSFHCYGACTKYEYPWHTARCHFERDFEYENSWSCNPADCPGIGTGCTACGLYLDQLKPVGSAYKLITVRYSRRVCVQFGEENLCKTIDMNDCFVTRHVKVCIIGTVSKFSQGDTLVFLGPMEGGGLIFKDWCTTTCQFGDPGDIMSPKDKGFSCPDFTGHFRKKCNFATTPVCEYDGNMVSGYKKVMATIDSFQAFNTSNIHYTDERIEWKDPDGMLKDHLNILVTKDIDFENLGENPCKVGLQTASIEGAWGSGVGFTLTCQISLTECSRFLTSIKACDMAICYGAQSVTLVRGQNTVKVSGKGGHSGSSFKCCHGTDCSQQGLQASAPHLDKVNGIVEQESTQVYDDGAPQCGISCWFIKSGEWIKGIFNGNWIVIVVLIFFFILSLILLSFLCPIRKHKRS

SEQ ID NO: 941 - protein, 1133 aa, Artificial Sequence
  derived and/or modified protein sequence (wt) from DOBV(Ap/Sochi/hu)__JF920149.1__GP
MWGLLLTMILIDFGATLRNVYDMRIECPHSVNFGESSVSGKVELPPVLLSEVETLVPESSCNMDNHQSMSIIQKVTQLTWRKKADKAQAAKDSFEITSGEVSLKGTCTLTHRMVEDSHRNRKSIICYDLSCNSTHCKPTMHMIVPIHSCNMMKSCLVGLGPYRIQVVYERTYCTTGILTEGKCFVPDQSIVNVIKNGVFDIASVSIVCFFVRVKGTNYKIMASIKTATSNNCNDTGNKVQGYYLCIVGGNSSPVYVPSTTDFRSMEALASMLRAPHGEDHDLAGEEVATYSIAGQVEGKVPHTASTANMLLTAFSGIPSYSSLSVFTGSQDGPIVYSPGLFPKLNQSSCDKVGLPLIWEGYIDLPGYYETVHQCNVFCVLSGPGASCEAFSEGGIFNITSPNCMVSKQNRFRAAEQQVNFACQRVDQDILIFCNGQKKTILTKTLVIGQCIYSITSLFSIMPGVAHSIAIELCVPGFHGWATAALLTTFCFGWVLIPSITLAVLVVLKFFAAILHNSSQENRFKLILKKIKEEFEKTKGSMVCEVCKYECETGKELKAHNLSCPQSQCPYCFTHCEPTESAFQAHYKVCQATHRFRDDLKKTITPQSTSPGCYRTLNLFRYKSRCYIFTVWVVLLVVESVMWAASASETVLEPSWNDNAHGVGVVPMHTDLELDFSLPSSSKYTYKRKLTSPINQEQSVDLHIEIESQGISTSVHALGHWFDGRLNLKTSFHCYGACTKYEYPWHTARCHFERDFEYENSWGCNPADCPGIGTGCTACGIYIDQLKPVGSAYKLITVRYSRKVCVQFGEENLCKTIDMNDCFVTRHVKVCIIGTVSKFSQGDTLVFLGPMEGGGLIFKDWCTSTCQFGDPGDIMSPKDKGFSCPEFTGHFRKKCNFATTPVCEYDGNMVSGYKKVMATIDSFQAFNTSSIHYTDERIEWKDPDGMLKDHLNILVTKDIDFENLGDNPCKVGLQTVSIEGAWGSGVGFTLTCQVSLTECSRFLTSIKACDKAICYGAQSSTLIRGQNTVKVSGKGGHSGSSFKCCHGTDCSQQGLQASAPHLDKINGIVEQENEKVYDDGAPQCGISCWFVKSGEWIQGIFNGNWIVIVVLIFFFILSLILLSIFCPIRKHKRS

SEQ ID NO: 942 - protein, 1133 aa, Artificial Sequence
  derived and/or modified protein sequence (wt) from DOBV(Ap1584/Sochi-01)__EU188450.1__GP
MWGLLLTMILIDFGATLRNVYDMRIECPHSVNFGESSVSGKVELPPVLLSEVETLVPESSCNMDNHQSMSIIQKVTQLTWRKKADKAQAAKDSFEITSGEVSLKGTCTLTHRMVEDSHRNRKSIICYDLSCNSTHCKPTMHMIVPIHSCNMMKSCLVGLGPYRIQVVYERTYCTTGILTEGKCFVPDQSIVNVIKNGVFDIASVSIVCFFVRVKGTNYKIMASIKTATSNNCNDTGNKVQGYYLCIVGGNSSPVYVPSTTDFRSMEALASMLRAPHGEDHDLAGEEVATYSIAGQVEGKVPHTANAANMLLTAFSGVPSYSSLSVFTGSQDGPIVYSPGLFPKLNQSSCDKVGLPLIWEGYIDLPGYYETVHQCNVFCVLSGPGASCEAFSEGGIFNITSPNCMVSKQNRFRAAEQQVNFACQSVDQDILIFCNGQKKTILTKTLVIGQCIYPITSLFSIMPGVAHSIAIELCVPGFHGWATAALLTTFCFGWVLIPSITLAVLVVLKFFAAILHNSSQENRFKLILKKIKEEFEKTKGSMVCEVCKYECETGKELKAHNLSCPQSQCPYCFTHCEPTESAFQAHYKVCQATHRFRDDLKKTITPQSTSPGCYRTLNLFRYKSRCYIFTVWVVLLVVESVMWAASASETVLEPSWNDNAHGVGVVPMHTDLELDFSLPSSSKYTYKRKLTSPINQEQSVDLHIEIESQGISTSVHALGHWFDGRLNLKTSFHCYGACTKYEYPWHTARCHFERDFEYENSWGCNPADCPGIGTGCTACGIYIDQLKPVGSAYKLITVRYSRKVCVQFGEENLCKTIDMNDCFVTRHVKVCIIGTVSKFSQGDTLVFLGPMEGGGLIFKDWCTSTCQFGDPGDIMSPKDKGFSCPEFTGHFRKKCNFATTPVCEYDGNMVSGYKKVMATIDSFQAFNTSSIHYTDERIEWKDPDGMLKDHLNILVTKDIDFENLGDSPCKVGLQTVSIEGAWGSGVGFTLTCQVSLTECSRFLTSIKACDKAICYGAQSSTLIRGQNTVKVSGKGGHSGSSFKCCHGTDCSQQGLQASAPHLDKINGIVEQENEKVYDDGAPQCGISCWFVKSGEWIQGIFNGNWIVIVVLIFFFILSLILLSIFCPIRKHKRS

SEQ ID NO: 943 - protein, 1135 aa, Artificial Sequence
  derived and/or modified protein sequence (wt) from DOBV(GER/05/477/Af)__GQ205411.1__GP
MIMWGLLLTLSLINLGASLRNVYDMKIECPHSINFGESSVTGKVELPPLLLTDAEALVPESSCNMDNHQSLSITQKVTKVSWRKKADKVQAAKDSFETTSSEVNFKGTCTLTHRMVEESYRNRKSVICYDLSCNSTHCKPTMHMIVPVHSCNMMKSCLVGLGPYRIQVVYERTYCTTGILTEGKCFVPDQSIISVLKNGVFDIASVSIVCFFIRIKGTSYKIMTSIKEANPNNCNDTDNKVQGYYLCIVGANSSPVYAPSTTDFRSVEALASLLRSPHGEDHDLAGEEVATYSIAGQVEGKVPHTANAANMLFTAFSGIPSYSSFSVFTGNQEGNVIYSPGLFPKLNQSSCEKVALPLIWEGYIDLPGYYETVHPCNVFCVLSGPGASCEAFSEGGIFNITSPTCLVSKQNRFRAAEQQINFVCQRVDQDIVIYCNGQKKTILTKTLVIGQCIYSVTSLFSIMPGVAHSIAIELCVPGFHGWATAALLTTFCFGWILIPSITLAILIILKFFAALFHNSSQENRFKIILKKIKEEFEKTKGSMVCEVCKYECETGKELKAHNLSCPQSQCPYCFTHCELTESAFQAHYRVCQATHRFRDDLKKTITPQSTSPGCYRTLNLFRYKSRCYIFTVWVILLIIESILWAASASETVLEPSWNDNAHGVGVVPMHTDLELDFSLPSSSKYTYKRKLTSPINQEQSVDLHIEIESQGISTSVHALGHWFDGRLNLKTSFHCYGACTKYEYPWHTAKCHFERDFEYENSWSCNPADCPGIGTGCTACGLYLDQLKPVGSAYKLITVRYSRKVCVQFGEENLCKTIDMNDCFVTRHVKVCIIGTVSKFSQGDTLVFLGPMEGGGLIFKDWCTTTCQFGDPGDIMSPKDKGFSCPDFTGHFRKKCNFATTPVCEYDGNMVSGYKKVMATIDSFQAFNTSNIHYTDERIEWKDPDGMLKDHLNILVTKDIDFENLGENPCKVGLQTASIDGAWGSGVGFTLTCQISLTECSRFLTSIKACDMAICYGAQSVTLVRGQNTVRVSGKGGHSGSSFKCCHGTDCSQQGLQASAPHLDKVNGIVEQESTQVYDDGAPQCGISCWFVKSGEWIKGIFNGNWIVIVVLIFLFLLSLILLSFLCPIRKHKRS

SEQ ID NO: 944 - protein, 1135 aa, Artificial Sequence
  derived and/or modified protein sequence (wt) from DOBV(GER/07/607/Af)__GQ205410.1__GP
MIMWGLLVTLSLINLGASLRNVYDMKIECPHSINFGESSVTGKVELPPLPLTDAETLVPESSCNMDNHQSLSITQKVTKVSWRKKADKVQAAKDSFETTSSEMNLKGTCTLTHRMVEESYRNRKSVICYDLSCNSTHCKPTMHMIVPVHSCNMMKSCLVGLGPYRIQVVYERTYCTTGILTEGKCFVPDQSIISVMKNGVFDIASVSIVCFFIRIKGTSYKIMTSIKEANPNNCNDTDTKVQGYYLCIVGANSSPVYAPSTTDFRSVEALASLLRSPHGEDHDLAGEEVATYSIAGQVEGKVPHTANAANMLFTAFSGIPSYSSFSVFTGNQDGTVIYSPGLFPKLNQSSCDKVALPLIWEGYIDLPGYYETVHPCNVFCVLSGPGASCEAFSEGGIFNITSPTCLVSKQNRFRAAEQQINFVCQRVDQDIVIYCNGQKKTILTKTLVIGQCIYSVTSLFSIMPGVAHSIAIELCVPGFHGWATAALLTTFCFGWILIPSITLAILIVLKFFAALLHNSSQENRFKIILKKIKEEFEKTKGSMVCEVCKYECETGKELKAHNLSCPQSQCPYCFTHCELTESAFQAHYRVCQATHRFRDDLKKTITPQSTSPGCYRTLNLFRYKSRCYIFTVWVILLIIESILWAASASETVLEPSWNDNAHGVGVVPMHADLELDFSLPSSSKYTYKRKLTSPINQEQSVDLHIEIESQGISTSVHALGHWFDGRLNLKTSFHCYGACTKYEYPWHTAKCHFERDFEYENSWSCNPADCPGIGTGCTACGLYLDQLKPVGSAYKLITVRYSRKVCVQFGEENLCKTIDMNDCFVTRHVKVCIIGTVSKFSQGDTLVFLGPMEGGGLIFKDWCTTTCQFGDPGDIMSPKDKGFSCPDFTGHFRKKCNFATTPVCEYDGNMVSGYKKVMATIDSFQAFNTSNIHYTDERIEWKDPDGMLKDHLNILVTKDIDFENLGENPCKVGLQTASIDGAWGSGVGFTLTCQISLTECSRFLTSIKACDMAICYGAQSVTLVRGQNTVKVSGKGGHSGSSFKCCHGTDCSQQGLQASAPHLDKVNGIVEQESTQVYDDGAPQCGISCWFVKSGEWIKGIFSGNWIVIVVLIFLFLLSLILLSFLCPIRKHKRS

SEQ ID NO: 945 - protein, 1135 aa, Artificial Sequence
  derived and/or modified protein sequence (wt) from DOBV(GER/08/118/Aa)__GQ205412.1__GP
MIMWGLLVILSLINLGASLRNVYDMKIECPHSINFGESSVTGKVELPPLPLTDAETLVPESSCNMDNHQSLSITQKVTKVSWRKKADKVQAAKDSFETTSSEINLKGTCTLTHRMVEESYRNRKSVICYDLSCNSTHCKPTMHMIVPVHSCNMMKSCLVGLGPYRIQVVYERTYCTTGILTEGKCFVPDQSIISVMKNGVFDIASVSIVCFFIRIKGTSYKIMTSIKEANPNNCNDTDNKVQGYYLCIVGANSSPVYAPSTTDFRSVEALASLLRSPHGEDHDLAGEEVATYSIAGQVDGKVPHTANAANMLFTAFSGIPSYSSFSVFTGNQDGTVIYSPGLFPKLNQSSCDKVALPLIWEGYIDLPGYYETVHPCNVFCVLSGPGASCEAFSEGGIFNITSPTCLVSKQNRFRAAEQQINFVCQRVDQDIVIYCNGQKKTILTKTLVIGQCIYSVTSLFSIMPGVAHSIAIELCVPGFHGWATAALLTTFCFGWILIPSITLAILIVLKFFAALLHNSSQENRFKIILKKIKEEFEKTKGSMVCEVCKYECETGKELKAHNLSCPQSQCPYCFTHCELTESAFQAHYRVCQATHRFRDDLKKTITPQSTSPGCYRTLNLFRYKSRCYIFTVWVILLIIESILWAASASETILEPSWNDNAHGVGVVPMHTDLELDFSLPSSSKYTYKRKLTSPINQEQSVDLHIEIESQGISTSVHALGHWFDGRLNLKTSFHCYGACTKYEYPWHTAKCHFERDFEYENSWSCNPADCPGIGTGCTACGLYLDQLKPVGSAYKLITVRYSRKVCVQFGEENLCKTIDMNDCFVTRHVKVCIIGTVSKFSQGDTLVFLGPMEGGGLIFKDWCTTTCQFGDPGDIMSPKDKGFSCPDFTGHFRKKCNFATTPVCEYDGNMVSGYKKVMATIDSFQAFNTSNIHYTDERIEWEDPDGMLKDHLNILVTKDIDFENLGENPCKVGLQTASIDGAWGSGVGFTLTCQISLTECSRFLTSIKACDMAICYGAQSVTLVRGQNTVKVSGKGGHSGSSFKCCHGTDCSQQGLQASAPHLDKVNGIVEQESTQVYDDGAPQCGISCWFVKSGEWIKGVFSGNWIVIVVLIFLFLLSLILLSFLCPIRKHKRS

SEQ ID NO: 946 - protein, 1135 aa, Artificial Sequence
  derived and/or modified protein sequence (wt) from DOBV(GER/08/131/Af)__GQ205413.1__GP
MIMWGLLLTLSLINLGASLRNVYDMKIECPHSINFGESSVTGKVELPPLLLTDAETLVPESSCNMDNHQSLSITQKVTKVSWRKKADKVQAAKDSFETTSSEVNLKGTCTLTHRMVEESYRSRKSVICYDLSCNSTHCKPTMHMIVPVHSCNMMKSCLVGLGPYRIQVVYERTYCTTGILTEGKCFVPDQSIISVIKNGVFDIASVSIVCFFIRIKGTSYKIMTSIKESNPNNCNDTDNKVQGYYLCIVGANSSPVYAPSTTDFRSVEALASLLRSPYGEDHDLAGEEVATYSIAGQVEGKVPHTANAANMLFTAFSGIPSYSSFSVFTGNQDGNVIYSPGLFPKLNQSSCEKVALPLIWEGYIDLPGYYETVHPCNVFCVLSGPGASCEAFSEGGIFNITSPTCLVSKQNRFRAAEQQINFVCQRVDQDIVIYCNGQKKTILTKTLVIGQCIYSVTSLFSIMPGVAHSIAIELCVPGFHGWATAALLTTFCFGWILIPSITLAILIVLKFFAALLHNSSQENRFKIILKKIKEEFEKTKGSMVCEVCKYECETGKELKAHNLSCPQSQCPYCFTHCELTESAFQAHYRVCQATHRFRDDLKKTITPQSTSPGCYRTLNLFRYKSRCYIFTVWVILLIIESILWAASASEIVLEPSWNDNAHGVGVVPMHTDLELDFSLPSSSKYTYKRKLTSPINQEQSVDLHIEIESQGISTSVHALGHWFDGRLNLKTSFHCYGACTKYEYPWHTAKCHFERDFEYENSWSCNPADCPGIGTGCTACGLYLDQLKPVGSAYKLITVRYSRKVCVQFGEENLCKTIDMNDCFVTRHVKVCIIGTVSKFSQGDTLVFLGPMEGGGLIFKDWCTTTCQFGDPGDIMSPKDKGFSCPDFTGHFRKKCNFATTPVCEYDGNMVSGYKKVMATIDSFQAFNTSNIHYTDERIEWKDTDGMLKDHLNILVTKDIDFENLGENPCKVGLQTASIDGAWGSGVGFTLTCQISLTECSRFLTSIKACDMAICYGAQSVTLVRGQNTVRVSGKGGHSGSSFKCCHGTDCSHQGLQASAPHLDKVNGIVEQESTQVYDDGAPQCGISCWFVKSGEWIKGIFSGNWIVIVVLIFLFLLSLILLSFLCPIRKHKRS

SEQ ID NO: 947 - protein, 1135 aa, Artificial Sequence
  derived and/or modified protein sequence (wt) from DOBV(GRW/Aa)__JQ026205.1__GP
MIMWGLLLTLSLINLGASLRNVYDMKIECPHSINFGESSVTGKGELPPLLLTDAETLVPESSCNMDNHQSLSITQKVTKVSWRKKADKVQAAKDSFETTSSEVNLKGTCTLTHRMVEESYRSRKSVICYDLSCNSTHCKPTMHMIVPVHSCNMMKSCLVGLGPYRIQVVYERTYCTTGILTEGKCFVPDQSIISVIKNGVFDIASVSIVCFFIRIKGTSYKIMTSIKESNPNNCNDTDNKVQGYYLCIVGANSSPVYAPSTTDFRSVEALASLLRSPYGEDHDLAGEEVATYSIAGQVEGKVPHTANAANMLFTAFSGIPSYSSFSVFTGNQDGNVIYSPGLFPKLNQSSCEKVALPLIWEGYIDLPGYYETVHPCNVFCVSSGPGASCEAFSEGGIFNITSPTCLVSKQNRFRAAEQQINFVCQRVDQDIVIYCNGQKKTILTKTLVIGQCIYSVTSLFSIMPGVAHSIAIELCVPGFHGWATAALLTTFCFGWILIPSITLAILIVLKFFAALLHNSSQENRFKIILKKIKEEFEKTKGSMVCEVCKYECETGKELKAHNLSCPQSQCPYCFTHCELTESAFQAHYRVCQATHRFRDDLKKTITPQSTSPGCYRTLNLFRYKSRCYIFTVWVILLIIESILWAASASEIVLEPSWNDNAHGVGVVPMHTDLELDFSLPSSSKYTYKRKLTSPINQEQSVDLHIEIESQGISTSVHALGHWFDGRLNLKTSFHCYGACTKYEYPWHTAKCHFERDFEYENSWSCNPADCPGIGTGCTACGLYLDQLKPVGSAYKLITVRYSRKVCVQFGEENLCKTIDMNDCFVTRHVKVCIIGTVSKFSQGDTLVFLGPMEGGGLIFKDWCTTTCQFGDPGDIMSPKDKGFSCPDFTGHFRKKCNFATTPVCEYDGNMVSGYKKVMATIDSFQAFNTSNIHYTDERIEWKDPDGMLKDHLNILVTKDIDFENLGENPCKVGLQTASIDGAWGSGVGFTLTCQISLTECSRFLTSIKACDMAICYGAQSVTLVRGQNTVRVSGKGGHSGSSFKCCHGTDCSHQGLQASAPHLDKVNGIVEQESTQVYDDGAPQCGISCWFIKSGEWIKGIFSGNWIVIVVLIFLFLLSLILLSFLCPIRKHKRS

SEQ ID NO: 948 - protein, 1135 aa, Artificial Sequence
  derived and/or modified protein sequence (wt) from DOBV(Slo/Af-BER)__GU904035.1__GP
MIMWGLLLTMILIDFGASLRNVYDMKIECPHSINFGESSVTGKVELPPLLLTDAEALVPESSCNMDNHQSMSIIQKVTKVSWRKKADKAQAAKDSFETTSSEVNLKGTCTLSHRMVEESYRNRRSVICYDLSCNSTHCKPTMHMIVPVHSCNMMKSCLVGLGPYRIQVVYERTYCTTGILTEGKCFVPDQSIVSVIKNGVFDIASVSIVCFFIRVKGTNYKIMASIKTATANNCNDTDNKVQGYYLCIVGGNSSPVYAPSTTDFRSMEALASLLRAPHGEDHDLSGEEVATYSIAGQIEGKIPHTANAANMLFTAFSGIPSYSSLSVFIGSQDGPIIYSPGLFPKLNQSSCDKVALPLIWEGYIDLPGYYETVHPCNVFCVLSGPGASCEAFSEGGIFNITSPTCLVSKQNRFRAAEQQVNFVCQRVDQDIIIYCNGQKKTILTKTLVIGQCIYSVTSLFSIMPGVAHSIAIELCVPGFHGWATAALLTTFCFGWILIPSITLAVLVVLKFFAAILHNSSQENRFKIILRKIKEEFEKTKGSMVCEVCKYECETGKELKAHNLSCPQSQCPYCFTHCEPTESAFQAHYKVCQATHRFRDDLKKTITPQSTSPGCYRTLNLFRYKSRCYIFTVWVTLLIIESIMWAASASENVLEPSWNDNAHGVGVVPMHTDLELDFSLPSSSKYTYKRKLTSPLNQEQSVDLHIEIESQGISTSVHALGHWFDGRLNLKTSFHCYGACTKYEYPWHTAKCHFERDFEYENSWGCNPADCPGIGTGCTACGLYIDQLKPVGSAYKLITVRYSRKVCVQFGEENLCKTIDMNDCFVTRHVKVCIIGTVSKFSQGDTLVFLGPMEGGGLIFKDWCTSTCQFGDPGDIMSPKDKGFSCPDFTGHFRKKCNFATTPVCEYDGNMVSGYKKVMATIDSFQSFNTSSIHYTDERIEWKDPDGMLKDHLNILVTKDIDFENLGENPCKVGLQTSSIEGAWGSGVGFTLTCQISLTECSRFLTSIKACDMAICYGAQSVTLIRGQNTVKVSGKGGHSGSSFKCCHGTDCSQQGLQASAPHLDKVNGIVEQDSEKVYDDGAPQCGISCWFVKSGEWITGIFNGNWIVIVVLVFFFILSLILLSLLCPIRKHKRS

SEQ ID NO: 949 - protein, 1135 aa, Artificial Sequence
  derived and/or modified protein sequence (wt) from HTNV(76-118/POR)__KT885048.1__GP
MGIWKWLVMASLVWPVLTLRNVYDMKIECPHTVSFGGNSVIGYVELPPVPLADTAQMVPESSCSMDNHQSLNTITKYTQVSWRGKADQSQSSQNSFETVSTEVDLKGTCVLKHKMVEESYRSRKSVTCYDLSCNSTYCKPTLYMIVPIHACNMMKSCLIALGPYRVQVVYERTYCMTGVLIEGKCFVPDQSVVSIIKHGIFDIASVHIVCFFVAVKGNTYKIFEQVKKSFESTCNDTENKVQGYYICIVGGNSAPIYVPTLDDFRSMEAFTGIFRSPHGEDHDLAGEEIASYSIVGPANAKVPHSASSDTLRLIAYSGIPSYSSLSILTSSTEAKHVFSPGLFPKLNHTNCDKSAIPLIWTGMIDLPGYYEAVHPCTVFCVLSGPGASCEAFSEGGIFNITSSMCLVSKQNRFRLTEQQVNFVCQRVDMDIVVYCNGQRKVILTKTLVIGQCIYTITSLFSLLPGVAHSIAVELCVPGFHGWATAALLVTFCFGWVLIPAITFIILTVLKFIANIFHTSNQENRLKSVLRKIKEEFEKTKGSMVCDVCKYECETYKELKAHGVSCPQSQCPYCFTHCEPTEAAFQAHYKVCQVTHRFRDDLKKTVTPQNFTPGCYRTLNLFRYKSRCYIFTMWIFLLVLESILWAASASETPLTPVWNDNAHGVGSVPMHTDLELDFSLTSSSKYTYRRKLTNPLEEAQSIDLHIEIEEQTIGVDVHALGHWFDGRLNLKTSFHCYGACTKYEYPWHTAKCHYERDYQYETSWGCNPSDCPGVGTGCTACGLYLDQLKPVGSAYKIITIRYSRRVCVQFGEENLCKIIDMNDCFVSRHVKVCIIGTVSKFSQGDTLLFFGPLEGGGLIFKHWCTSTCQFGDPGDIMSPRDKGFLCPEFPGSFRKKCNFATTPICEYDGNMVSGYKKVMATIDSFQSFNTSTMHFTDERIEWKDPDGMLRDHINILVTKDIDFDNLGENPCKIGLQTSSIEGAWGSGVGFTLTCLVSLTECPTFLTSIKACDKAICYGAESVTLTRGQNTVKVSGKGGHSGSTFKCCHGEDCSQIGLHAAAPHLDKVNGISEIENSKVYDDGAPQCGIKCWFVKSGEWISGIFSGNWIVLIVLCVFLLFSLVLLSILCPVRKHKKS

SEQ ID NO: 950 - protein, 1135 aa, Artificial Sequence
  derived and/or modified protein sequence (wt) from HTNV(76-118)__Y00386.1__GP
MGIWKWLVMASLVWPVLTLRNVYDMKIECPHTVSFGGNSVIGYVELPPVPLADTAQMVPESSCSMDNHQSLNTITKYTQVSWRGKADQSQSSQNSFETVSTEVDLKGTCVLKHKMVEESYRSRKSVTCYDLSCNSTYCKPTLYMIVPIHACNMMKSCLIALGPYRVQVVYERTYCMTGVLIEGKCFVPDQSVVSIIKHGIFDIASVHIVCFFVAVKGNTYKIFEQVKKSFESTCNDTENKVQGYYICIVGGNSAPIYVPTLDDFRSMEAFTGIFRSPHGEDHDLAGEEIASYSIVGPANAKVPHSASSDTLSLIAYSGIPSYSSLSILTSSTEAKHVFSPGLFPKLNHTNCDKSAIPLIWTGMIDLPGYYEAVHPCTVFCVLSGPGASCEAFSEGGIFNITSPMCLVSKQNRFRLTEQQVNFVCQRVDMDIVVYCNGQRKVILTKTLVIGQCIYTITSLFSLLPGVAHSIAVELCVPGFHGWATAALLVTFCFGWVLIPAITFIILTVLKFIANIFHTSNQENRLKSVLRKIKEEFEKTKGSMVCDVCKYECETYKELKAHGVSCPQSQCPYCFTHCEPTEAAFQAHYKVCQVTHRFRDDLKKTVTPQNFTPGCYRTLNLFRYKSRCYIFTMWIFLLVLESILWAASASETPLTPVWNDNAHGVGSVPMHTDLELDFSLTSSSKYTYRRKLTNPLEEAQSIDLHIEIEEQTIGVDVHALGHWFDGRLNLKTSFHCYGACTKYEYPWHTAKCHYERDYQYETSWGCNPSDCPGVGTGCTACGLYLDQLKPVGSAYKIITIRYSRRVCVQFGEENLCKIIDMNDCFVSRHVKVCIIGTVSKFSQGDTLLFFGPLEGGGLIFKHWCTSTCQFGDPGDIMSPRDKGFLCPEFPGSFRKKCNFATTPICEYDGNMVSGYKKVMATIDSFQSFNTSTMHFTDERIEWKDPDGMLRDHINILVTKDIDFDNLGENPCKIGLQTSSIEGAWGSGVGFTLTCLVSLTECPTFLTSIKACDKAICYGAESVTLTRGQNTVKVSGKGGHSGSTFRCCHGEDCSQIGLHAAAPHLDKVNGISEIENSKVYDDGAPQCGIKCWFVKSGEWISGIFSGNWIVLIVLCVFLLFSLVLLSILCPVRKHKKS

SEQ ID NO: 951 - protein, 1135 aa, Artificial Sequence
  derived and/or modified protein sequence (wt) from HTNV(A16)__AF288645.1__GP
MGLWKWLIMAVLVWPCFALRNVYDMKIECPHTVNFGENSVVGYVELPPMPIADITQMMPESSCSMDNHQSLNTITKYTQVSWRKKADQAQSSQTSFETVSSEVDFKGTCVLKHKMIEDSYRSRRSIICYDLSCNSTFCKPTLYLIVPVHACNMMKSCLIALGPYRVQVVYERTYCMSGVLLEGKCFVPDQSVVSIIKHGIFDIASVHIVCFFVAIKGSTYKILEQVKKSFELTCNDTDNKIQGYYICLVGGNSAPIYVPTLDDFRSMEAFAGIFKSPHGEDHDLAGEEVASYSIVGPANAKVPHSASADTLGLVAFSGIPSYSSFSVLTGSTDARHVFSPGFFPQLNQTRCDKTAIPLTWTGMIDLPGYYEAVHPCTVFCVLSGPGASCEAFSEGGIFNITSPMCLVSKQNRFRSSKQQVNFVCQRVDMDIVVYCNGQKKVILTKTLVIGQCIYTITSLFSLLPGVAHSIAVELCVPGFHGWATAALLVTFCFGWVLIPAVTLVILTILKFIANIFHTSNQENRLKSVLKKIKEEFEKTKGSMVCDVCKYECETYKELKAHGVSCPQSQCPYCFTHCEPTEAAFQAHYKVCQVTHRFRDDLKKTVTPQNFTPGCYRTLNLFRYKSRCYIFTMWVFLLILESILWAASASETPLTPIWNDNAHGVGSIPMHTDLELDFSLTSSSKYTYRRKLTNPLEETQAVDLHIELAEQTIGVDVHALGHWFDGRLNLKTSFHCYGACTKYEYPWHTAKCHYERDYQYETSWGCNPSDCPGVGTGCTACGLYLDQLKPVGSAYKIITIRYSRRVCVQFGEENLCKVIDMNDCFVSRHVKVCIIGTVSKFSQGDTLLFFGPLEGGGLIFKHWCTSTCQFGDPGDIMSPRDKGFLCPEFPGSFRKKCNFATTPLCEYDGNMISGYKKVMATIDSFQSFNTSTMHFTDERIEWKDPDGMLRDHINILVTKDIDFDNLGENPCKIGLQTSSIEGAWGSGVGFTLTCLVSLTECPTFLTSIKACDKAICYGAESVTLTRGQNTVKVSGKGGHSGSTFKCCHGEDCSQTGLHAAAPHLDKVNGISEIENSKVYDDGAPQCGIKCWFVKSGEWISGIFSGNWIVLIVLCVFLLFSLVLLSVLCPVRKHKKS

SEQ ID NO: 952 - protein, 1135 aa, Artificial Sequence
  derived and/or modified protein sequence (wt) from HTNV(A9)__AF035831.1__GP
MGIWKWLVMASLVWPAYTLRNAYDMKIECPHTVSFGENSVIGYVELPPIPLADTTQMVPESSCSMDNHQSLNTITKYTQVSWRGKADHAQASQNSFEAVSAEVDLKGTCVLKHKMLEESYRSRKSIACYDLSCNSTYCKPTLYMIVPIHACNMMKSCLIALGPHRVQVVYERTYCMTGVLIEGKCFVPDQSVVSIIKHGIFDIASVHIVCFFVAVKGNTYKIFEQIKKSFESTCNDTKNKVQGYYICIVGGNSAPIYVPTLDDFRSMEAFSGIFRSPHGEDHDLAGEEIASYSIVGPANAKVPHSASSDTLSLTAYSGIPSYSSLSILAGSAEAKHVFSPGFFPQLNHTKCDKTAIPLMWTGMIDLPGYYEAIHPCTVFCVLSGPGASCEAFSEGGIFNITSPMCLVSKQNRFRLTEQQVNFVCQRVDMDIIVYCNGQRKVILTKTLVIGQCIYTITSLFSLLPGVAHSIAVELCVPGFHGWATAALLVTFCFGWVLIPAMTFIVLTILKFIANIFHTSNQENKLKSVLRKIKEEFEKTKGSMVCDVCKYECETYKELKAHGVSCPQSQCPYCFTHCEPTEAAFQAHYRVCQVTHRFRDDLKKTVTPQNFTPGCYRTLNLFRYKSRCYIFTMWVFLLVLESILWAASASEIPLNPVWNDNAHGVGSVPMPTDLELDFSLTSSSKYTYRRKLTNPLEESQAINLHIEIEEQTIGVDVHALGHWFDGRLNLKTSFHCYGACTKYEYPWHTAKCHYERDYQYETSWGCNPSDCPGVGTGCTACGLYLDQLRAVGSAYKIITIRYSRRVCVQFGEENLCKIIDMNDCFVSRHVKVCIIGTVSKFSQGDTLLFFGPLEGGGLIFKHWCTSTCQFGDPGDIMSPRDKGFLCPEFPGSSRKKCNFATTPLCEYDGNMVSGYKKVMATIDSFQSFNTSTMHFTDERIEWKDPDGMLRDHINILVTKDIDFENLGGNPCKIGLQTSSIEGAWGSGVGFTLTCLVSLTECPTFLTSIKACDKAICYGAESVTLTRGQNTVKVSGKGGHSGSTFKCCHGEECSQIGLHAAAPHLDKVNGISEIENNKVYDDGAPQCGIKCWFVKSGEWISGIFSGNWIVLIVLCVFLLFSLILLSILCPVRKHKKS

SEQ ID NO: 953 - protein, 1135 aa, Artificial Sequence
  derived and/or modified protein sequence (wt) from HTNV(84FLi)__AF345636.2__GP
MGVWKWLVMASLVWPACTLRNVYDMKIECPHTVSFGENSVIGYVELPPMPLADTTQLVPESSCSMDNHQSLNTITKYTQVSWRKKADQAQSSQNSFETVSVEVDLKGTCVLKHKMIEESYRSRKSITCYDLSCNSTYCKPTLYMIVPIHACNMMKSCLIALGPYRVQVVYERTYCMTGVLIEGKCFVPDQSVVSIIKHGIFDIASVKIVCFFVAVKGNTYKLFEQVKKSFDSTCNDTENKVQGYYICIVGGNSAPIYVPTLDDFRSMEAFSGIFRSPHGEDHDLAGEEVASYSIVGPANAKVPHSASSDTLSLIAYSGIPSYSSLSILTSSTEAKHVFSPGFFPQLNHTKCDKTAIPLTWTGMIDLPGYYEAIHLCTVFCVLSGPGASCEAFSEGGIFNITSPMCLVSKQNQFRLTKQQVNFVCQRVDMDIVVYCNGQRKVILTKTMVIGQCIYTITSLFSLLPGVAHSIAVELCVPGFHGWATAALLVTFCFGWVLIPAVTFIILTVLKFVANIFHTSNQENRLKSVLRKIKEEFEKTKGSMVCDVCKYECETYRELKAHGVSCPQSQCPYCFTHCEPTEAAFQAHYRVCQVTHRFRDDLKKTVTPQNFTPGCYRTLNLFRYKSRCYIFTMWVFLLVLESILWAASASEVPLNPIWNDNAHGVGSVPMHTDLELDFSLTSSSKYTYRRKLTNPLEETQAIDLHIEIEEQTIGVDVHALGHWFDGRLNLKTSFHCYGACTKYEYPWHTAKCHYERDYQYETSWGCNPSDCPGVGTGCTACGLYLDQLKPVGSAYKIITIRYSRRVCVQFGEENLCKVIDMNDCFVSRHVKVCIIGTVSKFSQGDTLLFFGPLEGGGLIFKHWCTSTCQFGDPGDIMSPRDKGFLCPEFPGSFRKKCNFATTPLCEYDGNMISGYKKVMATIDSFQSFNTSTMHFTDERIEWKDPDGMLRDHINILVTKDIDFDNLGENPCKIGLQTSSIEGAWGSGVGFTLTCLVSLTECPTFLTSIKACDKAICYGAESVTLTRGQNTVKVSGKGGHSGSTFKCCHGEDCSQTGLHAAAPHLDKVNGISEIENSKVYDDGAPQCGIKCWFVTSGEWISGIFSGNWIVLIVLCVFLLFSLVLLSVLCPVRKHKKS

SEQ ID NO: 954 - protein, 1135 aa, Artificial Sequence
  derived and/or modified protein sequence (wt) from HTNV(Aa03-161)__KT934990.1__GP
MGIWKWLVMASLVWPVLTLRNVYDMKIECPHTVSFGENSVIGYVELPPMPLADTAQLVPESSCSMDNHQSLNTITKYTQVSWRGKADQSQSSQNSFETVSTEVDLKGTCVLKHKMVEESYRSRKSITCYDLSCNSTYCKPTLYMIVPIHACNMMKSCLIALGPYRVQVVYERTYCMTGVLIEGKCFVPDQSVVSIIKHGIFDIASVHIVCFFVAVKGNTYKIFEQVKKSFESTCNDTENKVQGYYICIVGGNSAPIYVPTLDDFRSMEAFTGIFRSPHGEDHDLAGEETATYSIVGPANAKVPHSASSDTLSLIAFSGIPSYSSLSILTSSTEAKHVFSPGLFPKLNHTNCDKGAIPLMWTGMIDLPGYYEAIHPCTVFCVLSGPGASCEAFSEGGIFNITSPMCLVSKQNRFRLTEQQVNFVCQRVDVDIVVYCNGQRKVILTKTLVIGQCIYTITSLFSLLPGVAHSIAVELCVPGFHGWATAALLVTFCFGWVLIPAITFIILTILKFIANIFHTSNQENRLKSVLRKIKEEFEKTKGSMVCDVCKYECETYKELKAHGVSCPQSQCPYCFTHCEPTEAAFQAHYKVCQVTHRFRDDLKKTVTPQNFTPGCYRTLNLFRYKSRCYIFTMWIFLLVLESILWAASASETPLTPVWNDNAHGVGSVPMHTDLELDFSLTSSSKYTYRRKLTNPLEEAQSIDLHIEIEEQTIGVDVHALGHWFDGRLNLKTSFHCYGACTKYEYPWHTAKCHYERDYQYETSWGCNPSDCPGVGTGCTACGLYLDRLKPVGSAYKIITIRYSRRVCVQFGEENLCKIIDMNDCFVSRHVKVCIIGTVSKFSQGDTLLFFGPLEGGGLIFKHWCTSTCQFGDPGDIMSPRDKGFLCPEFPGSFRKKCNFATTPICEYDGNMVSGYRKVMATIDSFQSFNTSTMHFTDERIEWKDPDGMLRDHINILVTKDIDFDNLGENPCKIGLQTSSIEGAWGSGVGFTLTCLVSLTECPTFLTSIKACDKAICYGAESVTLTRGQNTVKVSGKGGHSGSTFKCCHGEDCSQIGLHAAAPHLDKVNGISEMENSKVYDDGAPQCGIKCWFVKSGEWISGIFSGNWIVLIVLCVFLLFSLVLLSILCPVRKHKKS

SEQ ID NO: 955 - protein, 1135 aa, Artificial Sequence
  derived and/or modified protein sequence (wt) from HTNV(Aa03-386)__KT934991.1__GP
MGIWKWLVMASLVWPVLTLRNVYDMKIECPHTISFGENSVIGYVELPPMPLADTAQLVPESSCSMDNHQSLNTITKYTQVSWRGKADQSQSSQNSFETVSTEVDLKGTCVLKHKMVEESYRSRKSITCYDLSCNSTYCKPTLYMIVPIHACNMMKSCLIALGPYRVQVVYERTYCMTGVLIEGKCFVPDQSVVSIIKHGIFDIASVHIVCFFVAVKGNTYKIFEQVKKSFESTCNDTENKVQGYYICIVGGNSAPIYVPTLDDFRSMEAFTGIFRSPHGEDHDLAGEETATYSIVGPANAKVPHSASSDTLSLIAFSGIPSYSSLSILTSSTEAKHVFSPGLFPKLNHTNCDKGAIPLMWTGMIDLPGYYEAIHPCTVFCVLSGPGASCEAFSEGGIFNITSPMCLVSKQNRFRLTEQQVNFVCQRVDVDIVVYCNGQRKVILTKTLVIGQCIYTITSLFSLLPGVAHSIAVELCVPGFHGWATAALLVTFCFGWVLIPAITFIILTILKFIANIFHTSNQENRLKSVLRKIKEEFEKTKGSMVCDVCKYECETYKELKAHGVSCPQSQCPYCFTHCEPTEAAFQAHYKVCQVTHRFRDDLKKTVTPQNFTPGCYRTLNLFRYKSRCYIFTMWIFLLVLESILWAASASETPLTPVWNDNAHGVGSVPMHTDLELDFSLTSSSKYTYRRKLTNPLEEAQSIDLHIEIEEQTIGVDVHALGHWFDGRLNLKTSFHCYGACTKYEYPWHTAKCHYERDYQYETSWGCNPSDCPGVGTGCTACGLYLDRLKPVGSAYKIITIRYSRRVCVQFGEENLCKIIDMNDCFVSRHVKVCIIGTVSKFSQGDTLLFFGPLEGGGLIFKHWCTSTCQFGDPGDIMSPRDKGFLCPEFPGSFRKKCNFATTPICEYDGNMVSGYKKVMATIDSFQSFNTSTMHFTDERIEWKDPDGMLRDHINILVTKDIDFDNLGENPCKIGLQTSSIEGAWGSGVGFTLTCLVSLTECPTFLTSIKACDKAICYGAESVTLTRGQNTVKVSGKGGHSGSTFKCCHGEDCSQIGLHAAAPHLDKVNGISEMENSKVYDDGAPQCGIKCWFVKSGEWISGIFSGNWIVLIVLCIFLLFSLVLLSILCPVRKHKKS

SEQ ID NO: 956 - protein, 1135 aa, Artificial Sequence
  derived and/or modified protein sequence (wt) from HTNV(Aa04-722)__KU207182.1__GP
MGIWKWLVMASLVWPVLTLRNVYDMKIECPHTVSFGENSVIGYVELPPMPLADTAQLVPESSCSMDNHQSLNTITKYTQVSWRGKADQSQSSQNSFETVSTEVDLKGTCVLKHKMVEESYRSRKSITCYDLSCNSTYCKPTLYMIVPIHACNMMKSCLIALGPYRVQVVYERTYCMTGVLIEGKCFVPDQSVVSIIKHGIFDIASVHIVCFFVAVKGNTYKIFEQVKKSFESTCNDTENKVQGYYICIVGGNSAPIYVPTLDDFRSMEAFTGIFRSPHGEDHDLAGEETATYSIVGPANAKVPHSASSDTLSLIAFSGIPSYSSLSILTSSTEAKHVFSPGLFPKLNHTNCDKGAIPLMWTGIIDLPGYYEAIHPCTVFCVLSGPGASCEAFSEGGIFNITSPMCLVSKQNRFRLTEQQVNFVCQRVDVDIVVYCNGQRKVILTKTLVIGQCIYTITSLFSLLPGVAHSIAVELCVPGFHGWATAALLVTFCFGWVLIPAITFIILTILKFIANIFHTSNQENRLKSVLRKIKEEFEKTKGSMVCDVCKYECETYKELKAHGVSCPQSQCPYCFTHCEPTEAAFQAHYKVCQVTHRFRDDLKKTVTPQNFTPGCYRTLNLFRYKSRCYIFTMWIFLLVLESILWAASASETPLTPVWNDNAHGVGSVPMHTDLELDFSLTSSSKYTYRRKLTNPLEEAQSIDLHIEIEEQTIGVDVHALGHWFDGRLNLKTSFHCYGACTKYEYPWHTAKCHYERDYQYETSWGCNPSDCPGVGTGCTACGLYLDRLKPVGSAYKIITIRYSRRVCVQFGEENLCKIIDMNDCFVSRHVKVCIIGTVSKFSQGDTLLFFGPLEGGGLIFKHWCTSTCQFGDPGDIMSPRDKGFLCPEFPGSFRKKCNFATTPICEYDGNMVSGYKKVMATIDSFQSFNTSTMHFTDERIEWKDPDGMLRDHINILVTKDIDFDNLGENPCKIGLQTSSIEGAWGSGVGFTLTCLVSLTECPTFLTSIKACDKAICYGAESVTLTRGQNTVKVSGKGGHSGSTFKCCHGEDCSQIGLHAAAPHLDKVNGISEMENSKVYDDGAPQCGIKCWFVKSGEWISGIFSGNWIVLIVLCVFLLFSLVLLSILCPVRKHKKS

SEQ ID NO: 957 - protein, 1135 aa, Artificial Sequence
  derived and/or modified protein sequence (wt) from HTNV(Aa05-190)__KT934993.1__GP
MGIWKWLVMASLVWPVLTLRNVYDMKIECPHTVSFGENSVIGYVELPPMPLTDTAQLVPESSCSMDNHQSLNTITKYTQVSWRGKADQSQSSQNSFETVSTEVDLKGTCVLKHKMIEESYRSRKSITCYDLSCNSTYCKPTLYMIVPIHACNMMKSCLIALGPYRVQVVYERTYCMTGVLIEGKCFVPDQSVVSIIKHGIFDIASVHIVCFFVAVKGNTYKIFEQVKKSFESTCNDTENKVQGYYICIVGGNSAPIYVPTLDDFRSMEAFTGIFRSPHGEDHDLAGEETATYSIVGPANAKVPHSASSDTLSLIAFSGIPSYSSLSILTSSTEAKHVFSPGLFPKLNHTNCDKGAIPLMWTGMIDLPGYYEAIHPCTVFCVLSGPGASCEAFSEGGIFNITSPMCLVSKQNRFRLTEQQVNFVCQRVDVDIVVYCNGQRKVILTKTLVIGQCIYTITSLFSLLPGVAHSIAVELCVPGFHGWATAALLVTFCFGWVLIPAITFIILTILKFIANIFHTSNQENRLKSVLRKIKEEFEKTKGSMVCDVCKYECETYKELKAHGVSCPQSQCPYCFTHCEPTEAAFQAHYKVCQVTHRFRDDLKKTVTPQNFTPGCYRTLNLFRYKSRCYIFTMWIFLLVLESILWAASASETPLTPVWNDNAHGVGSVPMHTDLELDFSLTSSSKYTYRRKLTNPLEEAQSIDLHIEIEEQTIGVDVHALGHWFDGRLNLKTSFHCYGACTKYEYPWHTAKCHYERDYQYETSWGCNPSDCPGVGTGCTACGLYLDRLKPVGSAYKIITIRYSRRVCVQFGEENLCKIIDMNDCFVSRHVKVCIIGTVSKFSQGDTLLFFGPLEGGGLIFKHWCTSTCQFGDPGDIMSPRDKGFLCPEFPGSFRKKCNFATTPICEYDGNMVSGYKKVMATIDSFQSFNTSTMHFTDERIEWKDPDGMLRDHINILVTKDIDFDNLGENPCKIGLQTSSIEGAWGSGVGFTLTCLVSLTECPTFLTSIKACDKAICYGAESVTLTRGQNTVKVSGKGGHSGSTFKCCHGEDCSQIGLHAAAPHLDKVNGISEMENSKVYDDGAPQCGIKCWFVKSGEWISGIFSGNWIVLIVLCVFLLFSLVLLSILCPVRKHKKS

SEQ ID NO: 958 - protein, 1135 aa, Artificial Sequence
  derived and/or modified protein sequence (wt) from HTNV(Aa09-1000)__KT935001.1__GP
MGIWKWLVMASLVWPVLTLRNVYDMKIECPHTVSFGENSVIGYVELPPMPLADTAQLVPESSCSMDNHQSLNTITKYTQVSWRGKADQSQSSQNSFETVSTEVDLKGTCVLKHKMVEESYRSRKSITCYDLSCNSTYCKPTLYMIVPIHACNMMKSCLIALGPYRVQVVYERTYCMTGVLIEGKCFVPDQSVVSIIKHGIFDIASVHIVCFFVAVKGNTYKIFEQVKKSFESTCNDTENKVQGYYICIVGGNSAPIYVPTLDDFRSMEAFTGIFRSPHGEDHDLAGEETATYSIVGPANAKVPHSASSDTLSLIAFSGIPSYSSLSILTSSTEAKHVFSPGLFPKLNHTNCDKGAIPLMWTGMIDLPGYYEAIHPCTVFCVLSGPGASCEAFSEGGIFNITSPMCLVSKQNRFRLTEQQVNFVCQRVDVDIVVYCNGQRKVILTKTLVIGQCIYTITSLFSLLPGVAHSIAVELCVPGFHGWATAALLVTFCFGWVLIPAITFIILTILKFIANIFHTSNQENRLKSVLRKIKEEFEKTKGSMVCDVCKYECETYKELKAHGVSCPQSQCPYCFTHCEPTEAAFQAHYKVCQVTHRFRDDLKKTVTPQNFTPGCYRTLNLFRYKSRCYIFTMWIFLLVLESILWAASASETPLTPVWNDNAHGVGSVPMHTDLELDFSLTSSSKYTYRRKLTNPLEEAQSIDLHIEIEEQTIGVDVHALGHWFDGRLNLKTSFHCYGACTKYEYPWHTAKCHYERDYQYETSWGCNPSDCPGVGTGCTACGLYLDRLKPVGSAYKIITIRYSRRVCVQFGEENLCKIIDMNDCFVSRHVKVCIIGTVSKFSQGDTLLFFGPLEGGGLIFKHWCTSTCQFGDPGDIMSPRDKGFLCPEFPGSFRKKCNFATTPICEYDGNMVSGYKKVMATIDSFQSFNTSTMHFTDERIEWKDPDGMLRDHINILVTKDIDFDNLGENPCKIGLQTSSIEGAWGSGVGFTLTCLVSLTECPTFLTSIKACDKAICYGAESVTLTRGQNTVKVSGKGGHSGSTFKCCHGEDCSQIGLHAAAPHLDKVNGISEMENSKVYDDGAPQCGIKCWFVKSGEWISGIFSGNWIVLIVLCVFLLFSLVLLSILCPVRKHKKS

SEQ ID NO: 959 - protein, 1135 aa, Artificial Sequence
  derived and/or modified protein sequence (wt) from HTNV(Aa09-948)__KT935000.1__GP
MGIWKWLVMASLVWPVLTLRNVYDMKIECPHTVSFGENSVIGYVELPPMPLADTAQLVPESSCSMDNHQSLNTITKYTQVSWRGKADQSQSSQNSFETVSTEVDLKGTCVLKHKMVEESYRSRKSITCYDLSCNSTYCKPTLYMIVPIHACNMMKSCLIALGPYRVQVVYERTYCMTGVLIEGKCFVPDQSVVSIIKHGIFDIASVHIVCFFVAVKGNTYKIFEQVKKSFESTCNDTENKVQGYYICIVGGNSAPIYVPTLDDFRSMEAFTGIFRSPHGEDHDLAGEETATYSIVGPANAKVPHSASSDTLSLIAFSGIPSYSSLSILTSSTEAKHVFSPGLFPKLNHTNCDKGAIPLMWTGMIDLPGYYEAIHPCTVFCVLSGPGASCEAFSEGGIFNITSPMCLISKQNRFRLTEQQVNFVCQRVDVDIVVYCNGQRKVILTKTLVIGQCIYTITSLFSLLPGVAHSIAVELCVPGFHGWATAALLVTFCFGWVLIPAITFIILTILKFIANIFHTSNQENRLKSVLRKIKEEFEKTKGSMVCDVCKYECETYKELKAHGVSCPQSQCPYCFTHCEPTEAAFQAHYKVCQVTHRFRDDLKKTVTPQNFTPGCYRTLNLFRYKSRCYIFTMWIFLLVLESILWAASASETPLTPVWNDNAHGVGSVPMHTDLELDFSLTSSSKYTYRRKLTNPLEEAQSIDLHIEIEEQTIGVDVHALGHWFDGRLNLKTSFHCYGACTKYEYPWHTAKCHYERDYQYETSWGCNPSDCPGVGTGCTACGLYLDRLKPVGSAYKIITIRYSRRVCVQFGEENLCKIIDMNDCFVSRHVKVCIIGTVSKFSQGDTLLFFGPLEGGGLIFKHWCTSTCQFGDPGDIMSPRDKGFLCPEFPGSFRKKCNFATTPICEYDGNMVSGYKKVMATIDSFQSFNTSTMHFTDERIEWKDPDGMLRDHINILVTKDIDFDNLGENPCKIGLQTSSIEGAWGSGVGFTLTCLVSLTECPTFLTSIKACDKAICYGAESVTLTRGQNTVKVSGKGGHSGSTFKCCHGEDCSQIGLHAAAPHLDKVNGISEMENSKVYDDGAPQCGIKCWFVKSGEWISGIFSGNWIVLIVLCVFLLFSLVLLSILCPVRKHKKS

SEQ ID NO: 960 - protein, 1135 aa, Artificial Sequence
  derived and/or modified protein sequence (wt) from HTNV(Aa10-434)__KT935004.1__GP
MGIWKWLVMASLVWPVLTLRNVYDMKIECPHTVSFGGNSVIGYVELPPMPLADTAQLVPESSCSMDNHQSLNTITKYTQVSWRGKADQSQSSQISFETVSTEVDLKGTCVLKHKMVEESYRSRKSITCYDLSCNSTYCKPTLYMIVPIHACNMMKSCLIALGPYRVQVVYERTYCMTGVLIEGKCFVPDQSVVSIIKHGIFDIASVHIVCFFVAVKGNTYKIFEQVKKSFESTCNDTENKVQGYYICIVGGNSAPIYVPTLDDFRSMEAFTGIFRSPHGEDHDLAGEETATYSIVGPANAKVPHSASSDTLSLIAFSGIPSYSSLSILTSSTEAKHVFSPGLFPKLNHTNCDKGAIPLMWTGMIDLPGYYEAIHPCTVFCVLSGPGASCEAFSEGGIFNITSPMCLVSKQNRFRLTEQQVNFVCQRVDVDIVVYCNGQRKVILTKTLVIGQCIYTITSLFSLLPGVAHSIAVELCVPGFHGWATAALLVTFCFGWVLIPAITFIILTILKFIANIFHTSNQENRLKSVLRKIKEEFEKTKGSMVCDVCKYECETYKELKAHGVSCPQSQCPYCFTHCEPTEAAFQAHYKVCQVTHRFRDDLKKTVTPQNFTPGCYRTLNLFRYKSRCYIFTMWIFLLVLESILWAASASETPLTPVWNDNAHGVGSVPMHTDLELDFSLTSSSKYTYRRKLTNPLEEAQSIDLHIEIEEQTIGVDVHALGHWFDGRLNLKTSFHCYGACTKYEYPWHTAKCHYERDYQYETSWGCNPSDCPGVGTGCTACGLYLDRLKPVGSAYKIITIRYSRRVCVQFGEENLCKIIDMNDCFVSRHVKVCIIGTISKFSQGDTLLFFGPLEGGGLIFKHWCTSTCQFGDPGDIMSPRDKGFLCPEFPGSFRKKCNFATTPICEYDGNMVSGYKKVMATIDSFQSFNTSTMHFTDERIEWKDPDGMLRDHINILVTKDIDFDNLGENPCKIGLQASSIEGAWGSGVGFTLTCLVSLTECPTFLTSIKACDKAICYGAESVTLTRGQNTVKVSGKGGHSGSTFKCCHGEDCSQIGLHAAAPHLDKVNGISEMENSKVYDDGAPQCGIKCWFVKSGEWISGIFSGNWIVLIVLCVFLLFSLVLLSILCPVRKHKKS

SEQ ID NO: 961 - protein, 1135 aa, Artificial Sequence
  derived and/or modified protein sequence (wt) from HTNV(Aa10-518)__KT935005.1__GP
MGIWKWLVMASLVWPVLTLRNVYDMKIECPHTVSFGENSVIGYVELPPMPLADTAQLVPESSCSMDNHQSLNTITKYTQVSWRGKADQSQSSQNSFETVSTEVDLKGTCVLKHKMVEESYRSRKSITCYDLSCNSTYCKPTLYMIVPIHACNMMKSCLIALGPYRVQVVYERTYCMTGVLIEGKCFVPDQSVVSIIKHGIFDIASVHIVCFFVAVKGNTYKIFEQVKKSFESTCNDTKNKVQGYYICIVGGNSAPIYVPTLDDFRSMEAFTGIFRSPHGEDHDLAGEETATYSIVGPANAKVPHSASSDTLSLIAFSGIPSYSSLSILTSSTEAKHVFSPGLFPKLNHTNCDKGAIPLMWTGMIDLPGYYEAIHPCTVFCVLSGPGASCEAFSEGGIFNITSPMCLVSKQNRFRLTEQQVNFVCQRVDVDIVVYCNGQRKVILTKTLVIGQCIYTITSLFSLLPGVAHSIAVELCVPGFHGWATAALLVTFCFGWVLIPAITFIILTILKFIANIFHTSNQENRLKSVLRKIKEEFEKTKGSMVCDVCKYECETYKELKAHGVSCPQSQCPYCFTHCEPTEAAFQAHYKVCQVTHRFRDDLKKTVTPQNFTPGCYRTLNLFRYKSRCYIFTMWIFLLVLESILWAASASETPLTPVWNDNAHGVGSVPMHTDLELDFSLTSSSKYTYRRKLTNPLEEAQSIDLHIEIEEQTIGVDVHALGHWFDGRLNLKTSFHCYGACTKYEYPWHTAKCHYERDYQYETSWGCNPSDCPGVGTGCTACGLYLDRLKPVGSAYKIITIRYSRRVCVQFGEENLCKIVDMNDCFVSRHVKVCIIGTVSKFSQGDTLLFFGPLEGGGLIFKHWCTSTCQFGDPGDIMSPRDKGFLCPEFPGSFRKKCNFATTPICEYDGNMVSGYKKVMATIDSFQSFNTSTMHFTDERIEWKDPDGMLRDHINILVTKDIDFDNLGENPCKIGLQTSSIEGAWGSGVGFTLTCLVSLTECPTFLTSIKACDKAICYGAESVTLTRGQNTVKVSGKGGHSGSTFKCCHGEDCSQIGLHAAAPHLDKVNGISEMENSKVYDDGAPQCGIKCWFVKSGEWISGIFSGNWIVLIVLCVFLLFSLVLLSILCPVRKHKKS

SEQ ID NO: 962 - protein, 1135 aa, Artificial Sequence
  derived and/or modified protein sequence (wt) from HTNV(Aa10-561)__KT935006.1__GP
MGIWKWLVMASLVWPVLTLRNVYDMKIECPHTVSFGENSVIGYVELPPMPLADTAQLVPESSCSMDNHQSLNTITKYTQVSWRGKADQSQSSQISFETVSTEVDLKGTCVLKHKMVEESYRSRKSITCYDLSCNSTYCKPTLYMIVPIHACNMMKSCLIALGPYRVQVVYERTYCMTGVLIEGKCFVPDQSVVSIIKHGIFDIASVHIVCFFVAVKGNTYKIFEQVKKSFESTCNDTENKVQGYYICIVGGNSAPIYVPTLDDFRSMEAFTGIFRSPHGEDHDLAGEETATYSIVGPANAKVPHSASSDTLSLIAFSGIPSYSSLSILTSSTEAKHVFSPGLFPKLNHTNCDKGAIPLMWTGMIDLPGYYEAIHPCTVFCVLSGPGASCEAFSEGGIFNITSPMCLVSKQNRFRLTEQQVNFVCQRVDVDIVVYCNGQRKVILTKTLVIGQCIYTITSLFSLLPGVAHSIAVELCVPGFHGWATAALLVTFCFGWVLIPAITFIILTILKFIANIFHTSNQENRLKSVLRKIKEEFEKTKGSMVCDVCKYECETYKELKAHGVSCPQSQCPYCFTHCEPTEAAFQAHYKVCQVTHRFRDDLKKTVTPQNFTPGCYRTLNLFRYKSRCYIFTMWIFLLVLESILWAASASETPLTPVWNDNAHGVGSVPMHTDLELDFSLTSSSKYTYRRKLTNPLEEAQSIDLHIEIEEQTIGVDVHALGHWFDGRLNLKTSFHCYGACTKYEYPWHTAKCHYERDYQYETSWGCNPSDCPGVGTGCTACGLYLDRLKPVGSAYKIITIRYSRRVCVQFGEENLCKIIDMNDCFVSRHVKVCIIGTISKFSQGDTLLFFGPLEGGGLIFKHWCTSTCQFGDPGDIMSPRDKGFLCPEFPGSFRKKCNFATTPICEYDGNMVSGYKKVMATIDSFQSFNTSTMHFTDERIEWKDPDGMLRDHINILVTKDIDFDNLGENPCKIGLQASSIEGAWGSGVGFTLTCLVSLTECPTFLTSIKACDKAICYGAESVTLTRGQNTVKVSGKGGHSGSTFKCCHGEDCSQIGLHAAAPHLDKVNGISEMENSKVYDDGAPQCGIKCWFVKSGEWISGIFSGNWIVLIVLCVFLLFSLVLLSILCPVRKHKKS

SEQ ID NO: 963 - protein, 1135 aa, Artificial Sequence
  derived and/or modified protein sequence (wt) from HTNV(Aa14-172)__KT935008.1__GP
MGIWKWLVMASLVWPVLTLRNVYDMKIECPHTVSFGENSVIGYVELPPMPLTDTAQLVPESSCSMDNHQSLNTITKYTQVSWRGKADQSQSSQNSFETVSTEVDLKGTCVLKHKMIEESYRSRKSITCYDLSCNNTYCKPTLYMIVPIHACNMMKSCLIALGPYRVQVVYERTYCMTGVLIEGKCFVPDQSVVSIIKHGIFDIASVHIVCFFVAVKGNTYKIFEQVKKSFESTCNDTENKVQGYYICIVGGNSAPIYVPTLDDFRSMEAFTGIFRSPHGEDHDLAGEETATYSIVGPANAKVPHSASSDTLSLIAFSGIPSYSSLSILTSSTEAKHVFSPGLFPKLNHTNCDKGAIPLMWTGMIDLPGYYEAIHPCTVFCVLSGPGASCEAFSEGGIFNITSPMCLVSKQNRFRLTEQQVNFVCQRVDVDIVVYCNGQRKVILTKTLVIGQCIYTITSLFSLLPGVAHSIAVELCVPGFHGWATAALLVTFCFGWVLIPAITFIILTILKFIANIFHTSNQENRLKSVLRKIKEEFEKTKGSMVCDVCKYECETYKELKAHGVSCPQSQCPYCFTHCEPTEAAFQAHYKVCQVTHRFRDDLKKTVTPQNFTPGCYRTLNLFRYKSRCYIFTMWIFLLVLESILWAASASETPLTPVWNDNAHGVGSVPMHTDLELDFSLTSSSKYTYRRKLTNPLEEAQSIDLHIEIEEQTIGVDVHALGHWFDGRLNLKTSFHCYGACTKYEYPWHTAKCHYERDYQYETSWGCNPSDCPGVGTGCTACGLYLDRLKPVGSAYKIITIRYSRRVCVQFGEENLCKIIDMNDCFVSRHVKVCIIGTVSKFSQGDTLLFFGPLEGGGLIFKHWCTSTCQFGDPGDIMSPRDKGFLCPEFPGSFRKKCNFATTPICEYDGNMVSGYKKVMATIDSFQSFNTSTMHFTDERIEWKDPDGMLRDHINILVTKDIDFDNLGENPCKIGLQTSSIEGAWGSGVGFTLTCLVSLTECPTFLTSIKACDKAICYGAESVTLTRGQNTVKVSGKGGHSGSTFKCCHGEDCSQIGLHAAAPHLDKVNGISEVENSKVYDDGAPQCGIKCWFVKSGEWISGIFSGNWIVLIVLCVFLLFSLVLLSILCPVRKHKKS

SEQ ID NO: 964 - protein, 1135 aa, Artificial Sequence
  derived and/or modified protein sequence (wt) from HTNV(Aa14-266)__KT935013.1__GP
MGIWKWLVMASLVWPVLTLRNVYDMKIECPHTVSFGENSVIGYVELPPMPLADTAQMVPESSCSMDNHQSLNTITKYTQVSWRGKADQSQSNQNSFETVSTEVDLKGTCVLKHKMVEESYRSRKSITCYDLSCNSTYCKPTLYMIVPIHACNMMKSCLIALGPYRVQVVYERTYCMTGVLIEGKCFVPDQSVVSIIKHGIFDIASVHIVCFFVAVKGNTYKIFEQVKKSFESTCNDTENKVQGYYICIVGGNSAPIYVPTLDDFRSMEAFTGIFRSPHGEDHDLAGEEIATYSIVGPANAKVPHSASSDTLSLIAYSGIPSYSSLSILTSSTEAKHVFSPGLFPKLNHTNCDKSAIPLMWTGMIDLPGYYEAVHPCTVFCVLSGPGASCEAFSEGGIFNITSPMCLVSKQNRFRLTEQQVNFVCQRVDVDIVVYCNGQRKVILTKTLVIGQCIYTITSLFSLLPGVAHSIAVELCVPGFHGWATAALLVTFCFGWVLIPAITFIILTILKFIANIFHTSNQENRLKSVLRKIKEEFEKTKGSMVCDVCKYECETYKELKAHGVSCPQSQCPYCFTHCEPTEAAFQAHYKVCQVTHRFRDDLKKTVTPQNFTPGCYRTLNLFRYKSRCYIFTMWIFLLVLESILWAASASETPLTPVWNDNAHGVGSVPMHTDLELDFSLTSSSKYTYRRKLTNPLEEAQSIDLHIEIEEQTIGVDVHALGHWFDGRLNLKTSFHCYGACTKYEYPWHTAKCHYERDYQYETSWGCNPSDCPGVGTGCTACGLYLDQLKPVGSAYKIITIRYSRRVCVQFGEENLCKTIDMNDCFVSRHVKVCIIGTVSKFSQGDTLLFFGPLEGGGLIFKHWCTSTCQFGDPGDIMSPRDKGFLCPEFPGSFRKKCNFATTPICEYDGNMVSGYKKVMATIDSFQSFNTSTMHFTDERIEWKDPDGMLRDHINILVTKDIDFDNLGENPCKIGLQTSSIEGAWGSGVGFTLTCLVSLTECPTFLTSIKACDKAICYGAESVTLTRGQNTVKVSGKGGHSGSTFKCCHGEDCSQIGLHAAAPHLDKVNGISEMENSKVYDDGAPQCGIKCWFVKSGEWISGIFSGNWIVLIVLCVFLLFSLVLLSILCPVRKHKKS

SEQ ID NO: 965 - protein, 1135 aa, Artificial Sequence
  derived and/or modified protein sequence (wt) from HTNV(Aa14-272)__KT935014.1__GP
MGIWKWLVMASLVWPVLTLRNVYDMKIECPHTVSFGENSVIGYVELPPMPLADTAQMVPESSCSMDNHQSLNTITKYTQVSWRGKADQSQSNQNSFETVSTEVDLKGTCVLKHKMVEESYRSRKSITCYDLSCNSTYCKPTLYMIVPIHACNMMKSCLIALGPYRVQVVYERTYCMTGVLIEGKCFVPDQSVVSIIKHGIFDIASVHIVCFFVAVKGNTYKIFEQVKKSFESTCNDTENKVQGYYICIVGGNSAPIYVPTLDDFRSMEAFTGIFRSPHGEDHDLAGEEIATYSIVGPANAKVPHSASSDTLSLIAYSGIPSYSSLSILTSSTEAKHVFSPGLFPKLNHTNCDKSAIPLMWTGMIDLPGYYEAVHPCTVFCVLSGPGASCEAFSEGGIFNITSPMCLVSKQNRFRLTEQQVNFVCQRVDVDIVVYCNGQRKVILTKTLVIGQCIYTITSLFSLLPGVAHSIAVELCVPGFHGWATAALLVTFCFGWVLIPAITFIILTILKFIANIFHTSNQENRLKSVLRKIKEEFEKTKGSMVCDVCKYECETYKELKAHGVSCPQSQCPYCFTHCEPTEAAFQAHYKVCQVTHRFRDDLKKTVTPQNFTPGCYRTLNLFRYKSRCYIFTMWIFLLVLESILWAASASETPLTPVWNDNAHGVGSVPMHTDLELDFSLTSSSKYTYRRKLTNPLEEAQSIDLHIEIEEQTIGVDVHALGHWFDGRLNLKTSFHCYGACTKYEYPWHTAKCHYERDYQYETSWGCNPSDCPGVGTGCTACGLYLDQLKPVGSAYKIITIRYSRRVCVQFGEENLCKIIDMNDCFVSRHVKVCIIGTVSKFSQGDTLLFFGPLEGGGLIFKHWCTSTCQFGDPGDIMSPRDKGFLCPEFPGSFRKKCNFATTPICEYDGNMVSGYKKVMATIDSFQSFNTSTMHFTDERIEWKDPDGMLRDHINILVTKDIDFDNLGENPCKIGLQTSSIEGAWGSGVGFTLTCLVSLTECPTFLTSIKACDKAICYGAESVTLTRGQNTVKVSGKGGHSGSTFKCCHGEDCSQIGLHAAAPHLDKVNGISEMENSKVYDDGAPQCGIKCWFVKSGEWISGIFSGNWIVLIVLCVFLLFSLVLLSILCPVRKHKKS

SEQ ID NO: 966 - protein, 1135 aa, Artificial Sequence
  derived and/or modified protein sequence (wt) from HTNV(Aa14-362)__KT935015.1__GP
MGIWKWLVMASLVWPVLTLRNVYDMKIECPHTVSFGENSVIGYVELPPMPLADTAQLVPESSCSMDNHQSLNTITKYTQVSWRGKADQSQSSQNSFEAVSTEVDLKGTCVLKHKMVEESYRSRKSITCYDLSCNSTYCKPTLYMIVPIHACNMMKSCLIALGPYRVQVVYERTYCMTGVLIEGKCFVPDQSVVSIIKHGIFDIASVHIVCFFVAVKGNTYKIFEQVKKSFESTCNDTENKVQGYYICIVGGNSAPIYVPTLDDFRSMEAFTGIFRSPHGEDHDLAGEETATYSIVGPANAKVPHSASSDTLSLIAFSGIPSYSSLSILTSSTEAKHVFSPGLFPKLNHTNCDKGAIPLMWTGMIDLPGYYEAIHPCTVFCVLSGPGASCEAFSEGGIFNITSPMCLVSKQNRFRLTEQQVNFVCQRVDVDIIVYCNGQRKVILTKTLVIGQCIYTITSLFSLLPGVAHSIAVELCVPGFHGWATAALLVTFCFGWVLIPAITFIILTILKFIANIFHTSNQENRLKSVLRKIKEEFEKTKGSMVCDVCKYECETYKELKAHGVSCPQSQCPYCFTHCEPTEAAFQAHYKVCQVTHRFRDDLKKTVTPQNFTPGCYRTLNLFRYKSRCYIFTMWIFLLVLESILWAASASETPLTPVWNDNAHGVGSVPMHTDLELDFSLTSSSKYTYRRKLTNPLEEAQSIDLHIEIEEQTIGVDVHALGHWFDGRLNLKTSFHCYGACTKYEYPWHTAKCHYERDYQYETSWGCNPSDCPGVGTGCTACGLYLDRLKPVGSAYKIITIRYSRRVCVQFGEENLCKIIDMNDCFVSRHVKVCIIGTVSKFSQGDTLLFFGPLEGGGLIFKHWCTSTCQFGDPGDIMSPRDKGFLCPEFPGSFRKKCNFATTPICEYDGNMVSGYKKVMATIDSFQSFNTSTMHFTDERIEWKDPDGMLRDHINILVTKDIDFDNLGENPCKIGLQTSSIEGAWGSGVGFTLTCLVSLTECPTFLTSIKACDKAICYGAESVTLTRGQNTVKVSGKGGHSGSTFKCCHGEDCSQIGLHAAAPHLDKVNGISEMENSKVYDDGAPQCGIKCWFVKSGEWISGIFSGNWIVLIVLCVFLLFSLVLLSILCPVRKHKKS

SEQ ID NO: 967 - protein, 1135 aa, Artificial Sequence
  derived and/or modified protein sequence (wt) from HTNV(Aa14-404)__KT935018.1__GP
MGIWKWLVMASLVWPVLTLRNVYDMKIECPHTVSFGENSVIGYVELPPMPLADTAQMVPESSCSMDNHQSLNTITKYTQVSWRGKADQSQSSQNSFETVSTEVDLKGTCVLKHKMVEESYRSRKSITCYDLSCNSTYCKPTLYMIVPIHACNMMKSCLIALGPYRVQVVYERTYCMTGVLIEGKCFVPDQSVVSIIKHGIFDIASVHIVCFFVAVKGNTYKIFEQVKKSFESTCNDTENKVQGYYICIVGGNSAPIYVPTLDDFRSMEAFTGIFRSPHGEDHDLAGEEIATYSIVGPANAKVPHSASSDTLSLIAYSGIPSYSSLSILTSSTEAKHVFSPGLFPKLNHTNCDKSAIPLMWTGMIDLPGYYEAVHPCTVFCVLSGPGASCEAFSEGGIFNITSPMCLVSKQNRFRLTEQQVNFVCQRVDVDIVVYCNGQRKVILTKTLVIGQCIYTITSLFSLLPGVAHSIAVELCVPGFHGWATAALLVTFCFGWVLIPAITFIILTILKFIANIFHTSNQENRLKSVLRKIKEEFEKTKGSMVCDVCKYECETYKELKAHGVSCPQSQCPYCFTHCEPTEATFQAHYKVCQVTHRFRDDLKKTVTPQNFTPGCYRTLNLFRYKSRCYIFTMWIFLLVLESILWAASASETPLTPVWNDNAHGVGSVPMHTDLELDFSLTSSSKYTYRRKLTNPLEEAQSIDLHIEIEEQTIGVDVHALGHWFDGRLNLKTSFHCYGACTKYEYPWHTAKCHYERDYQYETSWGCNPSDCPGVGTGCTACGLYLDQLKPVGSAYKIITIRYSRRVCVQFGEENLCKIIDMNDCFVSRHVKVCIIGTVSKFSQGDTLLFFGPLEGGGLIFKHWCTSTCQFGDPGDIMSPRDKGFLCPEFPGSFRKKCNFATTPLCEYDGNMVSGYKKVMATIDSFQSFNTSTMHFTDERIEWKDPDGMLRDHINILVTKDIDFDNLGENPCKIGLQTSSIEGAWGSGVGFTLTCLVSLTECPTFLTSIKACDKAICYGAESVTLTRGQNTVKVSGKGGHSGSTFKCCHGEDCSQIGLHAAAPHLDKVNGISEMENSKVYDDGAPQCGIKCWFVKSGEWISGIFSGNWIVLIVLCVFLLFSLVLLSILCPVRKHKKS

SEQ ID NO: 968 - protein, 1135 aa, Artificial Sequence
  derived and/or modified protein sequence (wt) from HTNV(Aa14-423)__KT935022.1__GP
MGIWKWLVMASLVWPVLTLRNVYDMKIECPHTVSFGENSVIGYVELPPMPLADTAQMVPESSCSMDNHQSLNTITKYTQVSWRGKADQSQSSQNSFETVSTEVDLKGTCVLKHKMVEESYRSRKSITCYDLSCNSTYCKPTLYMIVPIHACNMMKSCLIALGPYRVQVVYERTYCMTGVLIEGKCFVPDQSVVSIIKHGIFDIASVHIVCFFVAVKGNTYKIFEQVKKSFESTCNDTENKVQGYYICIVGGNSAPIYVPTLDDFRSMEAFTGIFRSPHGEDHDLAGEEIATYSIVGPANAKVPHSASSDTLSLIAYSGIPSYSSLSILTSSTEAKHVFSPGLFPKLNHTNCDKSAIPLMWTGMIDLPGYYEAVHPCTVFCVLSGPGASCEAFSEGGIFNITSPMCLVSKQNRFRLTEQQVNFVCQRVDVDIVVYCNGQRKVILTKTLVIGQCIYTITSLFSLLPGVAHSIAVELCVPGFHGWATAALLVTFCFGWVLIPAITLIILTILKFIANIFHTSNQENRLKSVLRKIKEEFEKTKGSMVCDVCKYECETYKELKAHGVSCPQSQCPYCFTHCEPTEATFQAHYKVCQVTHRFRDDLKKTVTPQNFTPGCYRTLNLFRYKSRCYIFTMWIFLLVLESILWAASASETPLTPVWNDNAHGVGSVPMHTDLELDFSLTSSSKYTYRRKLTNPLEEAQSIDLHIEIEEQTIGVDVHALGHWFDGRLNLKTSFHCYGACTKYEYPWHTAKCHYERDYQYETSWGCNPSDCPGVGTGCTACGLYLDQLKPVGSAYKIITIRYSRRVCVQFGEENLCKIIDMNDCFVSRHVKVCIIGTVSKFSQGDTLLFFGPLEGGGLIFKHWCTSTCQFGDPGDIMSPRDKGFLCPEFPGSFRKKCNFATTPLCEYDGNMVSGYKKVMATIDSFQSFNTSTMHFTDERIEWKDPDGMLRDHINILVTKDIDFDNLGENPCKIGLQTSSIEGAWGSGVGFTLTCLVSLTECPTFLTSIKACDKAICYGAESVTLTRGQNTVKVSGKGGHSGSTFKCCHGEDCSQIGLHAAAPHLDKVNGISEMENSKVYDDGAPQCGIKCWFVKSGEWISGIFSGNWIVLIVLCVFLLFSLVLLSILCPVRKHKKS

SEQ ID NO: 969 - protein, 1135 aa, Artificial Sequence
  derived and/or modified protein sequence (wt) from HTNV(Aa15-56)__KU207187.1__GP
MGIWKWLVMASLVWPVLTLRNVYDMKIECPHTVSFGENSVIGYVELPPMPLADTAQLVPESSCSMDNHQSLNTITKYTQVSWRRKADQSQSSQNSFETVSTEVDLKGTCVLKHKMVEESYRSRKSITCYDLSCNSTYCKPTLYMIVPIHACNMMKSCLIALGPYRVQVVYERTYCMTGALIEGKCFVPDQSVVSIIKHGIFDIASVHIVCFFVAVKGNTYKIFEQVKKSFESTCNDTENKVQGYYICIVGGNSAPIYVPTLDDFRSMEAFTGIFRSPHGEDHDLAGEETATYSIVGPANAKVPHSASSDTLSLIAFSGIPSYSSLSILTSSTEAKHVFSPGLFPKLNHTNCDKGAIPLMWTGMIDLPGYYEAIHPCTVFCVLSGPGASCEAFSEGGIFNITSPMCLVSKQNRFRLTEQQVNFVCQRVDVDIVVYCNGQRKVILTKTLVIGQCIYTITSLFSLLPGVAHSIAVELCVPGFHGWATAALLVTFCFGWVLIPAITFIILTILKFIANIFHTSNQENRLKSVLRKIKEEFEKTKGSMVCDVCKYECETYKELKAHGVSCPQSQCPYCFTHCEPTEAAFQAHYKVCQVTHRFRDDLKKTVTPQNFTPGCYRTLNLFRYKSRCYIFTMWIFLLVLESILWAASASETPLTPVWNDNAHGVGSVPMHTDLELDFSLTSSSKYTYRRKLTNPLEEAQSIDLHIEIEEQTIGVDVHALGHWFDGRLNLKTSFHCYGACTKYEYPWHTAKCHYERDYQYETSWGCNPSDCPGVGTGCTACGLYLDRLKPVGSAYKIITIRYSRRVCVQFGEENLCKIIDMNDCFVSRHVKVCIIGTVSKFSQGDTLLFFGPLEGGGLIFKHWCTSTCQFGDPGDIMSPRDKGFLCPEFPGSFRKKCNFATTPICEYDGNMVSGYKKVMATIDSFQSFNTSTMHFTDERIEWKDPDGMLRDHINILVTKDIDFDNLGENPCKIGLQTSSIEGAWGSGVGFTLTCLVSLTECPTFLTSIKACDKAICYGAESVTLTRGQNTVKVSGKGGHSGSTFKCCHGEDCSQIGLHAAAPHLDKVNGISEMENSKVYDDGAPQCGIKCWFVKSGEWISGIFSGNWIVLIVLCVFLLFSLVLLSILCPVRKHKKS

SEQ ID NO: 970 - protein, 1135 aa, Artificial Sequence
  derived and/or modified protein sequence (wt) from HTNV(CBAa11-106)__KC576787.1__GP
MGMWKWLVIASLVWPALTLRNVYDMKIECPHTVSFGENSVIGYVELPPMPLADTAQMVPESSCSMDNHQSMNTITKYTQVIWRGKADPGQSSQNSFETVSTEIDLKGTCVLKHKMVEESYRSRKSITCYDLSCNSTYCKPTLYMIVPIHACNMMKSCLIALGPYRVQVVYERTYCMTGVLIEGKCFVPDQSVVSIIKHGIFDIASVHIVCFFVAVKGNTYKLFEQVKKSFESTCNDTENKVQGYYICIVGGNFAPIYVPTLDDFRSMEAFTGIFRSPHGEDHDLAGEEIASYSIVGPANAKVPHSASSDTLSLIAYSGIPSYSSLSILTSSTEAKHVFSPGLFPKLNHTNCDKSAIPLTWTGMIDLPGYYEAIHPCTVFCVLSGPGASCEAFSEGGIFNITSPMCLVSKQNRFRLTEQQVNFVCQRVDMDIVVYCNGQRKVILTKTLVIGQCIYTITSLFSLLPGVAHSIAVELCVPGFHGWATAALLVTFCFGWVLIPAITFIILTVLKFVANIFHTSNQENRLKSVLRKIKEEFEKTKGSMVCDVCKYECETYKELKAHGVSCPQSQCPYCFTHCEPTEAAFQAHYKVCQVTHRFRDDLKKTVTPQNFTPGCYRTLNLFRYKSRCYIFTMWVFLLILESVLWAASASETPLTPVWNDNAHGVGSVPMHTDLELDFSLTSSSKYTYRRKLTNPLEEAQSIDLHIEIEEQTIGVDVHALGHWFDGRLNLKTSFHCYGACTKYEYPWHTAKCHYERDYQYETSWGCNPSDCPGVGTGCTACGLYLDQLKPVGSAYKIITIRYSRRVCVQFGEENLCKIIDMNDCFVSRHVKVCIIGTVSKFSQGDTLLFFGPLEGGGLIFKHWCTSTCQFGDPGDIMSPRDKGFLCPEFPGSFRKKCNFATTPICEYDGNMVSGYKKVMATIDSFQSFNTSTMHFTDERIEWKDPDGMLRDHINILVTKDIDFDNLGENPCKIGLQTSSIEGAWGSGVGFTLTCLVSLTECPTFLTSIKACDKAICYGAESVTLTRGQNTVKVSGKGGHSGSTFKCCHGEDCSQIGLHAAAPHLDKVNGISEIENSKVYDDGAPQCGIKCWFVKSGEWISGIFSGNWIVLIVLCVFLLFSLVLLSILCPVRKHKKS

SEQ ID NO: 971 - protein, 1135 aa, Artificial Sequence
  derived and/or modified protein sequence (wt) from HTNV(CBAa11-26)__KC576786.1__GP
MGMWKWLVIASLVWPALTLRNVYDMKIECPHTVSFGENSVIGYVELPPMPLADTAQMVPESSCSMDNHQSMNTITKYTQVIWRGKADPGQSSQNSFETVSTEIDLKGTCVLKHKMVEESYRSRKSITCYDLSCNSTYCKPTLYMIVPIHACNMMKSCLIALGPYRVQVVYERTYCMTGVLIEGKCFVPDQSVVSIIKHGIFDIASVHIVCFFVAVKGNTYKLFEQVKKSFESTCNDTENKVQGYYICIVGGNSAPIYVPTLDDFRSMEAFTGIFRSPHGEDHDLAGEEIASYSIVGPANAKVPHSASSDTLSLIAYSGIPSYSSLSILTSSTEAKHVFSPGLFPKLNHTNCDKSAIPLTWTGMIDLPGYYEAIHPCTVFCVLSGPGASCEAFSEGGIFNITSPMCLVSKQNRFRLTEQQVNFVCQRVDMDIVVYCNGQRKVILTKTLVIGQCIYTITSLFSLLPGVAHSIAVELCVPGFHGWATAALLVTFCFGWVLIPAITFIILTVLKFVANIFHTSNQENRLKSVLRKIKEEFEKTKGSMVCDVCKYECETYKELKAHGVSCPQSQCPYCFTHCEPTEAAFQAHYKVCQVTHRFRDDLKKTVTPQNFTPGCYRTLNLFRYKSRCYIFTMWVFLLILESVLWAASASETPLTPVWNDNAHGVGSVPMHTDLELDFSLTSSSKYTYRRKLTNPLEEAQSIDLHIEIEEQTIGVDVHALGHWFDGRLNLKTSFHCYGACTKYEYPWHTAKCHYERDYQYETSWGCNPSDCPGVGTGCTACGLYLDQLKPVGSAYKIITIRYSRRVCVQFGEENLCKIIDMNDCFVSRHVKVCIIGTVSKFSQGDTLLFFGPLEGGGLIFKHWCTSTCQFGDPGDIMSPRDKGFLCPEFPGSFRKKCNFATTPICEYDGNMVSGYKKVMATIDSFQSFNTSTMHFTDERIEWKDPDGMLRDHINILVTKDIDFDNLGENPCKIGLQTSSIEGAWGSGVGFTLTCLVSLTECPTFLTSIKACDKAICYGAESVTLTRGQNTVKVSGKGGHSGSTFKCCHGEDCSQIGLHAAAPHLDKVNGISEIENSKVYDDGAPQCGIKCWFVKSGEWISGIFSGNWIVLIVLCVFLLFSLVLLSILCPVRKHKKS

SEQ ID NO: 972 - protein, 1135 aa, Artificial Sequence
  derived and/or modified protein sequence (wt) from HTNV(Fuyuan-Aa-145)__KJ857336.1__GP
MGMWKWLVIASLVWPALSLRNVYDMKIECPHTVSFGENSVIGYVELPPMPLADTAQMVPESSCSMDNHQSINTITKYTQVIWRGKADPGQSSQNSFETVSTEVDLKGTCVLKHKMVEESYRSRKSITCYDLSCNSTFCKPTLYMIVPIHACNMMKSCLIALGPYRVQVVYERTYCMTGVLIEGKCFVPDQSVVSIIKHGIFDIASVHVVCFFVAVKGNTYKLFEQVKKSFESTCNDTENKVQGYYICIVGGNSAPIYVPTLDDFRSMEAFTGIFKSPHGEDHDLAGEEIASYSIVGPANAKVPHSASSDTLSLIAYSGIPSYSSLSILTSSTDAKHVFSPGLFPKLNHTNCDKSAIPLTWTGMIDLPGYYEAIHPCTVFCVLSGPGASCEAFSEGGIFNITSPMCLVSKQNRFRLTEQQVNFVCQRVDMDIVVYCNGQRKVILTKTLVIGQCIYTITSLFSLLPGVAHSIAVELCVPGFHGWATAALLVTFCFGWVLIPAVTFIILTVLKFIANIFHTSNQENRLKSVLRKIKEEFEKTKGSMVCDVCKYECETYKELKAHGVSCPQSQCPYCFTHCEPTEAAFQAHYKVCQVTHRFRDDLKKTVTPQNFTPGCYRTLNLFRYKSRCYIFTMWVFLLILESVLWAASASETPLTPVWNDNAHGVGSVPMHTDLELDFSLTSSSKYTYRRKLTNPLEEAQSIDLHIEIEEQTIGVDVHALGHWFDGRLNLKTSFHCYGACTKYEYPWHTAKCHYERDYQYETSWGCNPSDCPGVGTGCTACGLYLDQLKPVGSAYKIITIRYSRRVCVQFGEENLCKIIDMNDCFVSRHVKVCIIGTVSKFSQGDTLLFFGPLEGGGLIFKHWCTSTCQFGDPGDIMSPRDKGFLCPEFPGSFRKKCNFATTPICEYDGNMVSGYKKVMATIDSFQSFNTSTMHFTDERIEWKDPDGMLRDHINILVTKDIDFDNLGENPCKIGLQTSSIEGAWGSGVGFTLTCLVSLTECPTFLTSIKACDKAICYGAESVTLTRGQNTVKVSGKGGHSGSTFKCCHGEDCSKIGLHAAAPHLDKVNGISEIENSKVYDDGAPQCGIKCWFVKSGEWISGIFSGNWIVLIVLCVFLLFSLVLLSILCPVRKHKKS

SEQ ID NO: 973 - protein, 1135 aa, Artificial Sequence
  derived and/or modified protein sequence (wt) from HTNV(Fuyuan-Aa-26)__KJ857334.1__GP
MGMWKWLVIASLVWPALSLRNVYDMKIECPHTVSFGENSVIGYVELPPMPLADTAQMVPESSCSMDNHQSINTITKYTQVIWRGKADPGQSSQNSFETVSTEVDLKGTCVLKHKMVEESYRSRKSITCYDLSCNSTYCKPTLYMIVPIHACNMMKSCLIALGPYRVQVVYERTYCMTGVLIEGKCFVPDQSVVSIIKHGIFDIASVHIVCFFVAVKGNTYKLFEQVKKSFESTCNDTENKVQGYYICIVGGNSAPIYVPTLDDFRSMEAFTGIFKSPHGEDHDLAGEEIASYSIVGPANAKVPHSASSDTLSLIAYSGIPSYSSLSILTSSTDAKHVFSPGLFPKLNHTNCDKSAIPLTWTGMIDLPGYYEAIHPCTVFCVLSGPGASCEAFSEGGIFNITSPMCLVSKQNRFRLTEQQVNFVCQRVDMDIVVYCNGQRKVILTKTLVIGQCIYTITSLFSLLPGVAHSIAVELCVPGFHGWATAALLVTFCFGWVLIPAVTFIILTVLKFIANIFHTSNQENRLKSVLRKIKEEFEKTKGSMVCDVCKYECETYKELKAHGVSCPQSQCPYCFTHCEPTEAAFQAHYKVCQVTHRFRDDLKKTVTPQNFTPGCYRTLNLFRYKSRCYIFTMWVFLLILESVLWAASASETPLTPVWNDNAHGVGSVPMHTDLELDFSLTSSSKYTYRRKLTNPLEEAQSIDLHIEIEEQTIGVDVHALGHWFDGRLNLKTSFHCYGACTKYEYPWHTAKCHYERDYQYETSWGCNPSDCPGVGTGCTACGLYLDQLKPVGSAYKIITIRYSRRVCVQFGEENLCKIIDMNDCFVSRHVKVCIIGTVSKFSQGDTLLFFGPLEGGGLIFKHWCTSTCQFGDPGDIMSPRDKGFLCPEFPGSFRKKCNFATTPICEYDGNMVSGYKKVMATIDSFQSFNTSTMHFTDERIEWKDPDGMLRDHINILVTKDIDFDNLGENPCKIGLQTSSIEGAWGSGVGFTLTCLVSLTECPTFLTSIKACDKAICYGAESVTLTRGQNTVKVSGKGGHSGSTFKCCHGEDCSKIGLHAAAPHLDKVNGISEIENSKVYDDGAPQCGIKCWFVKSGEWISGIFSGNWIVLIVLCVFLLFSLVLLSILCPVRKHKKS

SEQ ID NO: 974 - protein, 1135 aa, Artificial Sequence
  derived and/or modified protein sequence (wt) from HTNV(JS1)__KP970560.1__GP
MGIWKWLVMASLVWPVLTLRNVYDMKIECPHTVSFGGNSVIGYVELPPVPLADTAQMVPESSCSMDNHQSLNTIAKYTQVSWRGKADQSQSSQNSFETVSTEVDLKGTCVLKHKMVEESYRSRKSVTCYDLSCNSTYCKPTLYMIVPIHACNMMKSCLIALGPYRVQVVYERTYCMTGVLIEGKCFVPDQSVVSIIKHGIFDIASVHIVCFFVAVKGNTYKIFEQVKKSFESTCNDTENKVQGYYICIVGGNSAPIYVPTLDDFRSMEAFTGIFRSPHGEDHDLAGEEIASYSIVGPANAKVPHSASSDTLSLIAYSGIPSYSSLSILTSSTEAKHVFSPGLFPKLNHTNCDKSAIPLIWTGMIDLPGYYEAVHPCTVFCVLSGPGASCEAFSEGGIFNITSPMCLVSKQNRFRLTEQQVNFVCQRVDMDIVVYCNGQRKVILTKTLVIGQCIYTITSLFSLLPGVAHSIAVELCVPGFHGWATAALLVTFCFGWVLIPAITFIILTVLKFIANIFHTSNQENRLKSVLRKIKEEFEKTKGSMVCDVCKYECETYKELKAHGVSCPQSQCPYCFTHCEPTEAAFQAHYKVCQVTHRFRDDLKKTVTPQNFTPGCYRTLNLFRYKSRCYIFTMWIFLLVLESILWAASASETPLTPVWNDNAHGVGSVPMHTDLELDFSLTSSSKYTYRRKLTNPLEEAQSIDLHIEIEEQTIGVDVHALGHWFDGRLNLKTSFHCYGACTKYEYPWHTAKCHYERDYQYETSWGCNPSDCPGVGTGCTACGLYLDQLKPVGSAYKIITIRYSRRVCVQFGEGNLCKIIDMNDCFVSRHVKVCIIGTVSKFSQGDTLLFFGPLEGGGLIFKHWCTSTCQFGDPGDIMSPRDKGFLCPEFPGSFRKKCNFATTPICEYDGNMVSGYKKVMATIDSFQSFNTSTMHFTDERIEWKDPDGMLRDHINILVTKDIDFDNLGENPCKIGLQTSSIEGAWGSGVGFTLTCLVSLTECPTFLTSIKACDKAICYGAESVTLTRGQNTVKVSGKGGHSGSTFKCCHGEDCSQIGLHAAAPHLDKVNGISEIENSKVYDDGAPQCGIKCWFVKSGEWISGIFSGNWIVLIVLCVFLLFSLVLLSILCPVRKHKKS

SEQ ID NO: 975 - protein, 1135 aa, Artificial Sequence
  derived and/or modified protein sequence (wt) from HTNV(LongquanAa-08-150)__JQ912803.1__GP
MGIWKWLVMASLVWPAFTLRNVYDMKIECPHTVSFGENSVIGYVELPPMPLADTAQMVPESSCNMDNHQSMNTITKYTQVSWRGKADQAQASQNSFEAVSAEVDLKGICVLKHKMLEESYRSRKSITCYDLSCNSTYCKPTLYMIVPIHACNMMKSCLIALGPYRVQVVYERTYCMTGVLLEGKCFVPDQSVVSIIKHGIFDIASVHIVCFFVAVKGNTYKLLEQVKKSFQSTCNDTENKVQGYYICIVGGNSAPIYVPTLDDFRSMEAFSGIFRSPHGEDHDLAGEEIASYSIVGPANAKVPHSASSDTLSLIAYSGIPSYSSLSILASSTEAKHVFSPGFFPQLNHTKCDKTAIPLIWTGMIDLPGYYEAIHPCTVFCVLSGPGASCEAFSEGGIFNITSPMCLVSKQNRFRLTEQQVNFVCQRVDVDIIVYCNGQRKVILTKTLVIGQCIYTITSLFSLLPGVAHSIAVELCVPGFHGWATAALLVTFCFGWVLIPALTLIILTILKFIANIFHTCNQENRLKSVLRKIKEEFEKTKGSMVCDVCKYECETYKELKAHGVSCPQSQCPYCFTHCEPTEAAFQAHYRVCQVTHRFRDDLKKTVTPQNFTPGCYRTLNLFRYKSRCYIFTMWVCLLVLESILWAASASEVPLNPVWNDNAHGVGSVPMHTDLELDFSLTSSSKYTYRRRLTNPLEETQSINLHIEIEEQTIGVDVHALGHWFDGRLNLKTSFHCYGACTKYEYPWHTAKCHYERDYQYETSWGCNPADCPGVGTGCTACGLYLDQLKPVGSAYKIITIRYSRKVCVQFGEENLCKVIDMNDCFVTRHVKVCIIGTVSKFSQGDTLLFFGPLEGGGLIFKHWCTSTCQFGDPGDIMSPRDKGFLCPEFPGSFRKKCNFATTPLCEYDGNMVSGYKKVMATIDSFQSFNTSTMHFTDERIEWKDPDGMLRDHINILVTKDIDFDNLGENPCKIGLQTSSIEGAWGSGVGFTLTCLISLTECPTFLTSIKACDKAICYGAESVTLTRGQNTVKVSGKGGHSGSTFKCCHGEECSQIGLHAAAPHLDKVNGISEIENNKVYDDGAPQCGVKCWFVKSGEWISGIFSGNWIVLIVLCVFLLFSLVLLSVLCPVRKHKKS

SEQ ID NO: 976 - protein, 1135 aa, Artificial Sequence
  derived and/or modified protein sequence (wt) from HTNV(LongquanAa-08-157)__JQ912804.1__GP
MEIWKWLVMASLVWPAFTLRNVYDMKIECPHTVSFGENSVIGYVELSPMPLADTAQMVPESSCNMDNHQSMNTITKYTQVSWRGKADQAQASQNSFEAVSAEVDLKGTCVLKHKMLEESYRSRKSITCYDLSCNSTYCKPTLYMIVPIHACNMMKSCLIALGPYRVQVVYERTYCMTGVLIEGKCFVPDQSVVSIIKHGIFDIASVHIVCFFVAVKGNTYKLFEQVKKSFQSTCNGTENKVQGYYICIVGGNSAPIYVPTLDDFRSMEAFSGIFRSPHGEDHDLAGEEIASYSIVGPANAKVPHSASSDTLSLIAYSGIPSYSSLSILASSTEAKHVFSPGFFPQLNHTKCDKTAIPLTWTGMIDLPGYYEAIHPCTVFCVLSGPGASCEAFSEGGIFNITSPMCLVSKQNRFRLTEQQVNFVCQRVDMDIIVYCNGQRKVILTKTLVIGQCIYTITSLFSLLPGVAHSIAVELCVPGFHGWATAALLVTFCFGWVLIPALTLIILTILKFIANLFHTSNQENRLKSVLRKIKEEFEKTKGSMVCDVCKYECETYKELKAHGVSCPQSQCPYCFTHCEPTEAAFQAHYRVCQVTHRFRDDLKKTVTPQNFTPGCYRTLNLFRYKSRCYIFTMWVCLLVLESILWAASASEVPLNPVWNDNAHGVGSVPMHTDLELDFSLTSSSKYTYRRRLTNPLEETQSINLHIEIEEQTIGVDVHALGHWFDGRLNLKTSFHCYGACTKYEYPWHTAKCHYERDYQYETSWGCNPADCPGVGTGCTACGLYLDQLKPVGSAYKIITIRYSRKVCVQFGEENLCKVIDMNDCFVTRHVKVCIIGTVSKFSQGDTLLFFGPLEGGGLIFKHWCTSTCQFGDPGDIMSPRDKGFLCPEFPGSFRKKCNFATTPLCEYDGNMVSGYKKVMATIDSFQSFNTSTMHFTDERIEWKDPDGMLRDHINILVTKDIDFDNLGENPCKIGLQTSSIEGAWGSGVGFTLTCLISLTECPTFLTSIKACDKAICYGAESVTLTRGQNTVKVSGKGGHSGSTFKCCHGEECSQIGLHAAAPHLDKVNGISEIENNKVYDDGAPQCGVKCWFVKSGEWISGIFSGNWIVLIVLCVFLLFSLVLLSVLCPVRKHKKS

SEQ ID NO: 977 - protein, 1135 aa, Artificial Sequence
  derived and/or modified protein sequence (wt) from HTNV(LongquanAa-08-196)__JQ912805.1__GP
MEIWKWLVMASLVWPAFTLRNVYDMKIECPHTVSFGENSVIGYVELPPMPLADTAQMVPESSCNMDNHQSMNTITKYTQVSWRGKADQAQASQNSFEAVSAEVDLKGTCVLKHKMLEESYRSRKSITCYDLSCNSTYCKPTLYMIVPIHACNMMKSCLIALGPYRVQVVYERTYCMTGVLIEGKCFVPDQSVVSIIKHGIFDIASVHIVCFFVAVKGNTYKLFEQVKKSFQSTCNGTENKVQGYYICIVGGNSAPIYVPTLDDFRSMEAFSGIFRSPHGEDHDLAGEEIASYSIVGPANAKVPHSASSDTLSLIAYSGIPSYSSLSILASSTEAKHVFSPGFFPQLNHTKCDKTAIPLTWTGMIDLPGYYEAIHPCTVFCVLSGPGASCEAFSEGGIFNITSPMCLVSKQNRFRLTEQQVNFVCQRVDMDIIVYCNGQRKVILTKTLVIGQCIYTITSLFSLLPGVAHSIAVELCVPGFHGWATAALLVTFCFGWVLIPALTLIILTILKFIANIFHTSNQENRLKSVLRKIKEEFEKTKGSMVCDVCKYECETYKELKAHGVSCPQSQCPYCFTHCEPTEAAFQAHYRVCQVTHRFRDDLKKTVTPQNFTPGCYRTLNLFRYKSRCYIFTMWVCLLVLESILWAASASEVPLNPVWNDNAHGVGSVPMHTDLELDFSLTSSSKYTYRRRLTNPLEETQSINLHIEIEEQTIGVDVHALGHWFDGRLNLKTSFHCYGACTKYEYPWHTAKCHYERDYQYETSWGCNPADCPGVGTGCTACGLYLDQLKPVGSAYKIITIRYSRKVCVQFGEENLCKVIDMNDCFVTRHVKVCIIGTVSKFSQGDTLLFFGPLEGGGLIFKHWCTSTCQFGDPGDIMSPRDKGFLCPEFPGSFRKKCNFATTPLCEYDGNMVSGYKKVMATIDSFQSFNTSTMHFTDERIEWKDPDGMLRDHINILVTKDIDFDNLGENPCKIGLQTSSIEGAWGSGVGFTLTCLISLTECPTFLTSIKACDKAICYGAESVTLTRGQNTVKVSGKGGHSGSTFKCCHGEECSQIGLHAAAPHLDKVNGISEIENNKVYDDGAPQCGVKCWFVKSGEWISGIFSGNWIVLIVLCVFLLFSLVLLSVLCPVRKHKKS

SEQ ID NO: 978 - protein, 1135 aa, Artificial Sequence
  derived and/or modified protein sequence (wt) from HTNV(LongquanAa-08-235)__JQ912810.1__GP
MEIWKWLVMASLVWPAFTLRNVYDMKIECPHTVSFGENSVIGYVELPPMPLADTAQMVPESSCNMDNHQSMNTITKYTQVSWRGKADQAQASQNSFEAVSAEVDLKGTCVLKHKMLEESYRSRKSITCYDLSCNSTYCKPTLYMIVPIHACNMMKSCLIALGPYRVQVVYERTYCMTGVLIEGKCFVPDQSVVSIIKHGIFDIASVHIVCFFVAVKGNTYKLFEQVKKSFQSTCNGTENKVQGYYICIVGGNSAPIYVPTLDDFRSMEAFSGIFRSPHGEDHDLAGEEIASYSIVGPANAKVPHSASSDTLSLIAYSGIPSYSSLSILASSTEAKHVFSPGFFPQLNHTKCDKTAIPLTWTGMIDLPGYYEAIHPCTVFCVLSGPGASCEAFSEGGIFNITSPMCLVSKQNRFRLTEQQVNFVCQRVDMDIIVYCNGQRKVILTKTLVIGQCIYTITSLFSLLPGVAHSIAVELCVPGFHGWATAALLVTFCFGWVLIPALTLIILTILKFIANIFHTSNQENRLKSVLRKIKEEFEKTKGSMVCDVCKYECETYKELKAHGVSCPQSQCPYCFTHCEPTEAAFQAHYRVCQVTHRFRDDLKKTVTPQNFTPGCYRTLNLFRYKSRCYIFTMWVCLLVFESILWAASASEVPLNPVWNDNAHGVGSVPMHTDLELDFSLTSSSKYTYRRRLTNPLEETQSINLHIEIEEQTIGVDVHALGHWFDGRLNLKTSFHCYGACTKYEYPWHTAKCHYERDYQYETSWGCNPADCPGVGTGCTACGLYLDQLKPVGSAYKIITIRYSRKVCVQFGEENLCKVIDMNDCFVTRHVKVCIIGTVSKFSQGDTLLFFGPLEGGGLIFKHWCTSTCQFGDPGDIMSPRDKGFLCPEFPGSFRKKCNFATTPLCEYDGNMVSGYKKVMATIDSFQSFNTSTMHFTDERIEWKDPDGMLRDHINILVTKDIDFDNLGENPCKIGLQTSSIEGAWGSGVGFTLTCLISLTECPTFLTSIKACDKAICYGAESVTLTRGQNTVKVSGKGGHSGSTFKCCHGEECSQIGLHAAAPHLDKVNGISEIENNKVYDDGAPQCGVKCWFVKSGEWISGIFSVNWIVLIVLCVFLLFSLVLLSVLCPVRKHKKS

SEQ ID NO: 979 - protein, 1135 aa, Artificial Sequence
  derived and/or modified protein sequence (wt) from HTNV(LongquanAa-09-171)__JQ912824.1__GP
MEIWKWLVMASLVWPAFTLRNVYDMKIECPHTVSFGENSVIGYVELPPMPLADTAQMVPESSCNMDNHQSMNTITKYTQVSWRGKADQAQASQNSFEAVSAEVDLKGTCVLKHKMLEESYRSRKSITCYDLSCNSTYCKPTLYMIVPIHACNMMKSCLIALGPYRVQVVYERTYCMTGVLIEGKCFVPDQSVVSIIKHGIFDIASVHIVCFFVAVKGNTYKLFEQVKKSFQSTCNGTENKVQGYYICIVGGNSAPIYVPTLDDFRSMEAFSGIFRSPHGEDHDLAGEEIASYSIVGPANAKVPHSASSDTLSLIAYSGIPSYSSLSILASSTEAKHVFSPGFFPQLNHTKCDKTAIPLTWTGMIDLPGYYEAIHPCTVFCVLSGPGASCEAFSEGGIFNITSPMCLVSKQNRFRLTEQQVNFVCQRVDMDIIVYCNGQRKVILTKTLVIGQCIYTITSLFSLLPGVAHSIAVELCVPGFHGWATAALLVTFCFGWVLIPALTLIILTILKFIANIFHTNNQENRLKSVLRKIKEEFEKTKGSMVCDVCKYECETYKELKAHGVSCPQSQCPYCFTHCEPTEAAFQAHYRVCQVTHRFRDDLKKTVTPQNFTPGCYRTLNLFRYKSRCYIFTMWVCLLVLESILWAASASEVPLNPVWNDNAHGVGSVPMHTDLELDFSLTSSSKYTYRRRLTNPLEETQSINLHIEIEEQTIGVDVHALGHWFDGRLNLKTSFHCYGACTKYEYPWHTAKCHYERDYQYETSWGCNPADCPGVGTGCTACGLYLDQLKPVGSAYKIITIRYSRKVCVQFGEENLCKVIDMNDCFVTRHVKVCIIGTVSKFSQGDTLLFFGPLEGGGLIFKHWCTSTCQFGDPGDIMSPRDKGFLCPEFPGSFRKKCNFATTPLCEYDGNMVSGYKKVMATIDSFQSFNTSTMHFTDERIEWKDPDGMLRDHINILVTKDIDFDNLGENPCKIGLQTSSIEGAWGSGVGFTLTCLISLTECPTFLTSIKACDKAICYGAESVTLTRGQNTVKVSGKGGHSGSTFKCCHGEECSQIGLHAAAPHLDKVNGISEIENNKVYDDGAPQCGVKCWFVKSGEWISGIFSGNWIVLIVLCVFLLFSLVLLSVLCPVRKHKKS

SEQ ID NO: 980 - protein, 1135 aa, Artificial Sequence
  derived and/or modified protein sequence (wt) from HTNV(LongquanAa-09-191)__JQ912825.1__GP
MEIWKWLVMASLVWPAFTLRNVYDMKIECPHTVSFGENSVIGYVELPRMPLADTAQMVPESSCNMDNHQSMNTITKYTQVSWRGKADQAQASQNSFEAVSAEVDLKGTCVLKHKMLEESYRSRKSITCYDLSCNSTYCKPTLYMIVPIHACNMMKSCLIALGPYRVQVVYERTYCMTGVLIEGKCFVPDQSVVSIIKHGIFDIASVHIVCFFVAVKGNTYKLFEQVKKSFQSTCNGTENKVQGYYICIVGGNSAPIYVPTLDDFRSMEAFSGIFRSPHGEDHDLAGEEIASYSIVGPANAKVPHSASSDTLSLIAYSGIPSYSSLSILASSTEAKHVFSPGFFPQLNHTKCDKTAIPLTWTGMIDLPGYYEAIHPCTVFCVLSGPGASCEAFSEGGIFNITSPMCLVSKQNRFRLTEQQVNFVCQRVDMDIIVYCNGQRKVILTKTLVIGQCIYTITSLFSLLPGVAHSIAVELCVPGFHGWATAALLVTFCFGWVLIPALTLIILTILKFIANIFHTSNQENRLKSVLRKIKEEFEKTKGSMVCDVCKYECETYKELKAHGVSCPQSQCPYCFTHCEPTEAAFQAHYRVCQVTHRFRDDLKKTVTPQNFTPGCYRTLNLFRYKSRCYIFTMWVCLLVLESILWAASASEVPLNPVWNDNAHGVGSVPMHTDLELDFSLTSSSKYTYRRRLTNPLEETQSINLHIEIEEQTIGVDVHALGHWFDGRLNLKTSFHCYGACTKYEYPWHTAKCHYERDYQYETSWGCNPADCPGVGTGCTACGLYLDQLKPVGSAYKIITIRYSRKVCVQFGEENLCKVIDMNDCFVTRHVKVCIIGTVSKFSQGDTLLFFGPLEGGGLIFKHWCTSTCQFGDPGDIMSPRDKGFLCPEFPGSFRKKCNFATTPLCEYDGNMVSGYKKVMATIDSFQSFNTSTMHFTDERIEWKDPDGMLRDHINILVTKDIDFDNLGENPCKIGLQTSSIEGAWGSGVGFTLTCLISLTECPTFLTSIKACDKAICYGAESVTLTRGQNTVKVSGKGGHSGSTFKCCHGEECSQIGLHAAAPHLDKVNGISEIENNKVYDDGAPQCGVKCWFVKSGEWISGIFSGNWIVLIVLCVFLLFSLVLLSVLCPVRKHKKS

SEQ ID NO: 981 - protein, 1135 aa, Artificial Sequence
  derived and/or modified protein sequence (wt) from HTNV(LongquanAa-09-350)__JQ912835.1__GP
MEIWKWLVMASLVWPAFTRRNVYDMKIECPHTVSFGENSVIGYVELPPMPLADTAQMVPESSCNMDNHQSMNTITKYTQVSWRGKADQAQASQNSFEAVSAEVDLKGTCVLKHKMLEESYRSRKSITCYDLSCNSTYCKPTLYMIVPIHACNMMKSCLIALGPYRVQVVYERTYCMTGVLIEGKCFVPDQSVVSIIKHGIFDIASVHIVCFFVAVKGNTYKLFEQVKKSFQSTCNGTENKVQGYYICIVGGNSAPIYVPTLDDFRSMEAFSGIFRSPHGEDHDLAGEEIASYSIVGPANAKVPHSASSDTLSLIAYSGIPSYSSLSILASSTEAKHVFSPGFFPQLNHTKCDKTAIPLTWTGMIDLPGYYEAIHPCTVFCVLSGPGASCEAFSEGGIFNITSPMCLVSKQNRFRLTEQQVNFVCQRVDMDIIVYCNGQRKVILTKTLVIGQCIYTITSLFSLLPGVAHSIAVELCVPGFHGWATAALLVTFCFGWVLIPALTLIILTILKFIANIFHTSNQENRLKSVLRKIKEEFEKTKGSMVCDVCKYECETYKELKAHGVSCPQSQCPYCFTHCEPTEAAFQAHYRVCQVTHRFRDDLKKTVTPQNFTPGCYRTLNLFRYKSRCYIFTMWVCLLVLESILWAASASEVPLNPVWNDNAHGVGSVPMHTDLELDFSLTSSSKYTYRRRLTNPLEETQSINLHIEIEEQTIGVDVHALGHWFDGRLNLKTSFHCYGACTKYEYPWHTAKCHYERDYQYETSWGCNPADCPGVGTGCTACGLYLDQLKPVGSAYKIITIRYSRKVCVQFGEENLCKVIDMNDCFVTRHVKVCIIGTVSKFSQGDTLLFFGPLEGGGLIFKHWCTSTCQFGDPGDIMSPRDKGFLCPEFPGSFRKKCNFATTPLCEYDGNMVSGYKKVMATIDSFQSFNTSTMHFTDERIEWKDPDGMLRDHINILVTKDIDFDNLGENPCKIGLQTSSIEGAWGSGVGFTLTCLISLTECPTFLTSIKACDKAICYGAESVTLTRGQNTVKVSGKGGHSGSTFKCCHGEKCSQIGLHAAAPHLDKVNGISEIENNKVYDDGAPQCGVKCWFVKSGEWISGIFSGNWIVLIVLCVFLLFSLVLLSVLCPVRKHKKS

SEQ ID NO: 982 - protein, 1135 aa, Artificial Sequence
  derived and/or modified protein sequence (wt) from HTNV(LongquanAa-09-489)__JQ912844.1__GP
MEIWKWLVMASLVWPAFTLRNVYDMKIECPHTVSFGENSVIGYVELPRMPLADTAQMVPESSCNMDNHQSMNTITKYTQVSWRGKADQAQASQNSFEAVSAEVDLKGTCVLKHKMLEESYRSRKSITCYDLSCNSTYCKPTLYMIVPIHACNMMKSCLIALGPYRVQVVYERTYCMTGVLIEGKCFVPDQSVVSIIKHGIFDIASVHIVCFFVAVKGNTYKLFEQVKKSFQSTCNGTENKVQGYYICIVGGNSAPIYVPTLDDFRSMEAFSGIFRSPHGEDHDLAGEEIASYSIVGPANAKVPHSASSDTLSLIAYSGIPSYSSLSILASSTEAKHVFSPGFFPQLNHTKCDKTAIPLTWTGMIDLPGYYEAIHPCTVFCVLSGPGASCEAFSEGGIFNITSPMCLVSKQNRFRLTEQQVNFVCQRVDMDIIVYCNGQRKVILTKTLVIGQCIYTITSLFSLLPGVAHSIAVELCVPGFHGWATAALLVTFCFGWVLIPALTLIILTILKFIANIFHTSNQENRLKSVLRKIKEEFEKTKGSMVCDVCKYECETYKELKAHGVSCPQSQCPYCFTHCEPTEAAFQAHYRVCQVTHRFRDDLKKTVTPQNFTPGCYRTLNLFRYKSRCYIFTMWVCLLVLESILWAASASEVPLNPVWNDNAHGVGSVPMHTDLQLDFSLTSSSKYTYRRRLTNPLEETQSINLHIEIEEQTIGVDVHALGHWFDGRLNLKTSFHCYGACTKYEYPWHTAKCHYERDYQYETSWGCNPADCPGVGTGCTACGLYLDQLKPVGSAYKIITIRYSRKVCVQFGEENLCKVIDMNDCFVTRHVKVCIIGTVSKFSQGDTLLFFGPLEGGGLIFKHWCTSTCQFGDPGDIMSPRDKGFLCPEFPGSFRKKCNFATTPLCEYDGNMVSGYKKVMATIDSFQSFNTSTMHFTDERIEWKDPDGMLRDHINILVTKDIDFDNLGENPCKIGLQTSSIEGAWGSGVGFTLTCLISLTECPTFLTSIKACDKAICYGAESVTLTRGQNTVKVSGKGGHSGSTFKCCHGEECSQIGLHAAAPHLDKVNGISEIENNKVYDDGAPQCGVKCWFVKSGEWISGIFSGNWIVLIVLCVFLLFSLVLLSVLCPVRKHKKS

SEQ ID NO: 983 - protein, 1135 aa, Artificial Sequence
  derived and/or modified protein sequence (wt) from HTNV(LongquanAa-09-541)__JQ912850.1__GP
MGIWKWLVMASLVWPAFTLRNVYDMKIECPHTVSFGENSVIGYVELPPMPLADTAQMVPESSCNMDNHQSMNTITKYTQVSWRGKADQAQASQNSFEAVSAEVDLKGICVLKHKMLEESYRSRKSITCYDLSCNSTYCKPTLYMIVPIHACNMMKSCLIALGPYRVQVVYERTYCMTGVLLEGKCFVPDQSVVSIIKHGIFDIASVHIVCFFVAVKGNTYKLFEQVKKSFQSTCNGTENKVQGYYICIVGGNSAPIYVPTLDDFRSMEAFSGIFRSPHGEDHDLAGEEIASYSIVGPANAKVPHSASSDTLSLIAYSGIPSYSSLSILASSTEAKHVFSPGFFPQLNHTKCDKTAIPLTWTGMIDLPGYYEAIHPCTVFCVLSGPGASCEAFSEGGIFNITSPMCLVSKQNRFRLTEQQVNFVCQRVDMDIIVYCNGQRKVILTKTLVIGQCIYTITSLFSLLPGVAHSIAVELCVPGFHGWATAALLVTFCFGWVLIPALTLIILTILKFIANIFHTSNQENRLKSVLRKIKEEFEKTKGSMVCDVCKYECETYKELKAHGVSCPQSQCPYCFTHCEPTEAAFQAHYRVCQVTHRFRDDLKKTVTPQNFTPGCYRTLNLFRYKSRCYIFTMWVCLLVLESILWAASASEVPLNPVWNDNAHGVGSVPMHTDLELDFSLTSSSKYTYRRRLTNPLEETQSINLHIEIEEQTIGVDVHALGHWFDGRLNLKTSFHCYGACTKYEYPWHTAKCHYERDYQYETSWGCNPADCPGVGTGCTACGLYLDQLKPVGSAYKIITIRYSRKVCVQFGEENLCKVIDMNDCFVTRHVKVCIIGTVSKFSQGDTLLFFGPLEGGGLIFKHWCTSTCQFGDPGDIMSPRDKGFLCPEFPGSFRKKCNFATTPLCEYDGNMVSGYKKVMATIDSFQSFNTSTMHFTDERIEWKDPDGMLRDHINILVTKDIDFDNLGENPCKIGLQTSSIEGAWGSGVGFTLTCLISLTECPTFLTSIKACDKAICYGAESVTLTRGQNTVKVSGKGGHSGSTFKCCHGEECSQIGLHAAAPHLDKVNGISEIENNKVYDDGAPQCGVKCWFVKSGEWISGIFSGNWIVLIVLCVFLLFSLVLLSVLCPVRKHKKS

SEQ ID NO: 984 - protein, 1135 aa, Artificial Sequence
  derived and/or modified protein sequence (wt) from HTNV(LongquanAa-09-698)__JQ912854.1__GP
MEIWKWLVMASLVWPAFTLRNVYDMKIECPHTVSFGENSVIGYVELPPMPLADTAQMVPESSCNMDNHQSMNTITKYTQVSWRGKADQAQASQNSFEAVSAEVDLKGTCILKHKMLEESYRSRKSITCYDLSCNSTYCKPTLYMIVPIHACNMMKSCLIALGPYRVQVVYERTYCMTGVLIEGKCFVPDQSVVSIIKHGIFDIASVHIVCFFVAVKGNTYKLFEQVKKSFQSTCNGTENKVQGYYICIVGGNSAPIYVPTLDDFRSMEAFSGIFRSPHGEDHDLAGEEIASYSIVGPANAKVPHSASSDTLSLIAYSGIPSYSSLSILASSTEAKHVFSPGFFPQLNHTKCDKTAIPLTWTGMIDLPGYYEAIHPCTVFCVLSGPGASCEAFSEGGIFNITSPMCLVSKQNRFRLTEQQVNFVCQRVDMDIIVYCNGQRKVILTKTLVIGQCIYTITSLFSLLPGVAHSIAVELCVPGFHGWATAALLVTFCFGWVLIPALTLIILTILKFIANIFHTSNQENRLKSVLRKIKEEFEKTKGSMVCDVCKYECETYKELKAHGVSCPQSQCPYCFTHCEPTEAAFQAHYRVCQVTHRFRDDLKKTVTPQNFTPGCYRTLNLFRYKSRCYIFTMWVCLLVLESILWAASASEVPLNPVWNDNAHGVGSVPMHTDLELDFSLTSSSKYTYRRRLTNPLEETQSINLHIEIEEQTIGVDVHALGHWFDGRLNLKTSFHCYGACTKYEYPWHTAKCHYERDYQYETSWGCNPADCPGVGTGCTACGLYLDQLKPVGSAYKIITIRYSRKVCVQFGEENLCKVIDMNDCFVTRHVKVCIIGTVSKFSQGDTLLFFGPLEGGGLIFKHWCTSTCQFGDPGDIMSPRDKGFLCPEFPGSFRKKCNFATTPLCEYDGNMVSGYKKVMATIDSFQSFNTSTMHFTDERIEWKDPDGMLRDHINILVTKDIDFDNLGENPCKIGLQTSSIEGAWGSGVGFTLTCLISLTECPTFLTSIKACDKAICYGAESVTLTRGQNTVKVSGKGGHSGSTFKCCHGEECSQIGLHAAAPHLDKVNGISEIENNKVYDDGAPQCGVKCWFVKSGEWISGIFSGNWIVLIVLCVFLLFSLVLLSVLCPVRKHKKS

SEQ ID NO: 985 - protein, 1135 aa, Artificial Sequence
  derived and/or modified protein sequence (wt) from HTNV(LongquanAa-10-393)__JQ912859.1__GP
MEIWKWLVMASLVWPAFTLRNVYDMKIECPHTVSFGENSVIGYVELPPMPLADTAQMVPESSCNMDNHQSMNTITKYTQVSWRGKADQAQASQNSFEAVSAEVDLKGTCVLKHKMLEESYRSRKSITCYDLSCNSTYCKPTLYMIVPIHACNMMKSCLIALGPYRVQVVYERTYCMTGVLIEGKCFVPDQSVVSIIKHGIFDIASVHIVCFFVAVKGNTYKLFEQVKKSFQSTCNGTENKVQGYYICIVGGNSAPIYVPTLDDFRSMEAFSGIFRSPHGEDHDLAGEEIASYSIVGPANAKVPHSASSDTLSLIAYSGIPSYSSLSILASSTEAKHVFSPGFFPQLNHTKCDKTAIPLTWTGMIDLPGYYEAIHPCTVFCVLSGPGASCEAFSEGGIFNITSPMCLVSKQNRFRLTEQQVNFVCQRVDMDIIVYCNGQRKVILTKTLVIGQCIYTITSLFSLLPGVAHSIAVELCVPGFHGWATAALLVTFCFGRVLIPALTLIILTILKFIANIFHTSNQENRLKSVLRKIKEEFEKTKGSMVCDVCKYECETYKELKAHGVSCPQSQCPYCFTHCEPTEAAFQAHYRVCQVTHRFRDDLKKTVTPQNFTPGCYRTLNLFRYKSRCYIFTMWVCLLVLESILWAASASEVPLNPVWNDNAHGVGSVPMHTDLELDFSLTSSSKYTYRRRLTNPLEETQSINLHIEIEEQTIGVDVHALGHWFDGRLNLKTSFHCYGACTKYEYPWHTAKCHYERDYQYETSWGCNPADCPGVGTGCTACGLYLDQLKPVGSAYKIITIRYSRKVCVQFGEENLCKVIDMNDCFVTRHVKVCIIGTVSKFSQGDTLLFFGPLEGGGLIFKHWCTSTCQFGDPGDIMSPRDKGFLCPEFPGSFRKKCNFATTPLCEYDGNMVSGYKKVMATIDSFQSFNTSTMHFTDERIEWKDPDGMLRDHINILVTKDIDFDNLGENPCKIGLQTSSIEGAWGSGVGFTLTCLISLTECPTFLTSIKACDKAICYGAESVTLTRGQNTVKVSGKGGHSGSTFKCCHGEECSQIGLHAAAPHLDKVNGISEIENNKVYDDGAPQCGVKCWFVKSGEWISGIFSGNWIVLIVLCVFLLFSLVLLSVLCPVRKHKKS

SEQ ID NO: 986 - protein, 1135 aa, Artificial Sequence
  derived and/or modified protein sequence (wt) from HTNV(LongquanAa-10-58)__JQ912861.1__GP
MEIWKWLVMASLVWPAFTLRNVYDMKIECPHTVSFGENSVIGYVELPPMPLADTAQMVPESSCNMDNHQSMNTITKYTQVSWRGKADQAQASQNSFEAVSAEVDLKGTCVLKHKMLEESYRSRKSITCYDLSCNSTYCKPTLYMIVPIHACNMMKSCLIALGPYRVQVVYERTYCMTGVLIEGKCFVPDQSVVSIIKHGIFDIASVHIVCFFVAVKGNTYKLFEQVKKSFQSTCNGTENKVQGYYICIVGGNSAPIYVPTLDDFRSMEAFSGIFRSPHGEDHDLAGEEIASYSIVGPANAKVPHSASSDTLSLIAYSGIPSYSSLSILASSTEAKHVFSPGFFPQLNHTKCDKTAIPLTWTGMIDLPGYYEAIHPCTVFCVLSGPGASCEAFSEGGIFNITSPMCLVSKQNRFRLTEQQVNFVCQRVDMDIIVYCNGQRKVILTKTLVIGQCIYTITSLFSLLPGVAHSIAVELCVPGFHGWATAALLVTFCFGWVLIPALTLIILTILKFIANIFHTSNQENRLKSVLRKIKEEFEKTKGSMVCDVCKYECETYKELKAHGVSCPQSQCPYCFTHCEPTEAAFQAHYRVCQVTHRFRDDLKKTVTPQNFTPGCYRTLNLFRYKSRCYIFTMWVCLLVLESILWAASASEVPLNPVWNDNAHGVGSVPMHTDLELDFSLTSSSKYTYRRRLTNPLEETQSINLHIEIEEQTIGVDVHALGHWFDGRLNLKTSFHCYGACTKYEYPWHTAKCHYERDYQYETSWGCNPADCPGVGTGCTACGLYLDQLKPVGSAYKIITIRYSRKVCVQFGEENLCKVIDMNDCFVTRHVKVCIIGTVSKFSQGDTLLFFGPLEGGGLIFKHWCTSTCQFGDPGDIMSPRDKGFLCPEFPGSFRKKCNFATTPLCEYDGNMVSGYKKVMATIDSFQSFNTSTMHFTDERIEWKDPDGMLRDHINILVTKDIDFDNLGENPCKIGLQTSSIEGAWGSGVGFTLTCLISLTECPTFLTSIKACDKAICYGAESVTLTRGQNTVKVSGKGGHSGSTFKCCHGEECSQIGLHAAAPHLDKVNGISEIENNKVYDDGAPQCGVKCWFVKSGEWISGIFSGNWIVLIVLCLFLLFSLVLLSVLCPVRKHKKS

SEQ ID NO: 987 - protein, 1135 aa, Artificial Sequence
  derived and/or modified protein sequence (wt) from HTNV(LongquanAa-10-74)__JQ912864.1__GP
MEIWKWLVMASLVWPAFTLRNVYDMKIECPHTVSFGENSVIGYVELPPMPLADTAQMVPESSCNMDNHQSMNTITKYTQVSWRGKADQAQASQNSFEAVSAEVDLKGTCVLKHKMLEESYRSRKSITCYDLSCNSTYCKPTLYMIVPIHACNMMKSCLIALGPYRVQVVYERTYCMTGVLIEGKCFVPDQSVVSIIKHGIFDIASVHIVCFFVAVKGNTYKLFEQVKKSFQSTCNGTENKVQGYYICIVGGNSAPIYVPTLDDFRSMEAFSGIFRSPHGEDHDLAGEEIASYSIVGPANAKVPHSASSDTLSLIAYSGIPSYSSLSILASSTEAKHVFSPGFFPQLNHTKCDKTAIPLTWTGMIDLPGYYEAIHPCTVFCVLSGPGASCEAFSEGGIFNITSPMCLVSKQNRFRLTEQQVNFVCQRVDMDIIVYCNGQRKVILTKTLVIGQCIYTITSLFSLLPGVAHSIAVELCVPGFHGWATAALLVTFCFGWVLIPALTLIILTILKFIANIFHTSNQENRLKSVLRKIKEEFEKTKGSMVCDVCKYECETYKELKAHGVSCPQSQCPYCFTHCEPTEAAFQAHYRVCQVTHRFRDDLKKTVTPQNFTPGCYRTLNLFRYKSRCYIFTMWVCLLVLESILWAASASEVPLNPVWNDNAHGVGSVPMHTDLELDFSLTSSSKYTYRRRLTNPLEETQSINLHIEIEEQTIGVDVHALGHWFDGRLNLKTSFHCYGACTKYEYPWHTAKCHYERDYQYETSWGCNPADCPGVGTGCTACGLYLDQLKPVGSAYKIITIRYSRKVCVQFGEENLCKVIDMNDCFVTRHVKVCIIGTVSKFSQGDTLLFFGPLEGGGLIFKHWCTSTCQFGDPGDIMSPRDKGFLCPEFPGSFRKKCNFATTPLCEYDGNMVSGYKKVMATIDSFQSFNTSTMHFTDERIEWKDPDGMLRDHINILVTKDIDFDNLGENPCKIGLQTSSIEGAWGSGVGFTLTCLISLTECPTFLTSIKACDKAICYGAESVTLTRGQNTVKVSGKGGHSGSTFECCHGEECSQIGLHAAAPHLDKVNGISEIENNKVYDDGAPQCGVKCWFVKSGEWISGIFSGNWIVLIVLCVFLLFSLVLLSVLCPVRKHKKS

SEQ ID NO: 988 - protein, 1135 aa, Artificial Sequence
  derived and/or modified protein sequence (wt) from HTNV(LongquanAa-10-98)__JQ912866.1__GP
MEIWKWLVMASLVWPAFTLRNVYDMKIECPHTVSFGENSVIGYVELPPMPLADTAQMVPESSCNMDNHQSMNTITKYTQVSWRGKADQAQASQNSFEAVSAEVDLKGTCVLKHKMLEESYRSRKSITCYDLSCNSTYCKPTLYMIVPIHACNMMKSCLIALGPYRVQVVYERTYCMTGVLIEGKCFVPDQSVVSIIKHGIFDIASVHIVCFFVAVKGNTYKLLEQVKKSFQSTCNDTENKVQGYYICIVGGNSAPIYVPTLDDFRSMEAFSGIFRSPHGEDHDLAGEEIASYSIVGPANAKVPHSASSDTLSLIAYSGIPSYSSLSILASSTEAKHVFSPGFFPQLNHTKCDKTAIPLTWTGMIDLPGYYEAIHPCTVFCVLSGPGASCEAFSEGGIFNITSPMCLVSKQNRFRLTEQQVNFVCQRVDMDIIVYCNGQRKVILTKTLVIGQCIYTITSLFSLLPGVAHSIAVELCVPGFHGWATAALLVTFCFGWVLIPALTLIILTILKFIANIFHTSNQENRLKSVLRKIKEEFEKTKGSMVCDVCKYECETYKELKAHGVSCPQSQCPYCFTHCEPTEAAFQAHYRVCQVTHRFRDDLKKTVTPQNFTPGCYRTLNLFRYKSRCYIFTMWVCLLVLESILWAASASEVPLNPVWNDNAHGVGSVPMHTDLELDFSLTSSSKYTYRRRLTNPLEETQSINLHIEIEEQTIGVDVHALGHWFDGRLNLKTSFHCYGACTKYEYPWHTAKCHYERDYQYETSWGCNPADCPGVGTGCTACGLYLDQLKPVGSAYKIITIRYSRKVCVQFGEENLCKVIDMNDCFVTRHVKVCIIGTVSKFSQGDTLLFFGPLEGGGLIFKHWCTSTCQFGDPGDIMSPRDKGFLCPEFPGSFRKKCNFATTPLCEYDGNMVSGYKKVMATIDSFQSFNTSTMHFTDERIEWKDPDGMLRDHINILVTKDIDFDNLGENPCKIGLQTSSIEGAWGSGVGFTLTCLISLTECPTFLTSIKACDKAICYGAESVTLTRGQNTVKVSGKGGHSGSTFKCCHGEECSQIGLHAAAPHLDKVNGISEIENNKVYDDGAPQCGVKCWFVKSGEWISGIFSGNWIVLIVLCVFLLFSLVLLSVLCPVRKHKKS

SEQ ID NO: 989 - protein, 1135 aa, Artificial Sequence
  derived and/or modified protein sequence (wt) from HTNV(LongquanAa-11-452)__KC344264.1__GP
MEIWKWLVMASLVWPAFTLRNVYDMKIECPHTVSFGENSVIGYVELPPMPLADTAQMVPESSCNMDNHQSINTITKYTQVSWRGKADQAQASQNSFEAVSAEVDLKGTCVLKHKMLEESYRSRKSITCYDLSCNSTYCKPTLYMIVPIHACNMMKSCLIALGPYRVQVVYERTYCMTGVLIEGKCFVPDQSVVSIIKHGIFDIASVHIVCFFVAVKGNTYKLLEQVKKSFQSTCNDTENKVQGYYICIVGGNSAPIYVPTLDDFRSMEAFSGIFRSPHGEDHDLAGEEIASYSIIGPANAKVPHSASSDTLSLIAYSGIPSYSSLSILASSTEAKHVFSPGFFPQLNHTKCDKTAIPLTWTGMIDLPGYYEAIHPCTVFCVLSGPGASCEAFSEGGIFNITSPMCLVSKQNRFRLTEQQVNFVCQRVDMDIIVYCNGQRKVILTKTLVIGQCIYTITSLFSLLPGVAHSIAVELCVPGFHGWATAALLVTFCFGWVLIPALTLIILTILKFIANIFHTSNQENRLKSVLRKIKEEFEKTKGSMVCDVCKYECETYKELKAHGVSCPQSQCPYCFTHCEPTEAAFQAHYRVCQVTHRFRDDLKKTVTPQNFTPGCYRTLNLFRYKSRCYIFTMWVCLLVLESILWAASASEVPLNPVWNDNAHGVGSVPMHTDLELDFSLTSSSKYTYRRRLTNPLEETQSINLHIEIEEQTIGVDVHALGHWFDGRLNLKTSFHCYGACTKYEYPWHTAKCHYERDYQYETSWGCNPADCPGVGTGCTACGLYLDQLKPVGSAYKIITIRYSRKVCVQFGEENLCKVIDMNDCFVTRHVKVCIIGTVSKFSQGDTLLFFGPLEGGGLIFKHWCTSTCQFGDPGDIMSPRDKGFLCPEFPGSFRKKCNFATTPLCEYDGNMVSGYKKVMATIDSFQSFNTSTMHFTDERIEWKDPDGMLRDHINILVTKDIDFDNLGENPCKIGLQTSSIEGAWGSGVGFTLTCLISLTECPTFLTSIKACDKAICYGAESVTLTRGQNTVKVSGKGGHSGSTFKCCHGEECSQIGLHAAAPHLDKVNGISEIENNKVYDDGAPQCGVKCWFVKSGEWISGIFSGNWIVLIVLCVFLLFSLVLLSVLCPVRKHKKS

SEQ ID NO: 990 - protein, 1135 aa, Artificial Sequence
  derived and/or modified protein sequence (wt) from HTNV(LongquanAa-11-473)__KC344263.1__GP
MGIWKWLVMASLVWPAFTLRNVYDMKIECPHTVSFGENSVIGYVELPPMPLADTAQMVPESSCNMDNHQSMNTITKYTQVSWRGKADQAQASQNSFEAVSAEVDLKGICVLKHKMLEESYRSRKSITCYDLSCNSTYCKPTLYMIVPIHACNMMKSCLIALGPYRVQVVYERTYCMTGVLLEGKCFVPDQSVVSIIKHGIFDIASVHIVCFFVAVKGNTYKLFEQVKKSFQSTCNDTENKVQGYYICIVGGNSAPIYVPTLDDFRSMEAFSGIFRSPHGEDHDLAGEEIASYSIVGPANAKVPHSASSDTLSLIAYSGIPSYSSLSILANSTEAKHVFSPGFFPQLNHTKCDKTAIPLIWTGMIDLPGYYEAIHPCTVFCVLSGPGASCEAFSEGGIFNITSPMCLVSKQNRFRLTEQQINFVCQRVDVDIIVYCNGQRKVILTKTLVIGQCIYTITSLFSLLPGVAHSIAVELCVPGFHGWATAALLVTFCFGWVLIPALTLIILTILKFIANIFHTSNQENRLKSVLRKIKEEFEKTKGSMVCDVCKYECETYKELKAHGVSCPQSQCPYCFTHCEPTEAAFQAHYRVCQVTHRFRDDLKKTVTPQNFTPGCYRTLNLFRYKSRCYIFTMWVCLLVLESILWAASASEVPLNPVWNDNAHGVGSVPMHTDLELDFSLTSSSKYTYRRRLTNPLEETQSINLHIEIEEQTIGVDVHALGHWFDGRLNLKTSFHCYGACTKYEYPWHTAKCHYERDYQYETSWGCNPADCPGVGTGCTACGLYLDQLKPVGSAYKIITIRYSRKVCVQFGEENLCKVIDMNDCFVTRHVKVCIIGTVSKFSQGDTLLFFGPLEGGGLIFKHWCTSTCQFGDPGDIMSPRDKGFLCPEFPGSFRKKCNFATTPLCEYDGNMVSGYKKVMATIDSFQSFNTSTMHFTDERIEWKDPDGMLRDHINILVTKDIDFDNLGENPCKIGLQTSSIEGAWGSGVGFTLTCLISLTECPTFLTSIKACDKAICYGAESVTLTRGQNTVKVSGKGGHSGSTFKCCHGEECSQIGLHAAAPHLDKVNGISEIENNKVYDDGAPQCGVKCWFVKSGEWISGIFSGNWIVLIVLCVFLLFSLVLLSVLCPVRKHKKS

SEQ ID NO: 991 - protein, 1135 aa, Artificial Sequence
  derived and/or modified protein sequence (wt) from HTNV(LongquanAa-11-642)__KC344262.1__GP
MEIWKWLVMASLVWPAFTLRNVYDMKIECPHTVSFGENSVIGYVELPPMPLADTAQMVPESSCNMDNHQSMNTITKYTQVSWRGKADQAQASQNSFEAVSAEVDLKGTCVLKHKMLEESYRSRKSITCYDLSCNSTYCKPTLYMIVPIHACNMMKSCLIALGPYRVQVVYERTYCMTGVLLEGKCFVPDQSVVSIIKHGIFDIASVHIVCFFVAVKGNTYKLFEQVKKSFQSTCNDTENKVQGYYICIVGGNSAPIYVPTLDDFRSMEAFSGIFRSPHGEDHDLAGEEIASYSIVGPANAKVPHSASSDTLSLIAYSGIPSYSSLSILASSTEAKHVFSPGFFPQLNHTKCDKTAIPLIWTGMIDLPGYYEAIHPCTVFCVLSGPGASCEAFSEGGIFNITSPMCLVSKQNRFRLTEQQVNFVCQRVDVDIIVYCNGQRKVILTKTLVIGQCIYTITSLFSLLPGVAHSIAVELCVPGFHGWATAALLVTFCFGWVLIPALTLIILTILKFIANIFHTSNQENRLKSVLRKIKEEFEKTKGSMVCDVCKYECETYKELKAHGVSCPQSQCPYCFTHCEPTEAAFQAHYRVCQVTHRFRDDLKKTVTPQNFTPGCYRTLNLFRYKSRCYIFTMWVCLLVLESILWAASASEVPLNPVWNDNAHGVGSVPMHTDLELDFSLTSSSKYTYRRRLTNPLEETQSINLHIEIEEQTIGVDVHALGHWFDGRLNLKTSFHCYGACTKYEYPWHTAKCHYERDYQYETSWGCNPADCPGVGTGCTACGLYLDQLKPVGSAYKIITIRYSRKVCVQFGEENLCKVIDMNDCFVTRHVKVCIIGTVSKFSQGDTLLFFGPLEGGGLIFKHWCTSTCQFGDPGDIMSPRDKGFLCPEFPGSFRKKCNFATTPLCEYDGNMVSGYKKVMATIDSFQSFNTSTMHFTDERIEWKDPDGMLRDHINILVTKDIDFDNLGENPCKIGLQTSSIEGAWGSGVGFTLTCLISLTECPTFLTSIKACDKAICYGAESVTLTRGQNTVKVSGKGGHSGSTFKCCHGEECSQIGLHAAAPHLDKVNGISEIENNKVYDDGAPQCGVKCWFVKSGEWISGIFSGNWIVLIVLCVFLLFSLVLLSVLCPVRKHKKS

SEQ ID NO: 992 - protein, 1135 aa, Artificial Sequence
  derived and/or modified protein sequence (wt) from HTNV(LongquanAa-11-774)__KC344257.1__GP
MEIWKWLVMASLVWPAFTLRNVYDMKIECPHTVSFGENSVIGYVELPPMPLADTAQMVPESSCNMDNHQSMNTITKYTQVSWRGKADQAQASQNSFEAVSAEVDLKGTCVLKHKMLEESYRSRKSITCYDLSCNSTYCKPTLYMIVPIHACNMMKSCLIALGPYRVQVVYERTYCMTGVLIEGKCFVPDQSVVSIIKHGIFDIASVHIVCFFVAVKGNTYKLFEQVKKSFQSTCNGTENKVQGYYICIVGGNSAPIYVPTLDDFRSMEAFSGIFRSPHGEDHDLAGEEIASYSIVGPANAKVPHSASSDTLSLIAYSGIPSYSSLSILASSTEAKHVFSPGFFPQLNHTKCDKTAIPLTWTGMIDLPGYYEAIHPCTVFCVLSGPGASCEAFSEGGIFNITSPMCLVSKQNRFRLTEQQVNFVCQRVDMDIIVYCNGQRKVILTKTLVIGQCIYTITSLFSLLPGVAHSIAVELCVPGFHGWATAALLVTFCFGWVLIPALTLIILTILKFIANIFHTSNQENRLKSVLRKIKEEFEKTKGSMVCDVCKYECETYKELKAHGVSCPQSQCPYCFTHCEPTEAAFQAHYRVCQVTHRFRDDLKKTVTPQNFTPGCYRTLNLFRYKSRCYIFTMWVCLLVLESILWAASASEVPLNPVWNDNAHGVGSVPMHTDLELDFSLTSSSKYTYRRRLTNPLEETQSINLHIEIEEQTIGVDVHALGHWFDGRLNLKTSFHCYGACTKYEYPWHTAKCHYERDYQYETSWGCNPADCPGVGTGCTACGLYLDQLKPVGSAYKIITIRYSRKVCVQFGEENLCKVIDMNDCFVTRHVKVCIIGTVSKFSQGDTLLFFGPLEGGGLIFKHWCTSTCQFGDPGDIMSPRDKGFLCPEFPGSFRKKCNFATTPLCEYDGNMVSGYKKVMATIDSFQSFNTSTMHFTDERIEWKDPDGMLRDHINILVTKDIDFDNLGENPCKIGLQTSSIEGAWGSGVGFTLTCLISLTECPTFLTSIKACDKAICYGAESVTLTRGQNTVKVSGKGGHSGSTFKCCHGEKCSQIGLHAAAPHLDKVNGISEIENNKVYDDGAPQCGVKCWFVKSGEWISGIFSGNWIVLIVLCVFLLFSLVLLSVLCPVRKHKKS

SEQ ID NO: 993 - protein, 1135 aa, Artificial Sequence
  derived and/or modified protein sequence (wt) from HTNV(LongquanMf-09-8)__JQ912875.1__GP
MEIWKWLVMASLVWPAFTLRNVYDMKIECPHTVSFGENSVIGYVELPPMPLADTAQMVPESSCNMDNHQSMNTITKYTQVSWRGKADQAQASQNSFEAVSAEVDLKGTCVLKHKMLEESYRSRKSITCYDLSCNSTYCKPTLYMIVPIHACNMMKSCLIALGPYRVQVVYERTYCMTGVLIEGKCFVPDQSVVSIIKHGIFDIASVHIVCFFVAVKGNTYKLFEQVKKSFQSTCNGTENKVQGYYICIVGGNSAPIYVPTLDDFRSMEAFSGIFRSPHGEDHDLAGEEIASYSIVGPANAKVPHSASSDTLSLIAYSGIPSYSSLSILASSTEAKHVFSPGFFPQLNHTKCDKTAIPLTWTGMIDLPGYYEAIHPCTVFCVLSGPGASCEAFSEGGIFNITSPMCLVSKQNRFRLTEQQVNFVCQRVDMDIIVYCNGQRKVILTKTLVIGQCIYTITSLFSLLPGVAHSIAVELCVPGFHGWATAALLVTFCFGWVLIPALTLIILTILKFIANIFHTSNQENRLKSVLRKIKEEFEKTKGSMVCDVCKYECETYKELKAHGVSCPQSQCPYCFTHCEPTEAAFQAHYRVCQVTHRFRDDLKKTVTPQNFTPGCYRTLNLFRYKSRCYIFTMWVCLLVLESILWAASASEVPLNPVWNDNAHGVGSVPMHTDLELDFSLTSSSKYTYRRRLTNPLEETQSINLHIEIEEQTIGVDVHALGHWFDGRLNLKTSFHCYGACTKYEYPWHTAKCHYERDYQYETSWGCNPADCPGVGTGCTACGLYLDQLKPVGSAYKIITIRYSRKVCVQFGEENLCKVIDMNDCFVTRHVKVCIIGTVSKFSQGDTLLFFGPLEGGGLIFKHWCTSTCQFGDPGDIMSPRDKGFLCPEFPGSFRKKCNFATTPLCEYDGNMVSGYKKVMATIDSFQSFNTSTMHFTDERIEWKDPDGMLRDHINILVNKDIDFDNLGENPCKIGLQTSSIEGAWGSGVGFTLTCLISLTECPTFLTSIKACDKAICYGAESVTLTRGQNTVKVSGKGGHSGSTFKCCHGEECSQIGLHAAAPHLDKVNGISEIENNKVYDDGAPQCGVKCWFVKSGEWISGIFSGNWIVLIVLCVFLLFSLVLLSVLCPVRKHKKS

SEQ ID NO: 994 - protein, 1135 aa, Artificial Sequence
  derived and/or modified protein sequence (wt) from HTNV(ROKA14-11)__KU207203.1__GP
MGIWKWLVMASLVWPVLTLRNVYDMKIECPHTVSFGENSVIGYVELPPMPLADTAQLVPESSCSMDNHQSLNTITKYTQVSWRGKADQSQSSQNSFETVSTEVDLKGTCVLKHKMVEESYRSRKSITCYDLSCNSTYCKPTLYMIVPIHACNMMKSCLIALGPYRVQVVYERTYCMTGVLIEGKCFVPDQSVVSIIKHGIFDIASVHIVCFFVAVKGNTYKIFEQVKKSFESTCNDTENKVQGYYICIVGGNSAPIYVPTLDDFRSMEAFTGIFRSPHGEDHDLAGEETATYSIVGPANAKVPHSASSDTLSLIAFSGIPSYSSLSILTSSTEAKHVFSPGLFPKLNHTNCDKGAIPLMWTGMIDLPGYYEAIHPCTVFCVLSGPGASCEAFSEGGIFNITSPMCLVSKQNRFRLTEQQVNFVCQRVDVDIVVYCNGQRKVILTKTLVIGQCIYTITSLFSLLPGVAHSIAVELCVPGFHGWATAALLVTFCFGWVLIPAITFIILTILKFIANIFHTSNQENRLKSVLRKIKEEFEKTKGSMVCDVCKYECETYKELKAHGVSCPQSQCPYCFTHCEPTEAAFQAHYKVCQVTHRFRDDLKKTVTPQNFTPGCYRTLNLFRYKSRCYIFTMWIFLLVLESILWAASASETPLTPVWNDNAHGVGSVPMHTDLELDFSLTSSSKYTYRRKLTNPLEEAQSIDLHIEIEEQTIGVDVHALGHWFDGRLNLKTSFHCYGACTKYEYPWHTAKCHYERDYQYETSWGCNPSDCPGVGTGCTACGLYLDRLKPVGSAYKIITIRYSRRVCVQFGEENLCKIIDMNDCFVSRHVKVCIIGTVSKFSQGDTLLFFGPLEGGGLIFKHWCTSTCQFGDPGDIMSPRDKGFLCPEFPGSFRKKCNFATTPICEYDGNMVSGYKKVMATIDSFQSFNTSTMHFTDERIEWKDPDGMLRDHINILVTKDIDFDNLGENPCKIGLQTSSIEGAWGSGVGFTSTCLVSLTECPTFLTSIKACDKAICYGAESVTLTRGQNTVKVSGKGGHSGSTFKCCHGEDCSQIGLHAAAPHLDKVNGISEMENSKVYDDGAPQCGIKCWFVKSGEWISGIFSGNWIVLIVLCVFLLFSLVLLSILCPVRKHKKS

SEQ ID NO: 995 - protein, 1135 aa, Artificial Sequence
  derived and/or modified protein sequence (wt) from HTNV(US8A15-1)__KU207205.1__GP
MGIWKWLVMASLVWPVLTLRNVYDMKIECPHTVSFGENSVIGYVELPPMPLADTAQLVPESSCSMDNHQSLNTITKYTQVSWRGKADQSQSSQNSFETVSTEVDLKGTCVLKHKMVEESYRSRKSITCYDLSCNSTYCKPTLYMIVPIHACNMMKSCLIALGPYRVQVVYERTYCMTGVLIEGKCFVPDQSVVSIIKHGIFDIASVHIVCFFVAVKGNTYKIFEQVKKSFESTCNDTENKVQGYYICIVGGNSAPIYVPTLDDFRSMEAFTGIFRSPHGEDHDLAGEETATYSIVGPANAKVPHSASSDTLSLIAFSGIPSYSSLSILTSSTEAKHVFSPGLFPKLNHTNCDKGAIPLMWTGMIDLPGYYEAIHPCTVFCVLSGPGASCEAFSEGGIFNITSPMCLVSKQNRFRLTEQQVNFVCQRVDVDIVVYCNGQRKVILTKTLVIGQCIYTITSLFSLLPGVAHSIAVELCVPGFHGWATAALLVTFCFGWVLIPAITFIILTILKFIANIFHTSNQENRLKSVLRKIKEEFEKTKGSMVCDVCKYECETYKELKAHGVSCPQSQCPYCFTHCEPTEAAFQAHYKVCQVTHRFRDDLKKTVTPQNFTPGCYRTLNLFRYKSRCYIFTMWIFLLVLESILWAASASETPLTPVWNDNAHGVGSVPMHTDLELDFSLTSSSKYTYRRKLTNPLEEAQSIDLHIEIEEQTIGVDVHALGHWFDGRLNLKTSFHCYGACTKYEYPWHTAKCHYERDYQYETSWGCNPSDCPGVGTGCTACGLYLDRLKPVGSAYKIITIRYSRRVCVQFGEENLCKIIDMNDCFVSRHVKVCIIGTVSKFSQGDTLLFFGPLEGGGLIFKHWCTSTCQFGDPGDIMSPRDKGFLCPEFPGSFRKHCNFATTPICEYDGNMVSGYKKVMATIDSFQSFNTSTMHFTDERIEWKDPDGMLRDHINILVTKDIDFDNLGENPCKIGLQTSSIEGAWGSGVGFTLTCLVSLTECPTFLTSIKACDKAICYGAESVTLTRGQNTVKVSGKGGHSGSTFKCCHGEDCSQIGLHAAAPHLDKVNGISEMENSKVYDDGAPQCGIKCWFVKSGEWISGIFSGNWIVLTVLCVFLLFSLVLLSILCPVRKHKKS

SEQ ID NO: 996 - protein, 1135 aa, Artificial Sequence
  derived and/or modified protein sequence (wt) from HTNV(Lee)__D00377.1__GP
MGIWKWLVMASLVWPVLTLRNVYDMKIECPHTVSFGENSVIGYVELPPMPLADTAQLVPESSCSMDNHQSLNTITKYTQVSWRGKADQSQSSQTSFETVSTEVDLKGTCVLKHKMVEESYRSRKSITCYDLSCNSTYCKPTLYMIVPIHACNMMKSCLIALGPYRVQVVYERTYCMTGVLIEGKCFVPDQSVVSIIKHGIFDIASVHIVCFFVAVKGNTYKIFEQVKKSFESTCNDTENKVQGYYICIVGGNSAPIYVPTLDDFRSMEAFTGIFRSPHGEDHDLAGEETATYSIVGPANAKVPHSASSDTLSLIAFSGIPSDSSLSILTSSTEAKHVFSPGLFPKLNHTNCDKGAIPLMWTGMIDLPGYYEAIHPCTVFCVLSGPGASCEAFSEGGIFNITYPMCLVSKQNRFRLTEQQVNFVCQRVDVDIVVYCNGQRKVILTKTLVIGQCIYTITSLFSLLPGVAHSIAVELCVPGFHGWATAALLVTFCFGWVLIPAITFIILTILKFIANIFHTSNQENRLKSVLRKIKEEFEKTKGSMVCDVCKYECETYKELKAHGVSCPQSQCPYCFTHCEPTEAAFQAHYKVCQVTHRFRDDLKKTVTPQNFTPGCYRTLNLFRYKSRCYIFTMWIFLLVLESILWAASASETPLTPVWNDNAHGVGSVPMHTDLELDFSLTSSSKYTYRRKLTNPLEEAQSIDLHIEIEEQTIGVDVHALGHWFDGRLNLKTSFHCYGACTKYEYPWHTAKCHYERDYQYETSWGCNPSDCPGVGTGCTACGLYLDRLKPVGSAYKIITIRYSRRVCVQFGEENLCKIIDMNDCFVSRHVKVCIIGTVSKFSQGDTLLFFGPLEGGGLIFKHWCTSTCQFGDPGDIMSPRDKGFLCPEFPGSFRKKCNFATTPICEYDGNMVSGYKKVMATIDSFQSFNTSTMHFTDERIEWKDPDGMLRDHINILVTKDIDFDNLGENPCKIGLQTSSIEGAWGSGVGFTLTCLVSLTECPTFLTSIKACDKAICYGAESVTLTRGQNTVKVSGKGGHSGSTFKCCHGEDCSQIGLHAAAPHLDKVNGISEMENSKEYDDGAPQCGIKCWFVKSGEWISGIFSGNWIVLIVLCVFLLFSLVLLSILCPVRKHKKS

SEQ ID NO: 997 - protein, 1127 aa, Artificial Sequence
  derived and/or modified protein sequence (wt) from HTNV(M)__U38177.1__GP
MASLVWPVLTLRNVYDMKIECPHTVSFGENSVIGYVELPPVPLADTAQMVPESSCNMDNHQSLNTITKYTQVSWRGKADQSQSSQNSFETVSTEVDLKGTCVLKHKMVEESYRSRKSVTCYDLSCNSTYCKPTLYMIVPIHACNMMKSCLIALGPYRVQVVYERSYCMTGVLIEGKCFVPDQSVVSIIKHGIFDIASVHIVCFFVAVKGNTYKIFEQVKKSFESTCNDTENKVQGYYICIVGGNSAPIYVPTLDDFRSMEAFTGIFRSPHGEDHDLAGEEIASYSIVGAANAKVPHSASSDTLRLIAYSGIPSYSSLSILTSSTEAKHVFSPGLFPKLNHTNCDKSAIPLIWTGMIDLPGYYEAVHPCTVFCVLSGPGASCEAFSEGGIFNITSPMCLVSKQNRFRLTEQQVNFVCQRVDMDIVVYCNGQRKVILTKTLVIGQCIYTITSLFSLLPGVAHSIAVELCVPGFHGWATAALLVTFCFGWVLIPAITFIILTVLKFIANIFHTSNQENRLKSVLRKIKEEFEKTKGSMVCDVCKYECETYKELKAHGVSCPQSQCPYCFTHCEPTEAAFQAHYKVCQVTHRFRDDLKKTVTPQNFTPGCYRTLNLFRYKSRCYIFTMWIFLLVLESILWAASASETPLTPVWNDNAHGVGSVPMHTDLELDFSLTSSSKYTYRRKLTNPLEEAQSIDLHIEIEEQTIGVDVHALGHWFDGRLNLKTSFHCYGACTKYEYPWHTAKCHYERDYQYETSWGCNPSDCPGVGTGCTACGLYLDQLKPVGSAYKIITIRYSRRVCVQFGEENLCKIIDMNDCFVSRHVKVCIIGTVSKFSQGDTLLFFGPLEGGGLIFKHWCTSTCQFGDPGDIMSPRDKGFLCPEFPGSFRKKCNFATTPICEYDGNMVSGYKKVMATIDSFQSFNTSTMHFTDERIEWKDPDGMLRDHINILVTKDIDFDNLGENPCKIGLQTSSIEGAWGSGVGFTLTCLVSLTECPTFLTSIKACDKAICYGAESVTLTRGQNTVKVSGKGGHSGSTFKCCHGEDCSQIGLHAAAPHLDKVNGISEIENSKVYDDGAPQCGIKCWFVKSGEWISGIFSGNWIVLIVLCVFLLFSLVLLSILCPVRKHKKS

SEQ ID NO: 998 - protein, 1135 aa, Artificial Sequence
  derived and/or modified protein sequence (wt) from HTNV(N8)__EF077656.1__GP
MGIWKWLVMASLVWPAYTLRNVYDMKIECPHTVSFGENSVIGYVELPPMPLADTAQMVPESSCNMDNHQSMNTITKYTQVSWRGKADQAQASQNSFEAVSAEVDLKGTCVLKHKMLEESYRSRKSITCYDLSCNNTYCKPTLYMIVPIHACNMMKSCLIALGPYRVQVIYERTYCMTGVLIEGKCFVPDQSVVSIIKHGIFDIASVHIVCFFVAVKGNTYKLFEQVKKSFQSTCNDTENKVQGYYICIVGGNSAPIYVPTLDDFRSMEAFSGIFRSPHGEDHDLAGEEIASYSIVGPANAKVPHSASSDTLSLIAYSGIPSYSSLSILTGSTEAKHVFSPGFFPQLNHTKCDKTAIPLTWTGMIDLPGYYEAIHPCTVFCVLSGPGASCEAFSEGGIFNITSPMCLVSKQNRFRLTEQQVNFVCQRVDMDIIVYCNGQRKVILTKTLVIGQCIYTITSLFSLLPGVAHSIAVELCVPGFHGWATAALLVTFCFGWVLIPAITFIILTVLKFIANIFHTSNQENRLRAVLRKIKEEFEKTKGSMVCDVCKYECETYKELKAHGVSCPQSQCPYCFTHCEPTEAAFQAHYRVCQVTHRFRDDLKKTVTPQNFTPGCYRTLNLFRYKSRCYIFTMWVCLLVLESILWAASASEVPLNPVWNDNAHGVGSVPMHTDLELDFSLTSSSKYTYRRRLTNPLEETQAINLHIEIEEQTIGVDVHALGHWFDGRLNLKTSFHCYGACTKYEYPWHTAKCHYERDYQYETSWGCNPADCPGVGTGCTACGLYIDQLKPVGSAYKIITIRYSRKVCVQFGEENLCKVIDMNDCFVSRHVKVCIIGTVSKFSQGDTLLFFGPLEGGGLIFKHWCTSTCQFGDPGDIMSPRDKGFLCPEFPGSFRKKCNFATTPLCEYDGNMVSGYKKVMATIDSFQSFNTSTMHFTDERIEWKDPDGMLRDHINILVTKDIDFDNLGENPCKIGLQTSSIEGAWGSGVGFTLTCLVSLTECPTFLTSIKACDKAICYGAESVALTRGQNTVKVSGKGGHSGSTFKCCHGEECSQIGLHAAAPHLDKVNGISEVENNKVYDDGAPQCGVKCWFVKSGEWISGIFSGNWIVLIVLCVFLLFSLVLLSVLCPVRKHKKS

SEQ ID NO: 999 - protein, 1135 aa, Artificial Sequence
  derived and/or modified protein sequence (wt) from HTNV(Q32)__DQ371905.1__GP
MGIWKWLVMASLVWPAFALRNVYDMKIECPHTVSFGENSVIGYVELPPMPLADTTQMVPESSCSMDNHQSLNTITKYTQIIWRGKADQSQSSQNSFETVSTEVDLKGTCVLKHKMIEESYRSRKSITCYDLSCNSTYCKPTLYMIVPIHACNMMKSCLIALGPYRVQVVYERTYCMTGVLIEGKCFVPDQSVVSIIKHGIFDIASVHIVCFFVAVKGNTYKIFEQVKKSFESNCNDTENKVQGYYICIIGGNSSPVYVPTLDDFRSMEAFSGIFRSPHGEDHDLAGEEVASYSIVGPANAKVPHSASSDTLGLIAYFGIPSYSSLSILTSSTEAKHVFSPGLFPQLNHTKCDKTAIPLTWTGMIDLPGYYEAIHPCTVFCVLSGPGASCEAFSEGGIFNITSPMCLVSKQNRFRLTEQQVNFVCQRVDVDIIVYCNGQRKVILTKTLVIGQCIYTITSLFSLLPGVAHSIAVELCVPGFHGWATAALLVTFCFGWVLIPAITFIILTILKFIANIFHTSNQENRLKSVLRKIKEEFERTKGSMVCDICKYECETYKELKAHGVSCPQSQCPYCFTHCEPTEAAFQAHYKVCQVTHRFRDDLKKTVTPQNFTPGCYRTLNLFRYKSRCYIFTMWVFLLVLESILWAASASEIPLNPVWNDNAHGVGSIPMHTDLELDFSLTSSSKYTYRRKLTNPLEESQAIDLHVEIEEQTIGVDVHALGHWFDGRLNLKTSFHCYGACTKYEYPWHTAKCHYERDYQYETSWGCNPSDCPGVGTGCTACGLYLDQLKPVGSAYKIITIRYSRRVCVQFGEENLCKIIDMNDCFVSRHVKVCIIGTVSKFSQGDTLLFFGPLEGGGLIFKHWCTSTCQFGDPGDIMSPRDKGFLCPEFPGSFRKKCNFATTPVCEYDGNMVSGYKKVMATIDSFQSFNTSTMHFTDERIEWKDPDGMLRDHINILVTKDIDFDNLGENPCKIGLQTSSIEGAWGSGVGFTLTCLISLTECSTFLTSIKACDKAICYGAESVTLIRGQNTVKVSGKGGHSGSSFKCCHGEECSQIGLHAAAPHLDKVNGISEMENSKVFDDGAPQCGIKCWFVKSGEWISGIFSGNWIVLIVLCVFLLFSLVLLSILCPVRKHKKS

SEQ ID NO: 1000 - protein, 1135 aa, Artificial Sequence
  derived and/or modified protein sequence (wt) from HTNV(Bao14)__AB127995.1__GP
MGMWKWLVIASLVWPALALRNVYDMKIECPHTVSFGENSVIGYVELPPMPLADTAQMVPESSCSMDNHQSINTITKYTQVIWRGKADPGQSSQNSFETVSTEVDLKGTCVLKHKMVEESYRSRKSITCYDLSCNSTYCKPTLYMIVPIHACNMMKSCLIALGPYRVQVVYERTYCMTGVLIEGKCFVPDQSVVSIIKHGIFDIASVHIVCFFVAVKGNTYKLFEQVKKSFESTCNDTENKVQGYYICIVGGNSAPIYVPTLDDFRSMEAFTGIFKSPHGEDHDLAGEEIASYSIVGPANAKVPHSASSDTLSLIAYSGIPSYSSLSILTSSTDAKHVFSPGLFPKLNHTNCDKSAIPLTWTGMIDLPGYYEAIHPCTVFCVLSGPGASCEAFSEGGIFNITSPMCLVSKQNRFRLTEQQVNFVCQRVDMDIVVYCNGQRKVILTKTLVIGQCIYTITSLFSLLPGVAHSIAVELCVPGFHGWATAALLVTFCFGWVLIPAVTFIILTVLKFIANIFHTSNQENRLKSVLRKIKEEFEKTKGSMVCDVCKYECETYKELKAHGVSCPQSQCPYCFTHCEPTEAAFQAHYKVCQVTHRFRDDLKKTVTPQNFTPGCYRTLNLFRYKSRCYIFTMWVFLLILESVLWAASASETPLTPVWNDNAHGVGSVPMHTDLELDFSLTSSSKYTYRRKLTNPLEEAQSIDLHIEIEEQTIGVDVHALGHWFDGRLNLKTSFHCYGACTKYEYPWHTAKCHYERDYQYETSWGCNPSDCPGVGTGCTACGLYLDQLKPVGSAYKIITIRYSRRVCVQFGEENLCKIIDMNDCFVSRHVKVCIIGTVSKFSQGDTLLFFGPLEGGGLIFKHWCTSTCQFGDPGDIMSPRDKGFLCPEFPGSFRKKCNFATTPICEYDGNMVSGYKKVMATIDSFQSFNTSTMHFTDERIEWKDPDGMLRDHINILVTKDIDFDNLGENPCKIGLQTSSIEGAWGSGVGFTLTCLVSLTECPTFLTSIKACDKAICYGAESVTLTRGQNTVRVSGKGGHSGSTFKCCHGEDCSKIGLHAAAPHLDKVNGISEIENSKVYDDGAPQCGIKCWFVKSGEWISGIFSGNWIVLIVLCVFLLFSLVLLSILCPVRKHKKS

SEQ ID NO: 1001 - protein, 1135 aa, Artificial Sequence
  derived and/or modified protein sequence (wt) from HTNV(HubeiHu02)__JQ665881.1__GP
MGIWKWLVMASLVWPAFALRNVYDMKIECPHTVSFGENSVIGYVELPPMPLADTAQMVPESSCSMDNHQSLNTITKYTQIVWRGKADQSQSSQNSFETVSTEVDLKGTCVLKHKMVEESYRSRKSITCYDLSCNSTYCKPTLYMIVPIHACNMMKSCLIALGPYRVQVVYERTYCMTGVLIEGKCFVPDQSVVSIIKHGIFDIASVHIVCFFVAVKGSTYKLFEQVKKSFESNCNDTENKVQGHYICIVGGNSAPIYVPTLDDFRSMEAFSGIFKSPHGEDHDLAGEEVASYSIVGPANAKVPHSASSDTLSLIAYSGIPSYSSLSILTSLTEAKHVFSPGLFPQLNHTKCDKTAIPLTWTGMIDLPGYYEAVHPCTVFCVLSGPGASCEAFSEGGILNITSPMCLVSKQNRFRLTEQQVNFVCQRVDVDIVVYCNGQRKVILTKTLVIGQCIYTITSLFSLLPGVAHSIAVELCVPGFHGWATAALLVTFCFGWVLIPAITFIILTILKFIANIFHTSNQENRLKSVLRKIKEEFERTKGSMVCDVCKYECETYKELKAHGVSCPQSQCPYCFTHCEPTEAAFQAHYKVCQVTHRFRDDLKKTVTPQNFTPGCYRTLNLFRYKSRCYIFTMWVFLLVLESILWAASASETPLNPVWNDNAHGVGSVPMHTDLELDFSLTSSSKYTYRRKLTNPLEESQAINLHIEIEEQTIGVDVHALGHWFDGRLNLKTSFHCYGACTKYEYPWHTAKCHYERDYQYETSWGCNPSDCPGVGTGCTACGLYLDQLKPVGSAYKIITIRYSRRVCVQFGEENLCKIIDMNDCFVSRHVKVCIIGTVSKFSQGDTLLFFGPLEGGGLIFKHWCTSTCQFGDPGDIMSPRDKGFLCPEFPGSFRKKCNFATTPICEYDGNMVSGYKKVMATIDSFQSFNTSTMHFTDERIEWKDPDGMLRDHISILVTKDIDFDNLGENPCKIGLQTSSIEGAWGSGVGYTLTCLISLTECPTFLTSIKACDKAICYGAESVTLTRGQNTVKVSGKGGHSGSSFKCCHGEDCSQIGLHAAAPHLDKVNGISEIENSKVFDDGAPQCGIKCWFVKSGEWISGIFNGNWIVLIVLCVFLLFSLVLLSILCPVRKHKKS

SEQ ID NO: 1002 - protein, 1135 aa, Artificial Sequence
  derived and/or modified protein sequence (wt) from HTNV(HV004)__JQ083394.1__GP
MGIWKWLVMASLVWPAFALRNVYDMKIECPHTVSFGENSVIGYVELPPMPLADTAQMVPESSCSMDNHQSLNTITKYTQIIWRGKADQSQSSQNSFETVSTEVDLKGTCVLKHKMVEESYRSRKSITCYDLSCNSTYCKPTLYMIVPIHACNMMKSCLIALGPYRVQVVYERTYCMTGVLIEGKCFVPDQSVVSIIKHGIFDIASVHIVCFFVAVKGSTYKLFEQVKKSFESNCNDTENKVQGYYICIVGGNSAPIYVPTLDDFRSMEAFSGIFKSPHGEDHDLAGEEVASYSIVGPANAKVPHSASSDTLSLIAYSGIPSYSSLSILTSSTEAKHVFSPGLFPQLNHTKCDKTAIPLTWTGMIDLPGYYEAIHPCTVFCVLSGPGASCEAFSEGGIFNITSPMCLVSKQNRFRLTEQQVNFVCQRVDVDIVVYCNGQRKVILTKTLVIGQCIYTITSLFSLLPGVAHSIAVELCVPGFHGWATAALLVTFCFGWVLIPAITFIILTILKFIANIFHTSNQENKLKSVLRKIKEEFERTKGSMVCDVCKYECETYKELKAHGVSCPQSQCPYCFTHCEPTEAAFQAHYKVCQVTHRFRDDLKKTVTPQNFTPGCYRTLNLFRYKSRCYIFTMWVFLLVLESILWAASASETPLNPVWNDNAHGVGSVPMHTDLELDFSLTSSSKYTYRRKLTNPLEESQAINLHIEIEEQTIGVDVHALGHWFDGRLNLKTSFHCYGACTKYEYPWHTAKCHYERDYQYETSWGCNPSDCPGVGTGCTACGLYLDQLKPVGSAYKIITIRYSRRVCVQFGEENLCKIIDMNDCFVSRHVKVCIIGTVSKFSQGDTLLFFGPLEGGGLIFKHWCTSTCQFGDPGDIMSPRDKGFLCPEFPGSFRKKCNFATTPICEYDGNMVSGYKKVMATIDSFQSFNTSTMHFTDERIEWKDPDGMLRDHINILVTKDIDFDNLGENPCKIGLQTSSIEGAWGSGVGFTLTCLISLTECPTFLTSIKACDKAICYGAESVTLTRGQNTVKVSGKGGHSGSSFKCCHGEDCSQIGLHAAAPHLDKVNGISEIENSKVFDDGAPQCGIKCWFVKSGEWISGIFNGNWIVLIVLCVFLLFSLVLLSILCPVRKHKKS

SEQ ID NO: 1003 - protein, 1134 aa, Artificial Sequence
  derived and/or modified protein sequence (wt) from HTNV(NC167)__AB027115.2__GP
MWGLLVVAGLIGPCISLRNVYDMKIECPHTVNFGENSVIGYVELPPVPIADITQMVPESSCNMDNHQSLSTFTKYTQLIWRKKAEQAQASQNSFETVSREVDFKGTCVFKHKMVEESYKNRKSIICYDLSCNITHCKPTLYMIIPVHACNMMKSCLIALGPFRVQVVYERTYCMSGILTEGRCFVPYQSVVSIIKHGIFDIASIHIICFFIAVEGNTYKLFEEVKKSFALNCNDTENKIQGYYICIIGGNSAPVYAPSPDDFRSMEAFSGIFRSPHGENHDLNGGRNAPYSIVGPTDGKVPHSSKHYNIEFDSIFQKFPTYSSFSILAGSVEPKHVFQPGLFPKLNHTKCTKSAIPLVWTGRIDIPGYYEAVHPLTVYCELSGPGASCEAFSEGGIFNITSPMCLVSKQNRFRSLRQQVSFVCQRVDMDIVVYCNGQKKTILTKTLVIGQCIYTITSLFSLLPSVAHSIAVELCVPGFHGWATAALLITFCFGWVLIPALTFIILTILKFIANIFHTSNQENKLKAVLRKIKEEFEKTKGSMVCDICKYECDTYKELKAHGLSCPQSQCPYCFTHCEPTESAFQAHYKVCQVTHRFREELKKTVTPQNFTPGCYRTLNLFRYKSRCYIFTMWILLLVFESILWAASASDVPLSTDWNDNAHGVGSVPMHTDLELDFSLTSSSKYTYRRKLTNPVDTSQAVDLHIELEEQTIGLDVHALGHWFDGRLNLKTSFHCYGACTKYEYPWHTAKCHFERDFQYETSWGCNPPDCPGVGTGCTACGLYIDQLRPVGNAYKIITIRYSRKVCVQFGDENLCKTIDMNDCFVSKHVKVCIIGTVSKFSQGDTLLFLGPMEGGGIIFKHWCTSTCQFGDPGDIMSPKDKGFSCPEFSGSFRKKCNFATTPACEYGGNMVSGYRKVMATIDSFQAFNTSTIHFTDERIEWKDPDGMLRDHINILVTRDIDFDNLAENPCKIGLQVSAIEGAWGSGVGFTLTCQVSLTECSTFLTSIKACDKAICYGAQSVTLVRGQNTVKISGKGGHSGSAFKCCHGEDCSQTGLQADAPHLDKVNGISEVENDKVYDDGAPECGIKCWFVKSGEWVAGIFSGNWIVLVVLCIFLIISLILLSILCPVRKHKKS

SEQ ID NO: 1004 - protein, 1135 aa, Artificial Sequence
  derived and/or modified protein sequence (wt) from HTNV(WuhanAaJ10)__JQ665882.1__GP
MGIWKWLVMASLVWPAFALRNVYDMKIECPHTVSFGENSVIGYVELPPMPLADTAQMVPESSCSMDNHQSLNTITKYTQIIWRGKADQSQSSQNSFETVSTEVDLKGTCVLKHKMVEESYRSRKSITCYDLSCNSTYCKPALYMIVPIHACNMMKSCLIALGPYRVQVVYERTYCMTGVLIEGKCFVPDQSVVSIIKHGIFDIASVHTVCFFVAVKGSTYKLFEQAKKSFQSNCNDTENKVQGYYICIVGGSSAPIYVPTLDDFRSMEAFSGLFKSPHGEDHDLAGEEVASYSIVGPANAKVPHSASSDTLSLIAYSGIPSYSSLSILTSSTEAKHVFSPGLFPQLNHTKCDKTAIPLTWTGMIDLPGYYEAVHPCTVFCVLSGPGASCEAFSEGGIFNITSPMCLVSKQNRFRLTEQQVNFVCQRVDVDIIVYCNGQRKVILTKTLVIGQCIYTITSLISLLPGVAHSIAVELCVPGSHGWATAALLVTFCFGWVLIPAITFIILTILKFIANIFHTSNQENRLKSVLRKIKEEFERTKGSMVCDVCKYECETYKELKAHGVSCPQSQCPYCFTHCEPTEAAFQAHYKVCQVTHRFRDDLKKTVTPQNFTPGCYRTLNLFRYKSRCYIFTMWVFLLVLESILWAASASETPLNPVWNDNAHGVGSVPMHTDLELDFSLTSSSKYTYRRKLTNPLEESQAIDLHIEIEDQTIGVDVHALGHWFDGRLNLETSFHCYGACTKYEYPWHTAKCHYERDYQYETSWGCSPSDCPGVGTGCTACGLYLDQLKPVGSAYKIITIRYSRRVCVQSGEENLCKIIDMNDCFVSRHVKVCIIGTVSKFSQGDTLLFFGPLEGGGLIFKHWCTSTCQFGDPGDIMSPRDKGFLCPEFPGSFRKKCNFATTPICEYDGNMVSGYKKVMATIDSFQSFNTSTMHFTDERIEWKDRDGMLRDHINILVTKDIDFDNLGENPCKIGLQTSSIEGAWGSGVGFTLTCLISLTECPTFLTSIKACDKAICYGAESVTLTRGQNTVKVSGKGGHSGSSFKCCHGEDCSQIGLHAAAPHLDKVNGISEIENSKVFDDGAPQCGIKCWSVKSGEWISGIFSGNWIVLIVLCVFLLFSLVLLSILCPVRKHKKS

SEQ ID NO: 1005 - protein, 1135 aa, Artificial Sequence
  derived and/or modified protein sequence (wt) from HTNV(Z5)__EU074224.1__GP
MGIWKWLVMASLVWPACTLRNVYDMKIECPHTVSFGENSVIGYVELPPMPLADTAQLVPESSCNMDNHQSMNTITKYTQVSWRSKVDQAQASQNSFEAVSAEVDLKGTCVLKHKMLEESYRSRKSITCYDLSCNSTYCKPTLYMIVPIHACNMMKGCLIALGPYRVQVVYERTYCMTGVLIEGKCFVPDQSVVSIIKHGIFDIASVHIVCFFVAVKGNTYKLFEQVKKSFQSTCNDTENKVQGYYICIVGGNSAPICVPTLDDFRSMEAFSGIFRSPHGEDHDLAGEEIASYSIVGPANAKVPHSASSDTLSLIAYSGIPSYSSLSILAGSTEAKHVFSPGFFPQLNHTKCDKTAIPLTWTGMIDLPGYYEAIHPCTVFCVLSGPGASCEAFSEGGIFNITSPMCLVSKQNRFRLTEQQVNFVCQRVDMDIIVYCNGQRKVILTKTLVIGQCIYTITSLFSLLPGVAHSIAVELCVPGFHGWATAALLVTFCFGWVLIPAITFVILTILKFIANIFHTSNQGNRLKSVLKKIKEEFEKTKGSMVCDVCKYECETYKELKAHGVSCPQSQCPYCFTHCEPTEAAFQAHYRVCQVTHRFRDDLKKTVTPQNFTPGCYRTLNLFRYKSRCYIFTMWVCLLVLESILWAASASEVPLNPIWNDNAHGVGSVPMHTDLELDFSLTSSSKYTYRRRLTNPLEETQAINLHIEIEEQTIGVDVHALGHWFDGRLNLKTSFHCYGACTKYEYPWHTAKCHYERDYQYETSWGCNPADCPGVGTGCTACGLYLDQLKPVGSAYKIITIRYSRKVCVQFGEENLCKVIDMNDCFVSRHVKVCIIGTVSKFSQGDTLLFFGPLEGGGLIFKHWCTSTCQFGDPGDIMSPRDKGFLCPEFPGSFRKKCNFATTPLCEYDGNMVSGYKKVMATIDSFQSFNTSTMHFTDERIEWKDPDGMLRDHINILVTKDIDFDNLGENPCKVGLQTSSIEGAWGSGVGFTLTCLVSLTECPTFLTSIKACDKAICYGAESVTLTRGQNTVKVSGKGGHSGSTFKCCHGEECSQIGLHAAAPHLDKVNGISEIENNKVYDDGAPQCGVKCWFVKSGEWISGIFSGNWIVLIVLCVFLLFSLALLSVLCPVRRHKKS

SEQ ID NO: 1006 - protein, 1135 aa, Artificial Sequence
  derived and/or modified protein sequence (wt) from HTNV(ZLS-12)__FJ753399.1__GP
MGIWKWLIMASLVWPAYTLRNVYDMRIECPHTVSFGENSVIGYVELPPMPLADTSQMVPESSCSMDNHQSLNTITKYTQVSWRGKADQSQASQNSFEAVSAEVDLKGTCVLKHKMLEESYRSRKSITCYDLSCNSTYCKPTLYMIVPIHACNMMKSCLIALGPYRVQVVYERTYCMTGILIEGKCFVPDQSVVSIIKHGIFDIASVHIVCFFVAVKGNTYKLFEQVKKSFQSTCNDTEDKVQGYYICIAGGNSAPIYVPTLDDFRSMEAFSGIFKSPHGEDHDLAGEEIASYSIVGPANAKVPHSASSDTLSLTAYSGIPSYSSLSILTSSTEAKHVFSPGFFPQLNHTKCDKTAIPLMWTGMIDLPGYYEAIHPCTVFCVLSGPGASCEAFSEGGIFNITSPMCLVSKQNRFRLTEQQVNFVCQRVDMDIVVYCNGQRKVILTKTLVIGQCIYTITSLFSLLPGVAHSIAVELCVPGFHGWATAALLVTFCFGWVLIPAITFIILTILKFIANIFHTSNQENRLKSVLRKIKEEFEKTKGSMVCDVCKYECETYKELKAHGVSCPQSQCPYCFTHCEPTEAAFQAHYRVCQVTHRFRDDLKKTVTPQNFTPGCYRTLNLFRYKSRCYIFTMWVFLLVLESILWAASASEVPLSPVWNDNAHGVGSIPMHTDLELDFSLTSSSKYTYRRKLTNPLEETQAINLHIEIEEQTIGVDVHALGHWFDGRLNLKTSFHCYGACTKYEYPWHTAKCHYERDYQYETSWGCNPADCPGVGTGCTACGLYLDQLKPVGSAYKIITIRYSRRVCVQLGEENLCKIIDMNDCFVSRHVKVCIIGTVSKFSQGDTLLFFGPLEGGGLIFKHWCTSTCQFGDPGDIMSPRDKGFLCPEFPGSFRKKCNFATTPLCEYDGNMVSGYKKVMATIDSFQSFNTSTMHFTDERIKWKDPDGMLRDHINILVTKDIDFDNLGENPCKIGLQTSAIEGAWGSGVGFTLTCLVSLTECPTFLTSIKACDKAICYGAESVTLTRGQNTVKVSGKGGHSGSLFKCCHGEECSQIGLHAAAPHLDKVNGISEIENNKVYDDGAPQCGVKCWFVKSGEWISGIFSGNWIVLIVLCVFLLFSLVLLSVLCPVRKHKKS

SEQ ID NO: 1007 - protein, 1135 aa, Artificial Sequence
  derived and/or modified protein sequence (wt) from HTNV(ZLS6-11)__FJ753397.1__GP
MGIWKWLIMASLVWPAYTLRNVYDMRIECPHTVSFGENSVIGYVELPPMPLADTSQMVPESSCSMDNHQSLNTITKYTQVSWRGKADQSQASQNSFEAVSAEVDLKGTCVLKHKMLEESYRSRKSITCYDLSCNSTYCKPTLYMIVPIHACNMMKSCLIALGPYRVQVVYERTYCMTGILIEGKCFVPDQSVVSIIKHGIFDIASVHIVCFFVAVKGNTYKLFEQVKKSFQSTCNDTEDKVQGYYICIAGGNSAPIYVPTLDDFRSMEAFSGIFKSPHGEDHDLAGEEIASYSIVGPANAKVPHSASSDTLSLTAYSGIPSYSSLSILTSSTEAKHVFSPGFFPQLNHTKCDKTAIPLMWTGMIDLPGYYEAIHPCTVFCVLSGPGASCEAFSEGGIFNITSPMCLVSKQNRFRLTEQQVNFVCQRVDMDIVVYCNGQRKVILTKTLVIGQCIYTITSLFSLLPGVAHSIAVELCVPGFHGWATAALLVTFCFGWVLIPAITFIILTILKFIANIFHTSNQENRLKSVLRKIKEEFEKTKGSMVCDVCKYECETYKELKAHGVSCPQSQCPYCFTHCEPTEAAFQAHYRVCQVTHRFRDDLKKTVTPQNFTPGCYRTLNLFRYKSRCYIFTMWVFLLVLESILWAASASEVPLSPVWNDNAHGVGSIPMHTDLELDFSLTSSSKYTYRRKLTNPLEETQAINLHIEIEEQTIGVDVHALGHWFDGRLNLKTSFHCYGACTKYEYPWHTAKCHYERDYQYETSWGCNPADCPGVGTGCTACGLYLDQLKPVGSAYKIITIRYSRKVCVQFGEENLCKIIDMNDCFVSRHVKVCIIGTVSKFSQGDTLLFFGPLEGGGLIFKHWCTSTCQFGDPGDIMSPRDKGFLCPEFPGSFRKKCNFATTPLCEYDGNMVSGYKKVMATIDSFQSFNTSTMHFTDERIEWKDPDGMLRDHINILVTKDIDFDNLGENPCKIGLQTSAIEGAWGSGVGFTLTCLVSLTECPTFLTSIKACDKAICYGAESVTLTRGQNTVKVSGKGGHSGSLFKCCHGEECSQIGLHAAAPHLDKVDGISEIENNKVYDDGAPQCGVKCWFVKSGEWISGIFSGNWIVLIVLCVFLLFSLVLLSVLCPVRKHKKS

SEQ ID NO: 1008 - protein, 1135 aa, Artificial Sequence
  derived and/or modified protein sequence (wt) from HTNV__AB030232.1__GP
MGLWKWLIMAVLVWPCFALRNVYDMKIECPHTVNFGENSVVGYVELPPMPIADITQMMPESSCSMDNHQSLNTITKYTQVSWRKKADRAQSSQTSFETVSSEVDFKGTCVLKHKMVEDSYRSRKSIICYDLSCNSTFCKPTLYLIVPVHACNMMKSCLIALGPYRVQDVYERTYCMSGVLLEGKCFVPDRSVVSIIKHGIFDIASVHIVCFFVAIKGSTYKILEQVKKSFELTCNDTDNKIQGYYICLVGGNSAPIYVPTLDDFRSMEAFAGIFKSPHGEDHDLAGEEVASYSIVGPANAKVPHSASADTLSLVAFSGIPSYSSFSVLTGSTDARHVFSPGFFPQLNQTRCDKTAIPLTWTGMIDLPGYYEAVHPCTVFCVLSGPGASCEAFSEGGIFNITSPMCLVSEQNRFRSSEQQVNFVCQRVDMDIVVYCNGQKKVILTKTLVIGQCIYTITSLFSLLPGVAHSIAVELCVPGFHGWATAALLVTFCFGWVLIPAVTLVILTILKFIANIFHTSNQENRLKSVLKKIKEEFEKTKGSMVCDVCKYECETYKELKAHGVSCPQSQCPYCFTHCEPTEAAFQAHYKVCQVTHRFRDDLKKTVTPQNFTPGCYRTLNLFRYKSRCYIFTMWVFLLILESILWAASASETPSTPIWNDNAHGVGSIPMHTDLELDFSLTSSSKYTYRRKLTNPLEKTQAVDLHIELAVQTIGVDVHALGHWFDGRLNLKTSFHCYGACTKYEYPWHTAKCHYERDYQYETSWGCNPADCPGVGTGCTACGLYLDQLKPVGSAYKIITIKYSRRVCVQFGEENLCKVIDMNDCFVSRHVKICIIGTVSKFSQGDTLLFFGPLEGGGLIFKHWCTSTCQFGDPGDIMSPRDKGFLCPEFPGSFRKKCNFATTPVCEYDGNMVSGYKKVMATIDSFQSFNTSMMHFTDERIEWKDPDGMLRDHINILVTKDIDFDNLGDNPCKVGLQTSAIEGAWGSGVGFTLTCQVSLTECPTFLTSIKACDKAICYGAESITLTRGQNTVKVSGKGGHSGSTFKCCHGEECSQIGLHAAAPHLDKVNGISEMENSKVYDDGAPECGIKCWFVKSGEWISGIFNGNWIVLIVLCAFLIFSLVLLSLLCPVRKHKKA

SEQ ID NO: 1009 - protein, 1135 aa, Artificial Sequence
  derived and/or modified protein sequence (wt) from HTNV__AB620032.1__GP
MGMWKWLVIASLVWPVLALRNVYDMKIECPHTVSFGENSVIGFVELPPMPLADTAQMVPESSCSMDNHQSINTITKYTQVTWRGKADPGQSSQNSFETVSTEVDLKGTCVLKHKMVEESYRSRKSITCYDLSCNSTYCKPTLYMIVPIHACNMMKSCLIALGPYRVQVVYERTYCMTGVLIEGKCFVPDQSVVSIIKHGIFDIASVHIVCFFVAIKGNTYKLFEQVKKSFESTCNDTENKVQGYYICIVGGNSAPIYVPTLDDFRSMEAFTGIFKSPHGEDHDLAGEEIASYSIVGPANAKVPHSASSDTLSLIAYSGIPSYSSLSILTSSTDAKHVFSPGLFPKLNHTNCDKSAIPLTWTGMIDLPGYYEAIHPCTVFCVLSGPGASCEAFSEGGIFNITSPMCLVSKQNRFRLTEQQVNFVCQRVDMDIVVYCNGQRKVILTKTLVIGQCIYTITSLFSLLPGVAHSIAVELCVPGFHGWATAALLVTFCFGWVLIPAVTFVILTILKFVANIFHTSNQENRLKSVLRKIKEEFEKTKGSMVCDVCKYECETYKELKAHGVSCPQSQCPYCFTHCEPTEAAFQAHYKVCQVTHRFRDDLKKTVTPQNFTPGCYRTLNLFRYKSRCYIFTMWVFLLILESVLWAASASETPLAPVWNDNAHGVGSVPMHTDLELDFSLTSSSKYTYRRKLTNPLEEAQSIDLHIEIEEQTIGVDVHALGHWFDGRLNLKTSFHCYGACTKYEYPWHTAKCHYERDYQYETSWGCNPSDCPGVGTGCTACGLYLDQLKPVGSAYKIITIRYSRRVCVQFGEENLCKIIDMNDCFVSRHVKVCIIGTVSKFSQGDTLLFFGPLEGGGLIFKHWCTSTCQFGDPGDIMSPRDKGFLCPEFPGSFRKKCNFATTPICEYDGNTVSGYKKVMATIDSFQSFNTSTMHFTDERIEWKDPDGMLRDHINILVTKDIDFDNLGENPCKIGLQTSSIEGAWGSGVGFTLTCLVSLTECPTFLTSIKACDKAICYGAESVTLTRGQNTVKVSGKGGHSGSTFKCCHGEDCSQIGLHAAAPHLDKVNGISEIENSKVYDDGAPQCGIKCWFVKSGEWISGIFSGNWIVLIVLCVFLLFSLVLLSILCPVRKHKKS

SEQ ID NO: 1010 - protein, 1135 aa, Artificial Sequence
  derived and/or modified protein sequence (wt) from HTNV__D25532.1__GP
MGIWKWLVMASLVWPVLTLRNVYDMKIECPHTVSFGGNSVIGYVELPPVPLADTAQMVPESSCSMDNHQSLNTITKYTQVSWRGKADQSQSSQNSFETVSTEVDLKGTCVLKHKMVEESYRSRKSVTCYDLSCNSTYCKPTLYMIVPIHACNMMKSCLIALGPYRVQVVYERTYCMTGVLIEGKCFVPDQSVVSIIKHGIFDIASVHIVCFFVAVKGNTYKIFEQVKKSFESTCNDTENKVQGYYICIVGGNSAPIYVPTLDDFRSMEAFTGIFRSPHGEDHDLAGEEIASYSIVGPANAKVPHSASSDTLRLIAYSGIPSYSSLSILTSSTEAKHVFSPGLFPKLNHTNCDKSAIPLIWTGMIDLPGYYEAVHPCTVFCVLSGPGASCEAFSEGGIFNITSSMCLVSKQNRFRLTEQQVNFVCQRVDMDIVVYCNGQRKVILTKTLVIGQCIYTITSLFSLLPGVAHSIAVELCVPGFHGWATAALLVTFCFGWVLIPAITFIILTVLKFIANIFHTSNQENRLKSVLRKIKEEFEKTKGSMVCDVCKYECETYKELKAHGVSCPQSQCPYCFTHCEPTEAAFQAHYKVCQVTHRFRDDLKKTVTPQNFTPGCYRTLNLFRYKSRCYIFTMWIFLLVLESILWAASASETPLTPVWNDNAHGVGSVPMHTDLELDFSLTSSSKYTYRRKLTNPLEEAQSIDLHIEIEEQTIGVDVHALGHWFDGRLNLKTSFHCYGACTKYEYPWHTAKCHYERDYQYETSWGCNPSDCPGVGTGCTACGLYLDQLKPVGSAYKIITIRYSRRVCVQFGEENLCKIIDMNDCFVSRHVKVCIIGTVSKFSQGDTLLFFGPLEGGGLIFKHWCTSTCQFGDPGDIMSPRDKGFLCPEFPGSFRKKCNFATTPICEYDGNMVSGYKKVMATIDSFQSFNTSTMHFTDERIEWKDPDGMLRDHINILVTKDIDFDNLGENPCKIGLQTSSIEGAWGSGVGFTLTCLVSLTECPTFLTSIKACDKAICYGAESVTLTRGQNTVKVSGKGGHSGSTFKCCHGEDCSQIGLHAAAPHLDKVNGISEIENSKVYDDGAPQCGIKCWFVKSGEWISGIFSGNWIVLIVLCVFLLFSLVLLGILCPVRKHKKS

SEQ ID NO: 1011 - protein, 1135 aa, Artificial Sequence
  derived and/or modified protein sequence (wt) from HTNV__L08753.1__GP
MGIWKWLVMASLVWPAYTLRNVYDMKIECPHTVSFGENSVIGYVELPPIPLADTTQMVPESSCSMDNHQSLNTVTKYTQVSWRGKADQAQASQNSFEAVSAEVDLKGTCVLKHKMLEESYRSRKSIACYDLSCNSTYCKPTLYMIVPIHACNMMKSCLIALGPHRVQVVYERTYCMTGVLIEGKCFVPDQSVVSIIKHGIFDIASVHIVCFFVAVKGNTYKIFEQIKKSFESTYNDTKNKVEGYYICIVGGNSAPIYVPTLDDFRSMEAFSGIFRSPHGEDHDLAGEEIASYSIVGPANVKVPHSASSDTLSLTAYSGIPSYSSLSILAGSAEAKHVFSPGFFPQLNHTKCDKTAIPLMWTGMIDLPGYYEAIHPCTVFCVLSGPGASCEAFSEGGIFNITSPMCLVSKQNRFRLTEQQVNFVCQRVDMDIIVYCNGQRKVILTKTLVIGQCIYTITSLFSLLPGVAHSIAVELCVPGFHGWATAALLVTFCFGWVLIPAMTFIVLTILKFIANIFHTSNQENKLKSVLRKIKEEFEKTKGSMVCDVCKYECETYKELKAHGVSCPQSQCPYCFTHCEPTEAAFQAHYRVCQVTHRFRDDLKKTVTPQNFTPGCYRTLNLFRYKSRCYIFTMWVFLLVLESILWAASASEIPLYPVWNDNAHGVGSVPMHTDLELDFSLTSSSKYTYRRKLTNPLEESQAINLHIEIEEQTIGVDVHALGHWFDGRLNLKTSFHCYGACTKYEYPWHTAKCHYDRDYQYETSWGCNPSDCPGVGTGCTACGLYLDQLKPVGSAYKIITIRYSRRVCVQFGEENLCKIIDMNDCFVSRHVKVCIIGTVSKFSQGDTLLFFGPLEGGGLIFKHWCTSTCQFGDPGDIMSPRDKGFLCPEFPGSFRKKCNFATTPLCEYDGNMVSGYKKVMATIDSFQSFNTSTMHFTDERIEWKDPDGMLRDHINILVTKDIDFENLGENPCKIGLQTSSIEGAWGSGVGFTLTCLVSLTECPTFLTSIKACDKAICYGAESVTLTRGQNTVKVSGKGGYSGSTFKCCHGEECSQIGLHAAAPHLDKVNGISEIENNKVYDDGAPQCGIKCWFVKSGEWISGIFSGNWIVLIVLCVFLLFSLILLSILCPARKHKKS

SEQ ID NO: 1012 - protein, 1135 aa, Artificial Sequence
  derived and/or modified protein sequence (wt) from HTNV__M14627.1__GP
MGIWKWLVMASLVWPVLTLRNVYDMKIECPHTVSFGENSVIGYVELPPVPLADTAQMVPESSCNMDNHQSLNTITKYTQVSWRGKADQSQSSQNSFETVSTEVDLKGTCVLKHKMVEESYRSRKSVTCYDLSCNSTYCKPTLYMIVPIHACNMMKSCLIALGPYRVQVVYERSYCMTGVLIEGKCFVPDQSVVSIIKHGIFDIASVHIVCFFVAVKGNTYKIFEQVKKSFESTCNDTENKVQGYYICIVGGNSAPIYVPTLDDFRSMEAFTGIFRSPHGEDHDLAGEEIASYSIVGPANAKVPHSASSDTLSLIAYSGIPSYSSLSILTSSTEAKHVFSPGLFPKLNHTNCDKSAIPLIWTGMIDLPGYYEAVHPCTVFCVLSGPGASCEAFSEGGIFNITSPMCLVSKQNRFRLTEQQVNFVCQRVDMDIVVYCNGQRKVILTKTLVIGQCIYTITSLFSLLPGVAHSIAVELCVPGFHGWATAALLVTFCFGWVLIPAITFIILTVLKFIANIFHTSNQENRLKSVLRKIKEEFEKTKGSMVCDVCKYECETYKELKAHGVSCPQSQCPYCFTHCEPTEAAFQAHYKVCQVTHRFRDDLKKTVTPQNFTPGCYRTLNLFRYKSRCYIFTMWIFLLVLESILWAASASETPLTPVWNDNAHGVGSVPMHTDLELDFSLTSSSKYTYRRKLTNPLEEAQSIDLHIEIEEQTIGVDVHALGHWFDGRLNLKTSFHCYGACTKYEYPWHTAKCHYERDYQYETSWGCNPSDCPGVGTGCTACGLYLDQLKPVGSAYKIITIRYSRRVCVQFGEENLCKIIDMNDCFVSRHVKVCIIGTVSKFSQGDTLLFFGPLEGGGLIFKHWCTSTCQFGDPGDIMSPRDKGFLCPEFPGSFRKKCNFATTPICEYDGNMVSGYKKVMATIDSFQSFNTSTMHFTDERIEWKDPDGMLRDHINILVTKDIDFDNLGENPCKIGLQTSSIEGAWGSGVGFTLTCLVSLTECPTFLTSIKACDKAICYGAESVTLTRGQNTVKVSGKGGHSGSTFRCCHGEDCSQIGLHAAAPHLDKVNGISEIENSKVYDDGAPQCGIKCWFVKSGEWISGIFSGNWIVLIVLCVFLLFSLVLLSILCPVRKHKKS

SEQ ID NO: 1013 - protein, 1135 aa, Artificial Sequence
  derived and/or modified protein sequence (wt) from HTNV__EU074672.1__GP
MGIWKWLVMASLVWPAFALRNVYDMKIECPHTVSFGENSVIGYVELPPMPLADTTQMVPESSCSMDNHQSLNTITKYTQIIWRGKADQSQSSQNSFETVSTEVDLKGTCVLKHKMIEESYRSRKSITCYDLSCNSTYCKPTLYMIVPIHACNMMKSCLIALGPYRVQVVYERTYCMTGVLIEGKCFVPDQSVVSIIKHGIFDIASVHIVCFFVAVKGNTYKIFEQVKKSFESNCNDTENKVQGYYICIIGGNSSPVYVPTLDDFRSMEAFSGIFRSPHGEDHDLAGEEVASYSIVGPANAKVPHSASSDTLGLIAYSGIPSYSSLSILTSSTEAKHVFSPGLFPQLNHTKCDKTAIPLTWTGMIDLPGYYEAIHPCTVFCVLSGPGASCEAFSEGGIFNITSPMCLVSKQNRFRLTEQQVNFVCQRVDVDIIVYCNGQRKVILTKTLVIGQCIYTITSLFSLLPGVAHSIAVELCVPGFHGWATAALLVTFCFGWVLIPAITFIILTILKFIANIFHTSNQENRLKSVLRKIKEEFERTKGSMVCDICKYECETYRELKAHGVSCPQSQCPYCFTHCEPTEAAFQAHYKVCQVTHRFRDDLKKTVTPQNFTPGCYRTLNLFRYKSRCYIFTMWVFLLVLESILWAASASEIPLNPVWNDNAHGVGSIPMHTDLELDFSLTSSSKYTYRRKLTNPLEESQAIDLHVEIEEQTIGVDVHALGHWFDGRLNLKTSFHCYGACTKYEYPWHTAKCHYERDYQYETSWGCNPSDCPGVGTGCTACGLYLDQLKPVGSAYKIITIRYSRRVCVQFGEENLCKIIDMNDCFVSRHVKVCIIGTVSKFSQGDTLLFFGPLEGGGLIFKHWCTSTCQFGDPGDIMSPRDKGFLCPEFPGSFRKKCNFATTPVCEYDGNMVSGYKKVMATIDSFQSFNTSTMHFTDERIEWKDPDGMLRDHINILVTKDIDFDNLGENPCKIGLQTSSIEGAWGSGVGFTLTCLISLTECSTFLTSIKACDKAICYGAESVTLTRGQNTVKVSGKGGHSGSSFKCCHGEECSQIGLHAAAPHLDKVNGISEMENSKVFDDGAPQCGIKCWFVKSGEWISGIFSGNWIVLIVLCVFLLFSLVLLSILCPVRKHKKS

SEQ ID NO: 1014 - protein, 1135 aa, Artificial Sequence
  derived and/or modified protein sequence (wt) from HTNV__GQ120966.1__GP
MEIWKWLVMASLVWPAFTLRNVYDMKIECPHTVSFGENSVIGYVELPPMPLADTAQMVPESSCNMDNHQSMNTITKYTQVSWRGKADQAQASQNSFEAVSAEVDLKGTCVLKHKMLEESYRSRKSITCYDLSCNSTYCKPTLYMIVPIHACNMMKSCLIALGPYRVQVVYERTYCMTGVLIEGKCFVPDQSVVSIIKHGIFDIASVHIVCFFVAVKGNTYKLFEQVKKSFQSTCNGTENKVQGYYICIVGGNSAPIYVPTLDDFRSMEAFSGIFRSPHGEDHDLAGEEIASYSIVGPANAKVPHSASSDTLSLIAYSGIPSYSSLSILASSTEAKHVFSPGFFPQLNHTKCDKTAIPLTWTGMIDLPGYYEAIHPCTVFCVLSGPGASCEAFSEGGIFNITSPMCLVSKQNRFRLTEQQVNFVCQRVDMDIIVYCNGQRKVILTKTLVIGQCIYTITSLFSLLPGVAHSIAVELCVPGFHGWATAALLVTFCFGWVLIPALTLIILTILKFIANIFHTSNQENRLKSVLRKIKEEFEKTKGSMVCDVCKYECETYKELKAHGVSCPQSQCPYCFTHCEPTEAAFQAHYRVCQVTHRFRDDLKKTVTPQNFTPGCYRTLNLFRYKSRCYIFTMWVCLLVLESILWAASASEVPLNPVWNDNAHGVGSVPMHTDLELDFPLTSSSKYTYRRRLTNPLEETQSINLHIEIEEQTIGVDVHALGHWFDGRLNLKTSFHCYGACTKYEYPWHTAKCHYERDYQYETSWGCNPADCPGVGTGCTACGLYLDQLKPVGSAYKIITIRYSRKVCVQFGEENLCKVIDMNDCFVTRHVKVCIIGTVSKFSQGDTLLFFGPLEGGGLIFKHWCTSTCQFGDPGDIMSPRDKGFLCPEFPGSFRKKCNFATTPLCEYDGNMVSGYKKVMATIDSFQSFNTSTMHFTDERIEWKDPDGMLRDHINILVTKDIDFDNLGENPCKIGLQTSSIEGAWGSGVGFTLTCLISLTECPTFLTSIKACDKAICYGAESVTLTRGQNTVKVSGKGGHSGSTFKCCHGEECSQIGLHAAAPHLDKVNGISEIENNKVYDDGAPQCGVKCWFVKSGEWISGIFSGNWIVLIVLCVFLLFSLVLLSVLCPVRKHKKS

SEQ ID NO: 1015 - protein, 1135 aa, Artificial Sequence
  derived and/or modified protein sequence (wt) from HTNV(CGAa1011)__EF990927.1__GP
MEIWKWLVMASLVWPALALRNVHDMKIECPHTVSFGKNSVIGYVELPPMPLADTIQMVPESSCSMDNHQSLSTVTKYTQVSWRGKADQAQSNQTSFETVSVEVDLKGTCVLKHKLVEESYRSRKSLTCYDLSCNSTYCKPTLYMIVPIHACNMMKSCIIALGPHRVQVVYERTYCMTGVLLEGKCFVPDQSVVGIVKHGIFDIASVHIACFFVAITGNTYKLFEQVKKSFGTTCNDTENKVQGYYICILGGNSPPIYVPTLDDFRSMEAFSGIFKSPHGEDHDLAGEEIASYSIVGPANAKVPHSASSDTLSLIAFSGIPSYSSLSILTSSTEAKHVFSPGLFPQLNHTKCDKTAIPLTWTGIIDLPGYYEAVHPCTVFCVLSGPGASCEAFSEGGIFNITSPMCLVSKQNRFRLTEQQVNFVCQRVDMDIVVYCNGQRKVILTKTLVIGQCIYTITSLFSLLPGVAHSIAVELCVPGFHGWATAALLITFCFGWVLIPALTFIVLTVLKFIANIFHTSNQENRLKMVLKKIKEEFERTKGSMVCDICKYECETYKELKAHGVSCPQSQCPYCFTHCEPTESAFQAHYRVCQVTHRFRDDLKKTVTPQNFTPGCYRTLNLFRYKSRCYIFTMWICLLVLESILWAASASEIPLSPTWNDNAHGVGSIPMHTDLELDFSLTSSSKYTYRRKLTNPLEESQAVNFHVEIEEQAIGVDVHALGHWFDGRLNLKTSFHCYGACTKYEYPWHTAKCHYERDYQYETSWGCNPSDCPGVGTGCTACGLYLDQLKPVGSAYKIITIRYSRRVCVQFGEENLCKVIDMNDCFVSRHVKVCIIGTVSKFSQGDTLLFFGPLEGGGLIFKHWCTSTCQFGDPGDIMSPRDKGFLCPEFPGSFRKKCNFATTPVCEYDGNMVSGYKKVMATIDSFQSSNTSTMHFTDERIEWKDPDGMLRDHINILVTKDIDFDNLGENPCKIGLQTSSIEGAWGSGVGFTLTCLISLTECPTFLTSIKACDKAICYGAESVTLTRGQNTVKVSGKGGHSGSTFKCCHGEDCSQSGLHAAAPHLDKVNGISEIENSKVYDDGAPQCGVKCWFVKSGEWISGIFSGNWIVLIVLCVFLLFSLVLLSILCPVRKHKKS

SEQ ID NO: 1016 - protein, 1135 aa, Artificial Sequence
  derived and/or modified protein sequence (wt) from HTNV(CGAa2)__EU092223.1__GP
MEIWKWLVMASLVWPALALRNVHDMKIECPHTVSFGKNSVIGYVELPPMPLADTIQMVPESSCSMDNHQSLSTVTKYTQVSWRGKADQAQPSQTSFETVSVEVDLKGTCVLKHKLVEESYRSRKSLTCYDLSCNSTYCKPTLYMIVPIHACNMMKSCIIALGPHRVQVVYERTYCMTGVLLEGKCFVPDQSVVSIVRHGIFDIASVHIACFFVAITGNTYKLFEQVKKSFGTTCNDTENKVQGYYICILGGNSPPIYVPTLDDFRSMEAFSGIFKSPHGEDHDLAGEEIASYSIVGPANAKVPHSASSDTLSLIAFSGIPSYSSLSILTSSTEAKHVFSPGLFPQLNHTKCDKTAIPLTWTGIIDLPGYYEAVHPCTVFCVLSGPGASCEAFSEGGIFNITSPMCLVSKQNRFRLTEQQVNFVCQRVDMDIVVYCNGQRKVILTKTLVIGQCIYTITSLFSLLPGVAHSIAVELCVPGFHGWATAALLITFCFGWVLIPALTFIVLTVLKFIANIFHTSNQENRLKMVLKKIKEEFERTKGSMVCDICKYECETYKELKAHGVSCPQSQCPYCFTHCEPTESAFQAHYRVCQVTHRFRDDLKKTVTPQNFTPGCYRTLNLFRYKSRCYIFTMWICLLVLESILWAASASEIPLSPTWNDNAHGVGSIPMHTDLELDFSLTSSSKYTYRRKLTNPLEESQAVNFHVEIEEQAIGVDVHALGHWSDGRLNLKTSFHCYGACTKYEYPWHTAKCHYERDYQYETSWGCNPSDCPGVGTGCTACGLYLDQLKPVGSAYKIITIRYSRRVCVQFGEENLCKVIDMNDCFVSRHVKVCIIGTVSKFSQGDTLLFFGPLEGGGLIFKHWCTSTCQFGDPGDIMSPRDKGFLCPEFPGSFRKKCNFATTPVCEYDGNMVSGYKKVMATIDSFQSSNTSTMHFTDERIEWKDPDGMLRDHINILVTKDIDFDNLGENPCKIGLQTSSIEGAWGSGVGFTLTCLISLTECPTFLTSIKACDKAICYGAESVTLTRGQNTVKVSGKGGHSGSTFKCCHGEDCSQSGLHAAAPHLDKVNGISEIENSKVYDDGAPQCGVKCWFVKSGEWISGIFSGNWIVLIVLCVFLLFSLVLLSILCPVRKHKKS

SEQ ID NO: 1017 - protein, 1135 aa, Artificial Sequence
  derived and/or modified protein sequence (wt) from HTNV(CGAa31MP7)__EF990925.1__GP
MGIWKWLVMASLVWPAFALRNVYDMKIECPHTVSFGENSVIGYVELPPMPLADTTQMVPESSCSMDNHQSLNTITKYTQIIWRGKADQSQSSQNSFETVSTGVDLKGTCVLKHKMIEESYRSRKSITCYDLSCNSTYCKPTLYMIVPIHACNMMKSCLIALGPYRVQVVYERTYCMTGVLIEGKCFVPDQSVVSIIKHGIFDIASVHIVCFFVAVKGNTYKIFEQVKKSFESNCNDTENKVQGYYICIIGGNSSPVYVPTLDDFRSMEAFSGIFRSPHGEDHDLAGEEVASYSIVGPANAKVPHSASSDTLGLIAYSGIPSYSSLSILTSSTEAKHVFSPGLFPQLNHTKCDKTAIPLTWTGMIDLPGYYEAIHPCTVFCVLSGPGASCEAFSEGGIFNITSPMCLVSKQNRFRLTEQQVNFVCQRVDVDIIVYCNGQRKVILTKTLVIGQCIYTITSLFSLLPGVAHSIAVELCVPGFHGWATAALLVTFCFGWVLIPAITFIILTILKFIANIFHTSNQENRLKSVLRKIKEEFERTKGSMVCDICKYECETYKELKAHGVSCPQSQCPYCFTHCEPTEAAFQAHYRVCQVTHRFRDDLKKTVTPQNFTPGCYRTLNLFRYKSRCYIFTMWICLLVLESILWAASASEIPLNPVWNDNAHGVGSIPMHTDLELDFSLTSSSKHTYRRKLTNPLEESQAIDLHVEIEEQTIGVDVHALGHWFDGRLNLKTSFHCYGACTKYEYPWHTAKCHYERDYQYETSWGCNPSDCPGVGTGCTACGLYLDQLKPVGSAYKIITIRYSRRVCVQFGEENLCKVIDMNDCFVSRHVKVCIIGTVSKFSQGDTLLFFGPLEGGGLIFKHWCTSTCQFGDPGDIMSPRDKGFLCPEFPGSFRKKCNFATTPVCGYDGNMVSGYKKVMATIDSFQSFNTSTMHFTDERIEWKDPDGMLRDHINILVTKDIDFDNLGENPCKIGLQTSSIEGAWGSGVGFTLTCLISLTECPTFLTSIKACDKAICYGAESVTLTRGQNTVKVSGKGGHSGSTFKCCHGEDCSQSGLHAAAPHLDKVNGISEIENSKVYDDGAPQCGIKCWFVKSGEWISGIFSGNWIVLIVLCVFLLFSLVLLSILCPVRKHKKS

SEQ ID NO: 1018 - protein, 1135 aa, Artificial Sequence
  derived and/or modified protein sequence (wt) from HTNV(CGAa4MP9)__EF990929.1__GP
MEIWKWLVMASLVWPALALRNVYDMKIECPHTVSFGENSVLGYVELPPMPLADTIQMVPESSCSMDNHQSMSTATKYTQVSWRGKADQAQSSQTSFETVSVEVDLKGTCVLKHKMVEKSYRSRKSLTCYDLSCNSTYCKPTLYMIVPIHACNMMKSCIIALGPYRVQVVYERTYCMTGVLLEGKCFVPDQSVVSIVKHSIFDIASVHIACFFVAITGNTYKLIEQVKTSFGTTCNDTEDKVQGYYICILGGNSPPIYVPTLDDFRSMEAFSGIFRSPHGEDHDLAGEEIASYSIVGPANAKIPHSASSDTLSLIAFSGIPSYSSLSILTSSTEAKHVFSPGLFPQLNHTKCDKTAIPLTWTGIIDLPGYYEAVHPCTVFCVLSGPGASCEAFSEGGIFNITSPMCLVSKQNRFRLTEQQVNFVCQRVDMDIVVYCNGQRKVILTKTLVIGQCIYTITSLFSLLPGVAHSIAVELCVPGFHGWATAALLVTFCFGWVLIPAITFVVLTVLKFIANIFHTSNQENRLKMVLKKIKEEFEKTKGSMVCDICKYECETYKELKAHGVSCPQSQCPYCFTHCEPTESAFQAHYRVCQVTHRFREDLKKTVTPQNFTPGCYRTLNLFRYKSRCYIFTMWIFLLVLESILWAASASETPLSPTWNDNAHGVGSIPMHTDLELDFSLTSSSKYTYRRKLTNPLEEAQAVSFHVEIEEQTIGVDVHALGHWFDGRLNLKTSFHCYGACTKYEYPWHTAKCHYERDYQYETSWGCNPSDCPGVGTGCTACGLYLDQLKPVGSAYKIITIRYSRRVCVQFGEENLCKVIDMDDCFVSRHVKVCIIGTVSKFSQGDTLLFFGPLEGGGLIYKHWCTSTCQFGDPGDIMSPRDKGLLCPEFPGSFRKKCNFATTPVCEYDGNMVSGYKKVMATIDSFQSINTSTMHFTDERIEWKDPDGMLRDHINILVTKDIDFDNLGENPCKIGLQTSSIEGAWGSGVGFTLTCLISLTECPTFLTSIKACDKAICYGAESVTLTRGQNTVKVSGKGGHSGSTFKCCHGEDCSQSGLHAAAPHLDKVNGISEMENSKVYDDGAPQCGIKCWFVKSGEWISGIFSGNWIVLIVLCVFLLFSLVLLSILCPVRKHKKS

SEQ ID NO: 1019 - protein, 1135 aa, Artificial Sequence
  derived and/or modified protein sequence (wt) from HTNV(CGAa4P15)__EF990928.1__GP
MEIWKWLVMASLVWPALALRNVYDMKIECPHTVSFGENSVLGYVELPPMPLADTIQMVPESSCSMDNHQSMSTATKYTQVSWRGKADQAQSSQTSFETVSVEVDLKGTCVLKHKMVEKSYRSRKSLTCYDLSCNSTYCKPTLYMIVPIHACNMMKSCIIALGPYRVQVVYERTYCMTGVLLEGKCFVPDQSVVSIVKHSIFDIASVHIACFFVAITGNTYKLFEQVKTSFGTTCNDTEDKVQGYYICILGGNSPPIYVPTLDDFRSMEAFSGIFRSPHGEDHDLAGEEIASYSIVGPANAKIPHSASSDTLSLIAFSGIPSYSSLSILTSSTEAKHVFSPGLFPQLNHTKCDKTAIPLTWTGIIDLPGYYEAVHPCTVFCVLSGPGASCEAFSEGGIFNITSPMCLVSKQNRFRLTEQQVNFVCQRVDMDIVVYCNGQRKVILTKTLVIGQCIYTITSLFSLLPGVAHSIAVELCVPGFHGWATAALLVTFCFGWVLIPAITFVVLTVLKFIANIFHTSNQENRLKMVLKKIKEEFEKTKGSMVCDICKYECETYKELKAHGVSCPQSQCPYCFTHCEPTESAFQAHYRVCQVTHRFREDLKKTVTPQNFTPGCYRTLNLFRYKSRCYIFTMWIFLLVLESILWAASASETPLSPTWNDNAHGVGSIPMHTDLELDFSLTSSSKYTYRRKLTNPLEEAQAVSFHVEIEEQTIGVDVHALGHWFDGRLNLKTSFHCYGACTKYEYPWHTAKCHYERDYQYETSWGCNPSDCPGVGTGCTACGLYLDQLKPVGSAYKIITIRYSRRVCVQFGEENLCKVIDMDDCFVSRHVKVCIIGTVSKFSQGDTLLFFGPLEGGGLIFKHWCTSTCQFGDPGDIMSPRDKGFLCPEFPGSFRKKCNFATTPVCEYDGNMVSGYKKVMATIDSFQSINTSTMHFTDERIEWKDPDGMLRDHINILVTKDIDFDNLGENPCKIGLQTSSIEGAWGSGVGFTLTCLISLTECPTFLTSIKACDKAICYGAESVTLTRGQNTVKVSGKGGHSGSTFKCCHGEDCSQSGLHAAAPHLDKVNGISEMENSKVYDDGAPQCGIKCWFVKSGEWISGIFSGNWIVLIVLCVFLLFSLVLLSILCPVRKHKKS

SEQ ID NO: 1020 - protein, 1135 aa, Artificial Sequence
  derived and/or modified protein sequence (wt) from HTNV(CGAa75)__EU092224.1__GP
MEIWKWLVMASLVWPALALRNVHDMKIECPHTVSFGKNSVIGYVELPPMPLADTIQMVPESSCSMDNHQSLSTVTKHTQVSWRGKADQAQSSQTSFETVSVEVDLKGTCVLKHKLVEESYRSRKSLTCYDLSCNSTYCKPTLYMIVPIHACNMMKSCIIALGPHRVQVVYERTYCMTGVLLEGKCFVPDQSVVSIVRHGIFDIASVHIACFFVAITGNTYKLFEQVKKSFGTTCNDTENKVQGYYICILGGNSPPIYVPTLDDFRSMEAFSGIFKSPHGEDHDLAGEEIASYSIVGPANAKVPHSASSDTLSLIAFSGIPSYSSLSILTSSTEAKHVFSPGLFPQLNHTKCDKTAIPLTWTGIIDLPGYYEAVHPCTVFCVLSGPGASCEAFSEGGIFNITSPMCLVSKQNRFRLTEQQVNFVCQRVDMDIVVYCNGQRKVILTKTLVIGQCIYTITSLFSLLPGVAHSIAVELCVPGFHGWATAALLITFCFGWVLIPALTFIVLTVLKFIANIFHTSNQENRLKMVLKKIKEEFERTKGSMVCDICKYECETNKELKAHGVSCPQSQCPYCFTHCEPTESASQAHYRVCQVTHRFRDDLKKTVTPQNFTPGCYRTLNLFRYKSRCYIFTMWICLLVLESILWAASASEIPLSPTWNDNAHGVGSIPMHTDLELDFSLTSSSKYTYRRKLTNPLEESQAVNFHVEIEEQAIGVDVHALGHWFDGRLNLKTSFHCYGACTKYEYPWHTAKCHYERDYQYETSWGCNPSDCPGVGTGCTACGLYLDQLKPVGSAYKIITIRYSRRVCVQFGEENLCIVIDMNDCFVSRHVKVCIIGTVSKFSQGDTLLFFGPLEGGGLILKHWCTSTCQFGDPGDIMSPRDKGFLCPEFPGSFRKKCNFATTPVCEYGGNMVSGYKKVMATIDSFQSFNTSTMHFTDERIEWKDPDGMLRDHINILVTKDIDFDNLGENPCKIGLQTSSIEGAWGSGVGFTLTCLISLTECPTFLTSIKACDKAICYGAESVTLTRGQNTVKVSGKGGHSGSTFKCCHGEDCSQSGLHAAAPHLDKVNGISEIENSKVYDDGAPQCGIKCWFVKSGEWISGIFSGNWIVLIVLCVFLLFSLVLLSILCPVRKHKES

SEQ ID NO: 1021 - protein, 1135 aa, Artificial Sequence
  derived and/or modified protein sequence (wt) from HTNV(CGHu2)__EU363819.1__GP
MGIWKWLVMASLVWPAFALRNVYDMKIECPHTVSFGENSVIGYVELPPMPLADTTQMVPESSCSMDNHQSLNTITKYTQIIWRGKADQSQSSQNSFETVSTGVDLKGTCVLKHKMIEESYRSRKSITCYDLSCNSTYCKPTLYMIVPIHACNMMKSCLIALGPYRVQVVYERTYCMTGVLIEGKCFVPDQSVVSIIKHGIFDIASVHIVCFYVAVKGNTYKIFEQVKKSFESNCNDTENKVQGYYICIIGGNSSPVYVPTLDDFRSMEAFSGIIRSPHGEDHDLAGEEVASYSIVGPANAKVPHSASSDTLGLIAYSGIPSYSSLSILTSSTEAKHVFSPGLFPQLNHTKCDKTAIPLTWTGMIDLPGYYEAIHPCTVICVLSGPGASCEALSEGGIFNITSPMCLVSKQNRFRLTEQQVNFVCQRVDVDIIVYCNGQRKVILTKTLVIGQCIYTITSLFSLLPGVAHSIAVELCVPGFHGWATAALLVTFCFGWVLIPAITFIILTILKFIANIFHTSNQENRLKSVLRKIKEEFERTKGSMVCDICKYECETYKELKAHGVSCPQSQCPYCFTHCEPTEAAFQAHYRVCQVTHRFRDDLKKTVTPQNFTPGCYRTLNLFRYKSRCYIFTMWICLLVLESILWAASASEIPLNPVWNDNAHGVGSIPMHTDLELDFSLTSSSKHTYRRKLTNPLEESQAIDLHVEIEEQTIGVDVHALGHWFDGRLNLKTSFHCYGACTKYEYPWHTAKCHYERDYQYETSWGCNPSDCPGVGTGCTACGLYLDQLKPVGSAYKIITIRYSRRVCVQFGEENLCKVIDMNDCFVSRHVKVCIIGTVSKFSQGDTLLFFGPLEGGGLIFKHWCTSTCQFGDPGDIMSPRDKGFLCPEFPGSFRKKCNFATTPVCGYDGNMVSGYKKVMATIDSFQSFNTSTMHFTDERIEWKDPDGMLRDHINILVTKDIDFDNLGENPCKIGLQTSSIEGAWGSGVGFTLTCLISLTECPTFLTSIKACDKAICYGAESVTLTRGQNTVKVSGKGGHSGSTFKCCHGEDCSQSGLHAAAPHLDKVNGISEIENSKVYDDGAPQCGIKCWFVKSGEWISGIFSGNWIVLIVLCVFLLFSLVLLSILCPVRKHKKS

SEQ ID NO: 1022 - protein, 1135 aa, Artificial Sequence
  derived and/or modified protein sequence (wt) from HTNV(CGHu3)__EU363818.1__GP
MEIWKWLVMASLVWPALALRNVHDMKIECPHTVSFGKNSVIGYVELPPMPLADTIQMVPESSCSMDNHQSLSTATKYTQVSWRGKADQAQSSQTSFETVSVEVDLKGTCVLKHKLVEESYRSRKSLTCYDLSCNSTYCKPTLYMIVPIHACNMMKSCIIALGPHRVQVVYERTYCMTGVLLEGKCFVPDQSVVSIVRHGIFDIASVHIACFFVAITGNTYKLFEQVKKSFGTTCNDTENKVQGYYICILGGNSPPIYVPTLDDFRSMEAFSGIFKSPHGEDHDLAGEEIASYSIVGPANAKVPHSASSDTLSLIAFSGIPSYSSLSILTSSTEAKHVFSPGLFPQLNHTKCDKTAIPLTWTGIIDLPGYYEAVHPCTVFCVLSGPGASCEAFSEGGIFNITSPMCLVSKQNRFRLTEQQVNFVCQRVDMDIVVYCNGQRKVILTKTLVIGQCIYTLTSLFSLLPGVAHSIAVELCVPGFHGWATAALLITFCFGWVLIPALTFIVLTVLKFIANIFHTSNQENRLKMVLKKIKEEFERTKGSMVCDICKYECETYKELKAHGVSCPQSQCPYCFTHCEPTESAFQAHYRVCQVTHRFRDDLKKTVTPQNFTPGCYRTLNLFRYKSRCYIFTMWICLLVLESILWAASASEIPLSPTWNDNAHGVGSIPMHTDLELDFSLTSSSKYTYRRKLTNPLEESQAVNFHVEIEEQAIGVDVHALGHWFDGRLNLKTSFHCYGACTKYEYPWHTAKCHYERDYQYETSWGCNPSDCPGVGTGCTACGLYLDQLKPVGSAYKIITIRYSRRVCVQFGEENLCKVIDMNDCFVSRHVKVCIIGTVSKFSQGDTLLFFGPLEGGGLIFKHWCTSTCQFGDPGDIMSPRDKGFLCPEFPGSFRKKCNFATTPVCEYDGNMVSGYKKVMATIDSFQSFNTSTMHFTDERIEWKDPDGMLRDHINILVTKDIDFDNLGENPCKVGLRTSSIEGAWGSGVGFTLTCLISLTECPTFLTSIKACDKAICYGAESVTLTRGQNTVKVSGKGGHSGSTFKCCHGEDCSQSGLHAAAPHLDKVNGISEIENSKVYDDGAPQCGIKCWFVKSGEWISGIFSGNWIVLIVLCVFLLFSLVLLSILCPVRKHKKS

SEQ ID NO: 1023 - protein, 1135 aa, Artificial Sequence
  derived and/or modified protein sequence (wt) from HTNV(CGHu3612)__EF990923.1__GP
MGIWKWLVMASLVWPAFALRNLYDMKIECPHTVSFGENSVTGYVELPPMPLADTTQMVPESSCSMDNHQSLNTITKYTQIIWRGKADQSQSSQNSFETVSTEVDLKGTCVLKHKMIEESYRSRKSITCYDLSCNSTYCKPTLYMIVPIHACNMMKSCLIALGPYRVQVVYERTYCMTGVLIEGKCFVPDQSVVSIIKHGIFDIASVHIVCFIVAVKGNTYKIFEQVKKTFESNCNDTENKVQGYYICIIGGNSSPVYVPTLDDFRSMEAFSGIIRSPHGEDHDLAGEEVASYSIVGPANAKVPHSASSDTLGLIAYSSIPSYSSLSILTSSTEAKHVFSPGLFRQLNHTKCDKTAIPLTWTGMIDLPGYYEAIHPCTVFCVLSGPGASCEAFSEGGIFNIASPMCLVSKQNRFRLTEQQVNFVCQRVDVDIIVYCNGQRKVILTKTLVIGQCIYTITSLFSLLPGVAHSIAVELCVPGFHGWATAALLVTFCFGWVLIPAITFIILTILKFIANIFHTSNQENRLKSVLRKIKEEFERTKGSMVCDICKYECETYKELKAHGVSCPQSQCPYCFTHCEPTEAAFQAHYKVCQVTHRFRDDLKKTVTPQNFTPGCYRTLNLFRYKSRCYIFTMWVFLLVLESILWAASASEIPLNPVWNDNAHGVGSIPMHTDLELDFSLTSSSKYTYRRKLTNPLEESQAIDLHVEIEEQTIGVDVHALGHWFDGRLNLKTSFHCYGACTKYEYPWHTAKCHYERDYQYETSWGCNPSDCPGVGTGCTACGLYLDQLKPVGSAYKIITIRYSRRVCVQFGEENLCKIIDMNDCFVSRHVKVCIIGTVSKFSQGDTLLFFGPLEGGGLIFKHWCTSTCQFGDPGDIMSPRDKGFLCPEFPGSFRKKCNFATTPVCEYDGNMVSGYKKVMATIDSIQSFNTSTMHFTDERIEWKDPDGMLRDHINILVTKDIDFDNLGENPCKIGLQTSSIEGAWGSGVGFTLTCLISLTECSTFLTSIKACDKAICYGAESVTLTRGQNTVKVSGKGGHSGSSFKCCHGEECSQIGLHAAAPHLDKVNGISEMENSKVFDDGAPQCGIKCWFVKSGEWISGIFSGNWIVLIVLCVFLLFSLVLLSILCPVRKHKKS

SEQ ID NO: 1024 - protein, 1135 aa, Artificial Sequence
  derived and/or modified protein sequence (wt) from HTNV(CGHu3614)__EF990922.1__GP
MGIWKWLVMASLVWPAFALRNLYDMKIECPHTVSFGENSVTGYVELPPMPLADTTQMVPESSCSMDNHQSLNTITKYTQIIWRGKADQSQSSQNSFETVSTEVDLKGTCVLKHKMIEESYRSRKSITCYDLSCNSTYCKPTLYMIVPIHACNMMKSCLIALGPYRVQVVYERTYCMTGVLIEGKCFVPDQSVVSIIKHGIFDIASVHIVCFFVAVKGNTYKIFEQVKKTFESNCNDTENKVQGYYICIIGGNSSPVYVPTLDDFRSMEAFSGIFRSPHGEDHDLAGEEVASYSIVGPANAKVPHSASSDTLGLIAYSSIPSYSSLSILTSSTEAKHVFSPGLFPQLNHTKCDKTAIPLTWTGMIDLPGYYEAIHPCTVFCVLSGPGASCEAFSEGGIFNIASPMCLVSKQNRFRLTEQQVNFVCQRVDVDIIVYCNGQRKVILTKTLVIGQCIYTITSLFSLLPGVAHSIAVELCVPGFHGWATAALLVTFCFGWVLIPAITFIILTILKFIANIFHTSNQENRLKSVLRKIKEEFERTKGSMVCDICKYECETYKELKAHGVSCPQSQCPYCFTHCEPTEAAFQAHYKVCQVTHRFRDDLKKTVTPQNFTPGCYRTLNLFRYKSRCYIFTMWVFLLVLESILWAASASEIPLNPVWNDNAHGVGSIPMHTDLELDFSLTSSSKYTYRRKLTNPLEESQAIDLHVEIEEQTIGVDVHALGHWFDGRLNLKTSFHCYGACTKYEYPWHTAKCHYERDYQYETSWGCNPSDCPGVGTGCTACGLYLDQLKPVGSAYKIITIRYSRRVCVQFGEENLCKIIDMNDCFVSRHVKVCIIGTVSKFSQGDTLLFFGPLEGGGLIFKHWCTSTCQFGDPGDIMSPRDKGFLCPEFPGSFRKKCNFATTPVCEYDGNMVSGYKKVMATIDSFQSFNTSTMHFTDERIEWKDPDGMLRDHINILVTKDIDFDNLGENPCKIGLQTSSIEGAWGSGVGFTLTCLISLTECSTFLTSIKACDKAICYGAESVTLTRGQNTVKVSGKGGHSGSSFKCCHGEECSQIGLHAAAPHLDKVNGISEMENSKVFDDGAPQCGIKCWFVKSGEWISGIFSGNWIVLIVLCVFLLFSLVLLSILCPVRKHKKS

SEQ ID NO: 1025 - protein, 1135 aa, Artificial Sequence
  derived and/or modified protein sequence (wt) from HTNV(CGRn15)__EU363814.1__GP
MEIWKWLVMASLVWPALALRNVHDMKIECPHTVSFGKNSVIGYVELPPMPLADTIQMVPESSCSMDNHQSLSTVTKYTQVSWRGKADQAQSSQTSSETVSVEVDLKGTCVLKHKLVEESYRSRKSLTCYDLSCNSTYCKPTLYMIVPIHACNMMKSCIIALGPHRVQVVYERTYCMTGVLLEGKCFVPDQSVVSIVRHGIFDIASVHIACFFVAITGNTYKLFEQVKKSFGTTCNDTENKVQGYYICILGGNSPPIYVPTLDDFRSMEAFSGIFKSPHGEDHDLAGEEIASYSIVGPANAKVPHSASSDTLSLIAFSGIPSYSSLSILTSSTEAKHVFSPGLFPQLNHTKCDKTAIPLTWTGIIDLPGYYEAVHPCTVFCVLSGPGASCEAFSEGGIFNITSPMCLVSKQNRFRLTEQQVNFVCQRVDMDIVVYCNGQRKVILTKTLVIGQCIYTITSLFSLLPGVAHSIAVELCVPGFHGWATAALLITFCFGWVLIPALTFIVLTVLKFIANIFHTSNQENRLKMVLKKIKEEFERTKGSMVCDICKYECETYKELKAHGVSCPQSQCPYCFTHCEPTESAFQAHYRVCQVTHRFRDDLKKTVTPQNFTPGCYRTLNLFRYKSRCYIFTMWICLLVLESILWAASASEIPLSPTWNDNAHGVGSIPMHTDLELDFSLTSSSKYTYRRKLTNPLEESQAVNFHVEIEEQAIGVDVHALGHWFDGRLNLKTSFHCYGACTKYEYPWHTAKCHYERDYQYETSWGSNPSDCPGVGTGCTACGLYLDQLKPVGSAYKIITIRYSRRVCVQFGEENLCKVIDMNDCFVSRHVKVCIIGTVSKFSQGDTLLFFGPLEGGGLIFKHWCTSTCQFGDPGDIMSPRDKGFLCPEFPGSFRKKCNFATTPVCEYDGNMVSGYKKVMATIDSFQSSNTSTMHFTDERIEWKDPDGMLRDHINILVTKDIDFDNLGENPCKIGLQTSSIEGAWGSGVGFTLTCLISLTECPTFLTSIKACDKAICYGAESVTLTRGQNTVKVSGKGGHSGSTFKCCHGEDCSQSGLHAAAPHLDKVNGISEIENSKVYDDGAPQCGVKCWFVKSGEWISGIFSGNWIVLIVLCVFLLFSLVLLSILCPVRKHKKS

SEQ ID NO: 1026 - protein, 1135 aa, Artificial Sequence
  derived and/or modified protein sequence (wt) from HTNV(CGRn2616)__EU363816.1__GP
MEIWKWLVMASLVWPALALRNVHDMKIECPHTVSFGKNSVIGYVELPPMPLADTIQMVPESSCSMDNHQSLSTVTKHTQVSWRGKADQAQSSQTSFETVSVEVDLKGTCVLKHKLVEESYRSRKSLTCYDLSCNSTYCKPTLYMIVPIHACNMMKSCIIALGPHRVQVVYERTYCMTGVLLEGKCFVPDQSVVSIVRHGIFDIASVHIACFFVAITGNTYKLFEQVKKSFGTTCNDTENKVQGYYICILGGNSPPIYVPTLDDFRSMEAFSGIFKSPHGEDHDLAGEEIASYSIVGPANAKVPHSASSDTLSLIAFSGIPSYSSLSILTSSTEAKHVFSPGLFPQLNHTKCDKTAIPLTWTGIIDLPGYYEAVHPCTVFCVLSGPGASCEAFSEGGIFNITSPMCLVSKQNRFRLTEQQVNFVCQRVDMDIVVYCNGQRKVILTKTLVIGQCIYTITSLFSLLPGVAHSIAVELCVPGFHGWATAALLITFCFGWVLIPALTFIVLTVLKFIANIFHTSNQENRLKMVLKKIKEEFERTKGSMVCDICKYECETNKELKAHGVSCPQSQCPYCFTHCEPTESAFQAHYRVCQVTHRFRDDLKKTVTPQNFTPGCYRTLNLFRYKSRCYIFTMWICLLVLESILWAASASEIPLSPTWNDNAHGVGSIPMHTDLELDFSLTSSSKYTYRRKLTNPLEESQAVNFHVEIEEQAIGVDVHALGHWFDGRLNLKTSFHCYGACTKYEYPWHTAKCHYERDYQYETSWGCNPSDCPGVGTGCTACGLYLDQLKPVGSAYKIITIRYSRRVCVQFGEENLCIVIDMNDCFVSRHVKVCIIGTVSKFSQGDTLLFFGPLEGGGLIFKHWCTSTCQFGDPGDIMSPRDKGFLCPEFPGSFRKKCNFATTPVCEYGGNMVSGYKKVMATIDSFQSFNTSTMHFTDERIEWKDPDGMLRDHINILVTKDIDFDNLGENPCKIGLQTSSIEGAWGSGVGFTLTCLISLTECPTFLTSIKACDKAICYGAESVTLTRGQNTVKVSGKGGHSGSTFKCCHGEDCSQSGLHAAAPHLDKVNGISEIENSKVYDDGAPQCGIKCWFVKSGEWISGIFSGNWIVLIVLCVFLLFSLVLLSILCPVRKHKKS

SEQ ID NO: 1027 - protein, 1135 aa, Artificial Sequence
  derived and/or modified protein sequence (wt) from HTNV(CGRn2618)__EU363817.1__GP
MEIWKWLVMASLVWPALALRNVHDMKIECPHTVSFGKNSVIGYVELPPMPLADTIQMVPESSCSMDNHQSLSTVTKYTQVSWRGKADQAQSSQTPFETVSVEVDLKRTCVLKHKLVEESYRSRKSLTCYDLSCNSTYCKPTLYMIVPIHACNMMKSCIIALGPHRVQVVYERTYCMTGVLLEGKCFVPDQSVVSIVRHGIFDIASVHIACFFVAITGNTYKLFEQVKKSFGTTCNDTENKVQGYYICILGGNSPPIYVPTLDDFRSMEAFSGIFKSPHGEDHDLAGEEIASYSIVGPANAKVPHSASSDTLSLIAFSGIPSYSSLSILTSSTEAKHVFSPGLFPQLNHTKCDKTAIPLTWTGIIDLPGYYEAVHPCTVFCVLSGPGASCEAFSEGGIFNITSPMCLVSKQNRFRLTEQQVNFVCQRVDMDIVVYCNGQRKVILTKTLVIGQCIYTITSLFSLLPGVAHSIAVELCVPGFHGWATAALLITFCFGWVLIPALTFIVLTVLKFIANIFHTSNQENRLKMVLKKIKEEFERTKGSMVCDICKYECETYKELKAHGVSCPQSQCPYCFTHCEPTESAFQAHYRVCQVTHRFRDDLKKTVTPQNFTPGCYRTLNLFRYKSRCYILTMWNLLLIPGYRLWAASASEIPLSPTWNDNAHGVGSIPMHTDLELDFSLTSSSKYTYRRKLTNPLEESQAVNFHVEIEEQAIGVDVHALGHWFDGRLNLKTSFHCYGACTKYEYPWHTAKCHYERDYQYETSWGCNPSDCPGVGTGCTACGLYLDQLKPVGSAYKIITIRYSRRVCVQFGEENLCIVIDMNDCFVSRHVKVCIIGTVSKFSQGDTLLFFGPLEGGGLIFKHWCTSTCQFGDPGDIMSPRDKGFLCPEFPGSFRKKCNFATTPVCEYGGNMVSGYKKVMATIDSFQSFNTSTMHFTDERIEWKDPDGMLRDHINILVTKDIDFDNLGENPCKIGLQTSSIEGAWGSGVGFTLTCLISLTECPTFLTSIKACDKAICYGAESVTLTRGQNTVKVSGKGGHSGSTFKCCHGEDCSQSGLHAAAPHLDKVNGISEIENSKVYDDGAPQCGIKCWFVKSGEWISGIFSGNWIVLIVLCVFLLFSLVLLSILCPVRKHKKS

SEQ ID NO: 1028 - protein, 1135 aa, Artificial Sequence
  derived and/or modified protein sequence (wt) from HTNV(CGRn45)__EU092225.1__GP
MEIWKWLVMASLVWPALALRNVHDMKIECPHTVSFGKNSVIGYVELPPMPLADTIQMVPESSCSMDNHQSLSTVTKYTQVSWRGKADQAQSSQTSFEAVSVEVDLKGTCVLKHKLVEESYRSRKSLTCYDLSCNSTYCKPTLYMIVPIHACNMMKSCIIALGPHRVQVVYERTYCMTGVLLEGKCFVPDQSVVSIVRHGIFDIASVHIACFFVAITGNTYKLFEQVKKSFGTTCNDTENKVQGYYICILGGNSPPIYVPTLDDFRSMEAFSGIFKSPHGEDHDLAGEEIASYSIVGPANAKVPHSASSDTLSLIAFSGIPSYSSLSILTSSTEAKHVFSPGLFPQLNHTKCDKTAIPLTWTGIIDLPGYYEAVHPCTVFCVLSGPGASCEAFSEGGIFNITSPMCLVSKQNRFRLTEQQVNFVCQRVDMDIVVYCNGQRKVILTKTLVIGQCIYTITSLFSLLPGVAHSIAVELCVPGFHGWATAALLITFCFGWVLIPALTFIVLTVLKFIANIFHTSNQENRLKMVLKKIKEEFERTKGSMVCDICKYECETYKELKAHGVSCPQSQCPYCFTHCEPTESAFQAHYRVCQVTHRFRDDLKKTVTPQNFTPGCYRTLNLFRYKSRCYIFTMWICLLVLESILWAASASEIPLSPTWNDNAHGVGSIPMHTDLELDFSLTSSSKYTYRRKLTNPLEESQAVNFHVEIEEQAIGVDVHALGHWFDGRLNLKTSFHCYGACTKYEYPWHTAKCHYERDHQYETSWGCNPSDCPGVGTGCTACGLYLDQLKPVGSAYKIITIRYSRRVCVQFGEENLCKVIDRNDCFVSRHVKVCIIGTVSKFSQGDTLLFFGPLEGGGLIFKHWCTSTCQFGDPGDIMSPRDKGFLCPEFPGSFRKKCNFATTPVCEYDGNMVSGYKKVMATIDSFQSFNTSTMHFTDERIEWKDPDGMLRDHINILVTKDIDFDNLGENPCKIGLQTSSIEGAWGSGVGFTLTCLISLTECPTFLTSIKACDKAICYGAESVTLTRGQNTVKVSGKGGHSGSTFKCCHGEDCSQSGLHAAAPHLDKVNGISEIENSKVYDDGAPQCGIKCWFVKSGEWISGIFSGNWIVLIVLCVFLLFSLVLLSILCPVRKHKKS

SEQ ID NO: 1029 - protein, 1135 aa, Artificial Sequence
  derived and/or modified protein sequence (wt) from HTNV(CGRn53)__EF990921.1__GP
MGIWKWLVMASLVWPAYTLRNVYDMKIECPHTVSFGENSVIGYVELPPIPLADTTQMVPESSCSMDNHQSLNTITKYTQVSWRGKAGQAQASQNSFEAVSAEVDLKGTCVLKHKMLEESYRSRKSIACYDLSCNSTYCKPTLYMIVPIHACNMMKSCLIALGPHRVQVVYERTYCMTGVLIEGKCFVPDQSVVSIIKHGIFDIASVHIVCFFVAVKGNTYKIFEQIKKSFESTCNDTKNKVQGYYICIVGGNSAPIYVPTLDDFRSMEAFSGIFRSPHGEDHDLAGEEIASYSIVGPANAKVPHSASSDTLSLTAYSGIPSYSSLSILAGSAEAKHVFSPGFFPQLNHTKCDKTAIPLMWTGMIDLPGYYEAIHPCTVFCVLSGPGASCEAFSEGGIFNITSPMCLVSKQNRFRLTEQQVNFVCQRVDMDIIVYCNGQRKVILTKTLVIGQCIYTITSLFSLLPGVAHSIAVELCVPGFHGWATAALLVTFCFGWVLIPAMTFIVLTILKFIANIFHTSNQENKLKSVLRKIKEEFEKTKGSMVCDVCKYECETYKELKAHGVSCPQSQCPYCFTHCEPTEAAFQAHYRVCQVTHRFRDDLKKTVTPQNFTPGCYRTLNLFRYKSRCYILTMWNLLLVPGYRAWAASASEIPLNPVWNDNAHGVGSVPMHTDLELDFSLTSSSKYTYRRKLTNPLEESQAINLHIEIEEQTIGVDVHALGHWFVGRLNLKTSFHCYGACTKYEYPWHTAKCHYERDYQYETSWGCNPSDCPGVGTGCTACGLYLDQLKPVGSAYKIITIRYSRRVCVQFGEENLCKIIDMNDCFVSRHVKVCIIGTVSKFSQGDTLLFFGPLEGGGLIFKHWCTSTCQFGDPGDIMSPRDKGFLCPEFPGSFRKKCNFATTPLCEYDGNMVSGYKKVMATIDSFQSFNTSTMHFTDERIEWKDPDGMLRDHINILVTKDIDFENLGENPCKIGLQTSSIEGAWGSGVGFTLTCLVSLTECPTFLTSIKACDKAICYGAESVTLTRGQNTVKVSGKGGHSGSTFKCCHGEECSQIGLHAAAPHLDKVNGISEIENNKVYDDGAPQCGIKCWFVKSGEWISGIFSGNWIVLIVLCVFLLFSLILLSILCPVRKHKKS

SEQ ID NO: 1030 - protein, 1135 aa, Artificial Sequence
  derived and/or modified protein sequence (wt) from HTNV(CGRn93MP8)__EF990919.1__GP
MGIWKWLVKASLVWPAYTLRNVYDMKIECPHTVSFGENSVIGYVELPPIPLADTTHMVPESSCSMDNHQSLNTITKYTQVSWRGKADQAQASQNSFEAVSAEVDLKGTCVLKHKMLEESYRSRKSIACYDLSCNSTYCKPTLYMIVPIHACNMMKSCLIALGPHRVQVVYERTYCMTGFLIEGKCFVPDRSVVSIIKHGIFDIASVHIVCFFVAVKGNTYKIFEQIKKSFESTCNDTKNKVQGYYICIVGGNSAPIYVPTLDDFRSMEAFSGIFRSPHGEDHDLAGEEIASYSIVGPANAKVPHSASSDTLSLTAYSGIPSYSSLSILAGSAEAKHVFSPGFLPQLNHTKCDKTAIPLMWTGMIDLPGYYEAIHPCTVFCVLSGPGASCEAFSEGGIFNITSPMCLVSKQNRFRLTEQQVNFVCQRVDMDIIVYCNGQRKVILTKTLVIGQCIYTITSLFSLLPGVAHSIAVELCVPGFHGWATAALLVTFCFGWVLIPAMTFIVLTILKFIANIFHTSNQENKLKSVLRKIKEEFEKTKGSMVCDVCKYECETYKELKAHGVSCPQSQCPYCFTHCEPTEAAFQAHYRVCQVTHRFRDDLKKTVTPQNFTPGCYRTLNLFRYKSRCYIFTMWVFLLVLESILWAASASEIPLNPVWNDNAHGVGSVPMHTDLELDFSLTSSSKYTYRRKLTNPLEESQAINLHIEIEEQTIGVDVHALGHWFDGRLNLKTSFHCYGACTKYEYPWHTAKCHYERDYQYETSWGCNPSDCPGVGTGCTACGLYLDQLKPVGSAYKIITIRYSRRVCVQFGEENLCKIIDMNDCFVSRHVKVCIIGTVSKFSQGDTLLFFGPLEGGGLIFKHWCTSTCQFGDPGDIMSPRDKGFLCPEFPGSFRKKCNFATTPLCEYDGNMVSGYKKVMATIDSFQSFNTSTMHFTDERIEWKDPDGMLRDHINILVTKDIDFENLGENPCKIGLQTSSIEGAWGSGVGFTLTCLVSLTECPTFLTSIKACDKAICYGAESVTLTRGQNTVKVSGKGGHSGSTFKCCHGEECSQIGLHAAAPHLDKVNGISEIENNKVYDDGAPQCGIKCWFVKSGEWISGIFSGNWIVLIVLCVFLLFSLILLSILCPVRKHEKS

SEQ ID NO: 1031 - protein, 1135 aa, Artificial Sequence
  derived and/or modified protein sequence (wt) from HTNV(CGRn93P8)__EF990918.1__GP
MGIWKWLVMASLVWPAYTLRNVYDMKIECPHTVSFGENSVIGYVELPPIPLADTTQMVPESSCSMDNHQSLNTITKYTQVSWRGKADQAQASQNSFEAVSAEVDLKGTCVLKHKMLEESYRSRKSIACYDLSCNSTYCKPTLYMIVPIHACNMMKSCLIALGPHRVQVVYERTYCMTGVLIEGKCFVPDRSVVSIIKHGIFDIASVHIVCFFVAVKGNNYKIFEQIKKSFESTCNDTKNKVQGYYICIVGGNSAPIYVPTLDDFRSMEAFSGIFRSPHGEDHDLAGEEIASYSIVGPANAKVPHSASSDTLSLTAYSGIPSYSSLSILAGSAEAKHVFSPGFFPQLNHTKCDKTAIPLMWTGMIDLPGYYEAIHPCTVFCVLSGPGASCEAFSEGGIFNITSPMCLVSKQNRFRLTEQQVNFVCQRVDMDIIVYCNGQRKVILTKTLVIGQCIYTITSLFSLLPGVAHSIAVELCVPGFHGWATAALLVTFCFGWVLIPAMTFIVLTILKFIANIFHTSNQENKLKSVLRKIKEEFEKTKGSMVCDVCKYECETYKELKAHGVSCPQSQCPYCFTHCEPTEAAFQAHYRVCQVTHRFRDDLKKTVTPQNFTPVCYRTLNLFRYKSRCYIFTMWVFLLVLESILWAASASEIPLNPVWNDNAHGVGSVPMHTDLELDFSLTSSSKYTYRRKLTNPLEESQAINLHIEIEEQTIGVDVHALGHWFDGRLNLKTSFHCYGACTKYEYPWHTAKCHYERDYQYETSWGCNPSDCPGVGTGCTICGLYLDQLKPVGSAYKIITIRYSRRVCVQFGEENLCKVIDMNDCFVSRHVKVCIIGTVSKFSQGDTLLFFGPLEGGGLIFKHWCTSTCQFGDPGDIMSPRDKGFLCPEFPGSFRKKCNFATTPVCEYDGNMVSGYKKVMATIDSFQSFNTSTMHFTDERIEWKDPDGMLRDHINILVTKDIDFDNLGENPCKIGLQTSSIEGAWGSGVGFTLTCLISLTECPTFLTSIKACDKAICYGAESVTLTRGQNTVKVSGKGGHSGSTFKCCHGEDCSQSGLHAAAPHLDKVNGISEIENSKVYDDGAPQCGIKCWFVKSGEWISGIFSGNWIVLIVLCVFLLFSLVLLSILCPVRKHKKS

SEQ ID NO: 1032 - protein, 1135 aa, Artificial Sequence
  derived and/or modified protein sequence (wt) from HTNV(CGRni1)__EU363815.1__GP
MGIWKWLVMASLVWPAFALRNLYDMKIECPHTVSFGENSVTGYVELPPMPLADTTQMVPESSCSMDNHQSLNTITKYTQIIWRGKADQSQSSQNSFETVSTEVDLKGTCVLKHKMIEESYRSRKSITCYDLSCNSTYCKPTLYMIVPIHACNMMKSCLIALGPYRVQVVYERTYCMTGVLIEGKCFVPDQSVVSIIKHGIFDIASVHIVCFYVAVKGNTYKIFEQVKKTFESNCNDTENKVQGYYICIIGGNSSPVYVPTLDDFRSMEAFSGIIRSPHGEDHDLAGEEVASYSIVGPANAKVPHSASSDTLGLIAYSSIPSYSSLSILTSSTEAKHVFSPGLFPQLNHTKCDKTAIPLTWTGMIDLPGYYEAIHPCTVFCVLSGPGASCEAFSEGGIFNIASPMCLVSKQNRFRLTEQQVNFVCQRVDVDIIVYCNGQRKVILTKTLVIGQCIYTITSLFSLLPGVAHSIAVELCVPGFHGWATAALLVTFCFGWVLIPAITFIILTILKFIANIFHTSNQENRLKSVLRKIKEEFERTMGSMVCDICKYECETYKELKAHGVSCPQSQCPYCFTHCEPTEAAFQAHYKVCQVTHRFRDDLKKTVTRQNFTPGCYRTLNLFRYKSRCYIFTMWVFLIVLESILWAASASEIPLNPVWNDNAHGVGSIPMHTDLELDFSLTSSSKYTYRRKLTNPLEESQAIDLHVEIEEQTIGVDVHALGHWFDGRLNLKTSFHCYGACTKYEYPWHTAKCHYERDYQYETSWGCNPSDCPGVGTGCTACGLYLDQLKPVGSAYKIITIRYSRRVCVQFGEENLCKIIDMNDCFVSRHVKVCIIGTVSKFSQGDTLLFFGPLEGGGLIFKHWCTSTCQFGDPGDIMSPRDKGFLCPEFPGSFRKKCNFATTPVCEYDGNMVSGYKKVMATIDSFQSFNTSTMHFTDERIEWKDPDGMLRDHINILVTKDIDFDNLGENPCKIGLQTSSIEGAWGSGVGFTLTCLISLTECSTFLTSIKACDKAICYGAESVTLTRGQNTVKVSGKGGHSGSSFKCCHGEECSQIGLHAAAPHLDKVNGISEMENSKVFDDGAPQCGIKCWFVKSGEWISGIFSGNWIVLIVLCVFLLFSLVLLSILCPVRKHKKS

SEQ ID NO: 1033 - protein, 1135 aa, Artificial Sequence
  derived and/or modified protein sequence (wt) from HTNV(Aa10-434)__KU207160.1__GP
MGIWKWLVMASLVWPVLTLRNVYDMKIECPHTVSFGGNSVIGYVELPPMPLADTAQLVPESSCSMDNHQSLNTITKYTQVSWRGKADQSQSSQISFETVSTEVDLKGTCVLKHKMVEESYRSRKSITCYDLSCNSTYCKPTLYMIVPIHACNMMKSCLIALGPYRVQVVYERTYCMTGVLIEGKCFVPDQSVVSIIKHGIFDIASVHIVCFFVAVKGNTYKIFEQVKKSFESTCNDTENKVQGYYICIVGGNSAPIYVPTLDDFRSMEAFTGIFRSPHGEDHDLAGEETATYSIVGPANAKVPHSASSDTLSLIAFSGIPSYSSLSILTSSTEAKHVFSPGLFPKLNHTNCDKGAIPLMWTGMIDLPGYYEAIHPCTVFCVLSGPGASCEAFSEGGIFNITSPMCLVSKQNRFRLTEQQVNFVCQRVDVDIVVYCNGQRKVILTKTLVIGQCIYTITSLFSLLPGVAHSIAVELCVPGFHGWATAALLVTFCFGWVLIPAITFIILTILKFIANIFHTSNQENRLKSVLRKIKEEFEKTKGSMVCDICKYECETYKELKAHGVSCPQSQCPYCFTHCEPTEAAFQAHYKVCQVTHRFRDDLKKTVTPQNFTPGCYRTLNLFRYKSRCYIFTMWIFLLVLESILWAASASETPLTPVWNDNAHGVGSVPMHTDLELDFSLTSSSKYTYRRKLTNPLEEAQSIDLHIEIEEQTIGVDVHALGHWFDGRLNLKTSFHCYGACTKYEYPWHTAKCHYERDYQYETSWGCNPSDCPGVGTGCTACGLYLDRLKPVGSAYKIITIRYSRRVCVQFGEENLCKIIDMNDCFVSRHVKVCIIGTISKFSQGDTLLFFGPLEGGGLIFKHWCTSTCQFGDPGDIMSPRDKGFLCPEFPGSFRKKCNFATTPICEYDGNMVSGYKKVMATIDSFQSFNTSTMHFTDERIEWKDPDGMLRDHINILVTKDIDFDNLGENPCKIGLQASSIEGAWGSGVGFTLTCLVSLTECPTFLTSIKACDKAICYGAESVTLTRGQNTVKVSGKGGHSGSTFKCCHGEDCSQIGLHAAAPHLDKVNGISEMENSKVYDDGAPQCGIKCWFVKSGEWISGIFSGNWIVLIVLCVFLLFSLVLLSILCPVRKHKKS

SEQ ID NO: 1034 - protein, 1135 aa, Artificial Sequence
  derived and/or modified protein sequence (wt) from HTNV(Aa10-518)__KU207161.1__GP
MGIWKWLVMASLVWPVLTLRNVYDMKIECPHTVSFGENSVIGYVELPPMPLADTAQLVPESSCSMDNHQSLNTITKYTQVSWRGKADQSQSSQNSFETVSTEVDLKGTCVLKHKMVEESYRSRKSITCYDLSCNSTYCKPTLYMIVPIHACNMMKSCLIALGPYRVQVVYERTYCMTGVLIEGKCFVPDQSVVSIIKHGIFDIASVHIVCFFVAVKGNTYKIFEQVKKSFESTCNDTKNKVQGYYICIVGGNSAPIYVPTLDDFRSMEAFTGIFRSPHGEDHDLAGEETATYSIVGPANAKVPHSASSDTLSLIAFSGIPSYSSLSILTSSTEAKHVFSPGLFPKLNHTNCDKGAIPLMWTGMIDLPGYYEAIHPCTVFCVLSGPGASCEAFSEGGIFNITSPMCLVSKQNRFRLTEQQVNFVCQRVDVDIVVYCNGQRKVILTKTLVIGQCIYTITSLFSLLPGVAHSIAVELCVPGFHGWATAALLVTFCFGWVLIPAITFIILTILKFIANIFHTSNQENRLKSVLRKIKEEFEKTKGSMVCDICKYECETYKELKAHGVSCPQSQCPYCFTHCEPTEAAFQAHYKVCQVTHRFRDDLKKTVTPQNFTPGCYRTLNLFRYKSRCYIFTMWIFLLVLESILWAASASETPLTPVWNDNAHGVGSVPMHTDLELDFSLTSSSKYTYRRKLTNPLEEAQSIDLHIEIEEQTIGVDVHALGHWFDGRLNLKTSFHCYGACTKYEYPWHTAKCHYERDYQYETSWGCNPSDCPGVGTGCTACGLYLDRLKPVGSAYKIITIRYSRRVCVQFGEENLCKIVDMNDCFVSRHVKVCIIGTVSKFSQGDTLLFFGPLEGGGLIFKHWCTSTCQFGDPGDIMSPRDKGFLCPEFPGSFRKKCNFATTPICEYDGNMVSGYKKVMATIDSFQSFNTSTMHFTDERIEWKDPDGMLRDHINILVTKDIDFDNLGENPCKIGLQTSSIEGAWGSGVGFTLTCLVSLTECPTFLTSIKACDKAICYGAESVTLTRGQNTVKVSGKGGHSGSTFKCCHGEDCSQIGLHAAAPHLDKVNGISEMENSKVYDDGAPQCGIKCWFVKSGEWISGIFSGNWIVLIVLCVFLLFSLVLLSILCPVRKHKKS

SEQ ID NO: 1035 - protein, 1135 aa, Artificial Sequence
  derived and/or modified protein sequence (wt) from HTNV(Aa13_3)__KX687227.1__GP
MGIWKWLVMASLVWPVLTLRNVYDMKIECPHTVSFGENSVIGYVELPPMPLVDTVQLVPESSCSMDNHQSLNTITKYTQVSWRGKADQSQSSQNSFETVSTEVDLKGTCVLKHKMVEESYRSRKSITCYDLSCNSTYCKPTLYMIVPIHACNMMKSCLIALGPYRVQVVYERTYCMTGVLIEGKCFVPDQSVVSIIKHGIFDIASVHIVCFFVAVKGNTYKIFEQVKKSFESTCNDTENKVQGYYICIVGGNSAPIYVPTLDDFRSMEAFTGIFRSPHGEDHDLAGEETATYSIVGPANAKVPHSASSDTLSLIAFSGIPSYSSLSILTSSTEAKHVFSPGLFPKLNHTNCDKGAIPLMWTGMIDLPGYYEAIHPCTVFCVLSGPGASCEAFSEGGIFNITSPMCLVSKQNRFRLTEQQVNFVCQRVDVDIVVYCNGQRKVILTKTLVIGQCIYTITSLFSLLPGVAHSIAVELCVPGFHGWATAALLVTFCFGWVLIPAITFIILTILKFIANIFHTSNQENRLKSVLRKIKEEFEKTKGSMVCDICKYECETYKELKAHGVSCPQSQCPYCFTHCEPTEAAFQAHYKVCQVTHRFRDDLKKTVTPQNFTPGCYRTLNLFRYKSRCYIFTMWIFLLVLESILWAASASETPLTPVWNDNAHGVGSVPMHTDLELDFSLTSSSKYTYRRKLTNPLEEAQSIDLHIEIEEQTIGVDVHALGHWFDGRLNLKTSFHCYGACTKYEYPWHTAKCHYERDYQYETSWGCNPSDCPGVGTGCTACGLYLDRLKPVGSAYKIITIRYSRRVCVQFGEENLCKIIDMNDCFVSRHVKVCIIGTVSKFSQGDTLLFFGPLEGGGLIFKHWCTSTCQFGDPGDIMSPRDKGFLCPEFPGSFRKKCNFATTPICEYDGNMVSGYKKVMATIDSFQSFNTSTMHFTDERIEWKDPDGMLRDHINILVTKDIDFDNLGENPCKIGLQTSSIEGAWGSGVGFTLTCLVSLTECPTFLTSIKACDKAICYGAESVTLTRGQNTVKVSGKGGHSGSTFKCCHGEDCSQIGLHAAAPHLDKVNGISEMENSKVYDDGAPQCGIKCWFVKSGEWISGIFSGNWIVLIVLCVFLLFSLVLLSILCPVRKHKKS

SEQ ID NO: 1036 - protein, 1135 aa, Artificial Sequence
  derived and/or modified protein sequence (wt) from HTNV(Aa14_186)__KX687228.1__GP
MGIWKWLVMASLVWPVLTLRNVYDMKIECPHTVSFGENSVIGYVELPPMPLADTAQLVPESSCSMDNHQSLNTITKYTQVSWRGKADQSQSSQNSFETVSTEVDLKGTCVLKHKMIEESYRSRKSITCYDLSCNNTYCKPTLYMIVPIHACNMMKSCLIALGPYRVQVVYERTYCMTGVLIEGKCFVPDQSVVSIIKHGIFDIASVHIVCFFVAVKGNTYKIFEQVKKSFESTCNDTENKVQGYYICIVGGNSAPIYVPTLDDFRSMEAFTGIFRSPHGEDHDLAGEETATYSIVGPANAKVPHSASSDTLSLIAFSGIPSYSSLSILTSSTEAKHVFSPGLFPKLNHTNCDKGAIPLMWTGMIDLPGYYEAIHPCTVFCVLSGPGASCEAFSEGGIFNITSPMCLVSKQNRFRLTEQQVNFVCQRVDVDIVVYCNGQRKVILTKTLVIGQCIYTITSLFSLLPGVAHSIAVELCVPGFHGWATAALLVTFCFGWVLIPAITFIILTILKFIANIFHTSNQENRLKSVLRKIKEEFEKTKGSMVCDICKYECETYKELKAHGVSCPQSQCPYCFTHCEPTEAAFQAHYKVCQVTHRFRDDLKKTVTPQNFTPGCYRTLNLFRYKSRCYIFTMWIFLLVLESILWAASASETPLTPVWNDNAHGVGSVPMHTDLELDFSLTSSSKYTYRRKLTNPLEEAQSIDLHIEIEEQTIGVDVHALGHWFDGRLNLKTSFHCYGACTKYEYPWHTAKCHYERDYQYETSWGCNPSDCPGVGTGCTACGLYLDRLKPVGSAYKIITIRYSRRVCVQFGEENLCKIIDMNDCFVSRHVKVCIIGTVSKFSQGDTLLFFGPLEGGGLIFKHWCTSTCQFGDPGDIMSPRDKGFLCPEFPGSFRKKCNFATTPICEYDGNMVSGYKKVMATIDSFQSFNTSTMHFTDERIEWKDPDGMLRDHINILVTKDIDFDNLGENPCKIGLQTSSIEGAWGSGVGFTLTCLVSLTECPTFLTSIKACDKAICYGAESVTLTRGQNTVKVSGKGGHSGSTFKCCHGEDCSQIGLHAAAPHLDKVNGISEVENSKVYDDGAPQCGIKCWFVKSGEWISGIFSGNWIVLIVLCVFLLFSLVLLSILCPVRKHKKS

SEQ ID NO: 1037 - protein, 1135 aa, Artificial Sequence
  derived and/or modified protein sequence (wt) from HTNV(Aa14_234)__KX687230.1__GP
MGIWKWLVMASLVWPVLTLRNVYDMKIECPHTVSFGENSVIGYVELPPMPLADTAQLVPESSCSMDNHQSLNTITKYTQVSWRGKADQSQSSQTSFETVSTEVDLKGTCVLKHKMVEESYRSRKSITCYDLSCNSTYCKPTLYMIVPIHACNMMKSCLIALGPYRVQVVYERTYCMTGVLIEGKCFVPDQSVVSIIKHGIFDIASVHIVCFFVAVKGNTYKIFEQVKKSFESTCNDTENKVQGYYICIVGGNSAPIYVPTLDDFRSMEAFTGIFRSPHGEDHDLAGEETATYSIVGPANAKVPHSASSDTLSLIAFSGIPSYSSLSILTSSTEAKHVFSPGLFPKLNHTSCDKGAIPLMWTGMIDLPGYYEAIHPCTVFCVLSGPGASCEAFSEGGIFNITSPMCLVSKQNRFRLTEQQVNFVCQRVDVDIVVYCNGQRKVILTKTLVIGQCIYTITSLFSLLPGVAHSIAVELCVPGFHGWATAALLVTFCFGWVLIPAITFIILTVLKFIANIFHTSNQENRLKSVLRKIKEEFEKTKGSMVCDICKYECETYKELKAHGVSCPQSQCPYCFTHCEPTEAAFQAHYKVCQVTHRFRDDLKKTVTPQNFTPGCYRTLNLFRYKSRCYIFTMWIFLLVLESILWAASASETPLTPVWNDNAHGVGSVPMHTDLELDFSLTSSSKYTYRRKLTNPLEEAQSIDLHIEIDEQTIGVDVHALGHWFDGRLNLKTSFHCYGACTKYEYPWHTAKCHYERDYQYETSWGCNPSDCPGVGTGCTACGLYLDRLKPVGSAYKIITIRYSRRVCVQFGEENLCKIIDMNDCFVSRHVKVCIIGTVSKFSQGDTLLFFGPLEGGGLIFKHWCTSTCQFGDPGDIMSPRDKGFLCPEFPGSFRKKCNFATTPICEYDGNMVSGYKKVMATIDSFQSFNTSTMHFTDERIEWKDPDGMLRDHINILVTKDIDFDNLGENPCKIGLQTSSIEGAWGSGVGFTLTCLVSLTECPTFLTSIKACDKAICYGAESVTLTRGQNTVKVSGKGGHSGSTFKCCHGEDCSQIGLHAAAPHLDKVNGISEMENSKVYDDGAPQCGIKCWFVKSGEWISGIFSGNWIVLIVLCVFLLFSLVLLSILCPVRKHKKS

SEQ ID NO: 1038 - protein, 1135 aa, Artificial Sequence
  derived and/or modified protein sequence (wt) from HTNV(Aa14_239)__KX687231.1__GP
MGIWKWLVMASLVWPVLTLRNVYDMKIECPHTVSFGENSVIGYVELPPMPLADTAQLVPESSCSMDNHQSLNTITKYTQVSWRGKADQSQSSQNSFETVSTEVDLKGTCVLKHKMVEESYRSRKSITCYDLSCNSTYCKPTLYMIVPIHACNMMKSCLIALGPYRVQVVYERTYCMTGVLIEGKCFVPDQSVVSIIKHGIFDIASVHIVCFFVAVKGNTYKIFEQVKKSFESTCNDTENKVQGYYICIVGGNSAPIYVPTLDDFRSMEAFTGIFRSPHGEDHDLAGEETATYSIVGPANAKVPHSASSDTLSLIAFSGIPSYSSLSILTSSTEAKHVFSPGLFPKLNHTNCDKGAIPLMWTGMIDLPGYYEAIHPCTVFCVLSGPGASCEAFSEGGIFNITSPMCLVSKQNRFRLTEQQVNFVCQRVDVDIVVYCNGQRKVILTKTLVIGQCIYTITSLFSLLPGVAHSIAVELCVPGFHGWATAALLVTFCFGWVLIPAITFIILTVLKFIANIFHTSNQENRLKSVLRKIKEEFEKTKGSMVCDICKYECETYKELKAHGVSCPQSQCPYCFTHCEPTEAAFQAHYKVCQVTHRFRDDLKKTVTPQNFTPGCYRTLNLFRYKSRCYIFTMWIFLLVLESILWAASASETPLTPVWNDNAHGVGSVPMHTDLELDFSLTSSSKYTYRRKLTNPLEEAQSIDLHIEIDEQTIGVDVHALGHWFDGRLNLKTSFHCYGACTKYEYPWHTAKCHYERDYQYETSWGCNPSDCPGVGTGCTACGLYLDRLKPVGSAYKIITIRYSRRVCVQFGEENLCKIIDMNDCFVSRHVKVCIIGTVSKFSQGDTLLFFGPLEGGGLIFKHWCTSTCQFGDPGDIMSPRDKGFLCPEFPGSFRKKCNFATTPICEYDGNMVSGYKKVMATIDSFQSFNTSTMHFTDERIEWKDPDGMLRDHINILVTKDIDFDNLGENPCKIGLQTSSIEGAWGSGVGFTLTCLVSLTECPTFLTSIKACDKAICYGAESVTLTRGQNTVKVSGKGGHSGSTFKCCHGEDCSQIGLHAAAPHLDKVNGISEMENSKVYDDGAPQCGIKCWFVKSGEWISGIFSGNWIVLIVLCVFLLFSLVLLSILCPVRKHKKS

SEQ ID NO: 1039 - protein, 1135 aa, Artificial Sequence
  derived and/or modified protein sequence (wt) from HTNV(Aa14-172)__KU207162.1__GP
MGIWKWLVMASLVWPVLTLRNVYDMKIECPHTVSFGENSVIGYVELPPMPLTDTAQLVPESSCSMDNHQSLNTITKYTQVSWRGKADQSQSSQNSFETVSTEVDLKGTCVLKHKMIEESYRSRKSITCYDLSCNNTYCKPTLYMIVPIHACNMMKSCLIALGPYRVQVVYERTYCMTGVLIEGKCFVPDQSVVSIIKHGIFDIASVHIVCFFVAVKGNTYKIFEQVKKSFESTCNDTENKVQGYYICIVGGNSAPIYVPTLDDFRSMEAFTGIFRSPHGEDHDLAGEETATYSIVGPANAKVPHSASSDTLSLIAFSGIPSYSSLSILTSSTEAKHVFSPGLFPKLNHTNCDKGAIPLMWTGMIDLPGYYEAIHPCTVFCVLSGPGASCEAFSEGGIFNITSPMCLVSKQNRFRLTEQQVNFVCQRVDVDIVVYCNGQRKVILTKTLVIGQCIYTITSLFSLLPGVAHSIAVELCVPGFHGWATAALLVTFCFGWVLIPAITFIILTILKFIANIFHTSNQENRLKSVLRKIKEEFEKTKGSMVCDICKYECETYKELKAHGVSCPQSQCPYCFTHCEPTEAAFQAHYKVCQVTHRFRDDLKKTVTPQNFTPGCYRTLNLFRYKSRCYIFTMWIFLLVLESILWAASASETPLTPVWNDNAHGVGSVPMHTDLELDFSLTSSSKYTYRRKLTNPLEEAQSIDLHIEIEEQTIGVDVHALGHWFDGRLNLKTSFHCYGACTKYEYPWHTAKCHYERDYQYETSWGCNPSDCPGVGTGCTACGLYLDRLKPVGSAYKIITIRYSRRVCVQFGEENLCKIIDMNDCFVSRHVKVCIIGTVSKFSQGDTLLFFGPLEGGGLIFKHWCTSTCQFGDPGDIMSPRDKGFLCPEFPGSFRKKCNFATTPICEYDGNMVSGYKKVMATIDSFQSFNTSTMHFTDERIEWKDPDGMLRDHINILVTKDIDFDNLGENPCKIGLQTSSIEGAWGSGVGFTLTCLVSLTECPTFLTSIKACDKAICYGAESVTLTRGQNTVKVSGKGGHSGSTFKCCHGEDCSQIGLHAAAPHLDKVNGISEVENSKVYDDGAPQCGIKCWFVKSGEWISGIFSGNWIVLIVLCVFLLFSLVLLSILCPVRKHKKS

SEQ ID NO: 1040 - protein, 1135 aa, Artificial Sequence
  derived and/or modified protein sequence (wt) from HTNV(Aa14-175)__KU207163.1__GP
MGIWKWLVMASLVWPVLTLRNVYDMKIECPHTVSFGENSVIGYVELPPMPLADTAQLVPESSCSMDNHQSLNTITKYTQVSWRGKADQSQSSQNSFETVSTEVDLKGTCVLKHKMVEESYRSRKSITCYDLSCNSTYCKPTLYMIVPIHACNMMKSCLIALGPYRVQVVYERTYCMTGVLIEGKCFVPDQSVVSIIKHGIFDIASVHIVCFFVAVKGNTYKIFEQVKKSFESTCNDTENKVQGYYICIVGGNSAPIYVPTLDDFRSMEAFTGIFRSPHGEDHDLAGEETATYSIVGPANAKVPHSASSDTLSLIAFSGIPSYSSLSILTSSTEAKHVFSPGLFPKLNHTNCDKGAIPLMWTGMIDLPGYYEAIHPCTVFCVLSGPGASCEAFSEGGIFNITSPMCLVSKQNRFRLTEQQVNFVCQRVDVDIVVYCNGQRKVILTKTLVIGQCIYTITSLFSLLPGVAHSIAVELCVPGFHGWATAALLVTFCFGWVLIPAITFIILTILKFIANIFHTSNQENRLKSVLRKIKEEFEKTKGSMVCDVCKYECETYKELKAHGVSCPQSQCPYCFTHCEPTEAAFQAHYKVCQVTHRFRDDLKKTVTPQNFTPGCYRTLNLFRYKSRCYIFTMWIFLLVLESILWAASASETPLTPVWNDNAHGVGSVPMHTDLELDFSLTSSSKYTYRRKLTNPLEEAQSIDLHIEIEEQTIGVDVHALGHWFDGRLNLKTSFHCYGACTKYEYPWHTAKCHYERDYQYETSWGCNPSDCPGVGTGCTACGLYLDRLKPVGSAYKIITIRYSRRVCVQFGEENLCKIIDMNDCFVSRHVKVCIIGTVSKFSQGDTLLFFGPLEGGGLIFKHWCTSTCQFGDPGDIMSPRDKGFLCPEFPGSFRKKCNFATTPICEYDGNMVSGYKKVMATIDSFQSFNTSTMHFTDERIEWKDPDGMLRDHINILVTKDIDFDNLGENPCKIGLQTSSIEGAWGSGVGFTLTCLVSLTECPTFLTSIKACDKAICYGAESVTLTRGQNTVKVSGKGGHSGSTFKCCHGEDCSQIGLHAAAPHLDKVNGISEVENSKVYDDGAPQCGIKCWFVKSGEWISGIFSGNWIVLIVLCVFLLFSLVLLSILCPVRKHKKS

SEQ ID NO: 1041 - protein, 1135 aa, Artificial Sequence
  derived and/or modified protein sequence (wt) from HTNV(Aa14-184)__KU207164.1__GP
MGIWKWLVMASLVWPVLTLRNVYDMKIECPHTVSFGENSVIGYVELPPMPLADTAQLVPESSCSMDNHQSLNTITKYTQVSWRGKADQSQSSQNSFETVSTEVDLKGTCVLKHKMIEESYRSRKSITCYDLSCNNTYCKPTLYMIVPIHACNMMKSCLIALGPYRVQVVYERTYCMTGVLIEGKCFVPDQSVVSIIKHGIFDIASVHIVCFFVAVKGNTYKIFEQVKKSFESTCNDTENKVQGYYICIVGGNSAPIYVPTLDDFRSMEAFTGIFRSPHGEDHDLAGEETATYSIVGPANAKVPHSASSDTLSLIAFSGIPSYSSLSILTSSTEAKHVFSPGLFPKLNHTNCDKGAIPLMWTGMIDLPGYYEAIHPCTVFCVLSGPGASCEAFSEGGIFNITSPMCLVSKQNRFRLTEQQVNFVCQRVDVDIVVYCNGQRKVILTKTLVIGQCIYTITSLFSLLPGVAHSIAVELCVPGFHGWATAALLVTFCFGWVLIPAITFIILTILKFIANIFHTSNQENRLKSVLRKIKEEFEKTKGSMVCDVCKYECETYKELKAHGVSCPQSQCPYCFTHCEPTEAAFQAHYKVCQVTHRFRDDLKKTVTPQNFTPGCYRTLNLFRYKSRCYIFTMWIFLLVLESILWAASASETPLTPVWNDNAHGVGSVPMHTDLELDFSLTSSSKYTYRRKLTNPLEEAQSIDLHIEIEEQTIGVDVHALGHWFDGRLNLKTSFHCYGACTKYEYPWHTAKCHYERDYQYETSWGCNPSDCPGVGTGCTACGLYLDRLKPVGSAYKIITIRYSRRVCVQFGEENLCKIIDMNDCFVSRHVKVCIIGTVSKFSQGDTLLFFGPLEGGGLIFKHWCTSTCQFGDPGDIMSPRDKGFLCPEFPGSFRKKCNFATTPICEYDGNMVSGYKKVMATIDSFQSFNTSTMHFTDERIEWKDPDGMLRDHINILVTKDIDFDNLGENPCKIGLQTSSIEGAWGSGVGFTLTCLVSLTECPTFLTSIKACDKAICYGAESVTLTRGQNTVKVSGKGGHSGSTFKCCHGEDCSQIGLHAAAPHLDKVNGISEVENSKVYDDGAPQCGIKCWFVKSGEWISGIFSGNWIVLIVLCVFLLFSLVLLSILCPVRKHKKS

SEQ ID NO: 1042 - protein, 1135 aa, Artificial Sequence
  derived and/or modified protein sequence (wt) from HTNV(LR1)__AF288293.1__GP
MGIWKWLVMASLVWPVLTLRNVYDMKIECPHTVSFGGNSVIGYVELPPVPLADTAQMVPESSCSMDNHQSLNTITKYTQVSWRGKADQSQSSQNSFETVSTEVDLKGTCVLKHKMVEESYRSRKSVTCYDLSCNSTYCKPTLYMIVPIHACNMMKSCLIALGPYRVQVVYERTYCMTGVLIEGKCFVPDQSVVSIIKHGIFDIASVHIVCFFVAVKGNTYKIFEQVKKSFESTCNDTENKVQGYYICIVGGNSAPIYVPTLDDFRSMEAFTGIFRSPHGEDRDLAGEEIASYSIVGPANAKVPHSASSDTLRLIAYSGIPSYSSLSILTSSTEAKHVFSPGLFPKLNHTNCDKSAIPLIWTGMIDLPGYYEAVHPCTVFCVLSGPGASCEAFSEGGIFNITSSMCLVSKQNRFRLTEQQVNFVCQRVDMDIVVYCNGQRKVILTKTLVIGQCIYTITSLFSLLPGVAHSIAVELCVPGFHGWATAALLVTFRFGWVLIPAITFIILTVLKFIANIFHTSNQENRLKSVLRKIKEEFEKTKGSMVCDVCKYECETYKELKAHGVSCPQSQCPYCFTHCEPTEAAFQAHYKVCQVTHRFRDGLKKTVTPQNFTPGCYRTLNLFRYKSRCYIFTMWIFLLVLESILWAASASETPLTPVWNDNAHGVGSVPMHTDLELDFSLTSSSKYTYRRKLTNPLEEAQSIDLHIEIEEQTIGVDVHALGHWFDGRLNLKTSFHCYGACTKYEYPWHTAKCHYERDYQYETSWGCNPSDCPGVGTGCTACGLYLDQLKPVGSAYKIITIRYSRRVCVQFGEENLCKIIDMNDCFVSRHVKVCIIGTVSKFSQGDTLLFFGPLEGGGLIFKHWCTSTCQFGDPGDIMSPRDKGFLCPEFPGSFRKKCNFATTPICEYDGNMVSGYKKVMATIDSFQSFNTSTMHFTDERIEWKDPDGMLRDHINILVTKDIDFDNLGENPCKIGLQTSSIEGAWGSGVGFTLTCLVSLTECPTFLTSIKACDKAICYGAESGTLTRGQNTVKVSGKGGHSGSTFKCCHGEDCSQIGLHAAAPHLDKVNGISEIENSKVYDDGAPQCGIKCWFVKSGEWISGIFSGNWIVLIVLCVFLLFSLVLLSIPCPVRKHKKS

SEQ ID NO: 1043 - protein, 1135 aa, Artificial Sequence
  derived and/or modified protein sequence (wt) from HTNV(SN7)__AF288656.1__GP
MGVWKWLVMASLVWPACTLRNVYDMKIECPHTVSFGENSVIGYVELPPMPLADTTQLVPESSCSMDNHQSLNTITKYTQVSWRKKADQAQSSQNSFETVSVEVDLKGTCVLKHKMIEESYRSRKSITCYDLSCNSTYCKPTLYMIVPIHACNMMKSCLIALGPYRVQVVYERTYCMTGVLIEGKCFVPDQSVVSIIKHGIFDIASVKIVCFFVAVKRNTYKLFEQVKKSFDSTCNDTENKVQGYYICIVGGNSAPIYVPTLDDFRSMEAFSGIFRSPHGEDHDLAGEEVASYSIVGPANAKVPHSASSDTLSLIAYSGIPSYSSLSILTSSTEAKHVFSPGFFPQLNHTKCDKTAIPLTWTGMIDLPGYYEAIHPCTVFCVLSGPGASCEAFSEGGIFNITSPMCLVSKQNRFRLTEQQVNFVCQRVDMDIVVYCNGQRKVILTKTMVIGQCIYTITSLFSLLPGVAHSIAVELCVPGFHGWATAALLVTFCFGWVLIPAVTFIILTVLKFVANIFHTSNQENRLKSVLRKIKEEFEKTKGSMVCDVCKYECETYKELKAHGVSCPQSQCPYCFTHCEPTEAAFQAHYRVCQVTHRFRDDLKKTVTPQNFTPGCYRTLNLFRYKSRCYIFTMWVFLLVLESILWAASASEVPLNPIWNDNAHGVGSVPMHTDLELDFSLTSSSKYTYRRKLTNPLEETQAIDLHIEIEEQTIGVDVHALGHWFDGRLNLKTSFHCYGACTKYEYPWHTAKCHYERDYQYETSWGCNPSDCPGVGTGCTACGLYLDQLKPVGSAYKIITIRYSRRVCVQFGEENLCKVIDMNDCFVSRHVKVCIIGTVSKFSQGDTLLFFGPLEGGGLIFKHWCTSTCQFGDPGDIMSPRDKGFLCPEFPGSFRKKCNFATTPLCEYDGNMISGYKKVMATIDSFQSFNTSTMHFTDERIEWKDPDGMLRDHINILVTKDIDFDNLGENPCKIGLQTSSIEGAWGSGVGFTLTCLVSLTECPTFLTSIKACDKAICYGAESVTLTRGQNTVKVSGKGGHSGSTFKCCHGEDCSQTGLHAAAPHLDKVNGISESENSKVYDDGAPQCGIKCWFVKSGEWISGIFSGNWIVLIVLCVFLLFSLVLLSVLCPVRKHKKS

SEQ ID NO: 1044 - protein, 1135 aa, Artificial Sequence
  derived and/or modified protein sequence (wt) from HTNV(84FLi)__AF366569.1__GP
MGVWKWLVMASLVWPACTLRNVYDMKIECPHTVSFGENSVIGYVELPPMPLADTTQLVPESSCSMDNHQSLNTITKYTQVSWRKKADQAQSSQNSFETVSVEVDLKGTCVLKHKMIEESYRSRKSITCYDLSCNSTYCKPTLYMIVPIHACNMMKSCLIALGPYRVQVVYERTYCMTGVLIEGKCFVPDQSVVSIIKHGIFDIASVKIVCFFVAVKGNTYKLFEQVKKSFDSTCNDTENKVQGYYICIVGGNSAPIYVPTLDDFRSMEAFSGIFRSPHGEDHDLAGEEVASYSIVGPANAKVPHNASSDTLSLIAYSGIPSYSSLSILTSSTEAKHVFSPGFFPQLNHTKCDKTAIPLTWTGMIDLPGYYEAIHPCTVFCVLSGPGASCEAFSEGGIFNITSPMCLVSKQNRFRLTKQQVNFVCQRVDMDIVVYCNGQRKVILTKTMVIGQCIYTITSLFSLLPGVAHSIAVELCVPGFHGWATAALLVTFCFGWVLIPAVTFIILTVLKFVANIFHTSNQENRLKSVLRKIKEEFEKTKGSMVCDVCKYECETYKELKAHGVSCPQSQCPYCFTHCEPTEAAFQAHYRVCQVTHRFRDDLKKTVTPQNFTPGCYRTLNLFRYKSRCYIFTMWVFLLVLESILWAASASEVPLNPIWNDNAHGVGSVPMHTDLELDFSLTSSSKYTYRRKLTNPLEETQAIDLHIEIEEQTIGVDVHALGHWFDGRLNLKTSFHCYGACTKYEYPWHTAKCHYERDYQYETSWGCNPSDCPGVGTGCTACGLYLDQLKPVGSAYKIITIRYSRRVCVQFGEENLCKVIDMNDCFVSRHVKVCIIGTVSKFSQGDTLLFFGPLEGGGLIFKHWCTSTCQFGDPGDIMSPRDKGFLCPEFPGSFRKKCNFATTPLCEYDGNMISGYKKVMATIDSFQSFNTSTMHFTDERIEWKDPDGMLRDHINILVTKDIDFDNLGENPCKIGLQTSSIEGAWGSGVGFTLTCLVSLTECPTFLTSIKACDKAICYGAESVTLTRGQNTVKVSGKGGHSGSTFKCCHGEDCSQTGLHAAAPHLDKVNGISEIENSKVYDDGAPQCGIKCWFVKSGEWISGIFSGNWIVLIVLCVFLLFSLVLLSVLCPVRKHKKS

SEQ ID NO: 1045 - protein, 1135 aa, Artificial Sequence
  derived and/or modified protein sequence (wt) from HTNV(Aa08-1111)__KY594715.1__GP
MGIWKWLVMASLVWPVFTLRNVYDMKIECPHTVSFGENSVIGYVELPPMPLADTAQMVPESSCSMDNHQSLNTITKYTQVSWRGKADQSQSSQNSFETVSTEVDLKGTCVLKHKMVEESYRSRKSITCYDLSCNSTYCKPTLYMIVPIHACNMMKSCLIALGPYRVQVVYERTYCMTGVLIEGKCFVPDQSVVSIIKHGIFDIASVHIVCFFVAVKGNTYKIFEQVKKSFESTCNDTENKVQGYYICIVGGNSAPIYAPTLDDFRSMEAFTGIFRSPHGEDHDLAGEEIASYSIVGPANAKVPHSASSDTLSLIAYSGIPSYSSLSIITSSTEAKHVFSPGLFPKLNHTNCNKGAIPLIWTGMIDLPGYYEAVHPCTVFCVLSGPGASCEAFSEGGIFNITSPMCLVSKQNRFRLTEQQVNFVCQRVDMDIVVYCNGQRKVILTKTLVIGQCIYTITSLFSLLPGVAHSIAVELCVPGFHGWATAALLVTFCFGWVLIPAITFIILTVLKFIANIFHTSNQENRLKSVLRKIKEEFEKTKGSMVCDICKYECETYKELKAHGVSCPQSQCPYCFTHCEPTEAAFQAHYKVCQVTHRFRDDLKKTVTPQNFTPGCYRTLNLFRYKSRCYIFTMWIFLLVLESILWAASASETPLTPVWNDNAHGVGSVPMHTDLELDFSLTSSSKYTYRRKLTNPLEEAQSIGLHIEIEEQTIGVDVHALGHWFDGRLNLKTSFHCYGACTKYEYPWHTAKCHYERDYQYETSWGCNPSDCPGVGTGCTACGLYLDQLKPVGSAYKIITIRYSRRVCVQFGEEHLCKIIDMNDCFVSRHVKVCIIGTVSKFSQGDTLLFFGPLEGGGLIFKHWCTSTCQFGDPGDIMSPRDKGFLCPEFPGSFRKKCNFATTPICEYDGNMVSGYKKVMATIDSFQSFNTSTMHFTDERIEWKDPDGMLRDHINILVTKDIDFDNLGENPCKIGLQTSSIEGAWGSGVGFTLTCLVSLTECPTFLTSIKACDKAICYGAESVTLTRGQNTVKVSGKGGHSGSTFKCCHGEECSQIGLHAAAPHLDKVNGISEIENSKVYDDGAPQCGIKCWFVKSGEWISGIFSGNWIVLIVLCVFLLFSLVLLSILCPVRKHKKS

SEQ ID NO: 1046 - protein, 1135 aa, Artificial Sequence
  derived and/or modified protein sequence (wt) from HTNV(Aa09-189)__KY594716.1__GP
MGIWKWLVMASLVWPVFTLRNVYDMKIECPHTVSFGENSVIGYVELPPMPLADTAQMVPESSCSMDNHQSLNTITKYTQVSWRGKADQSQSSQNSFETVSTEVDLKGTCVLKHKMVEESYRSRKSITCYDLSCNSTYCKPTLYMIVPIHACNMMKSCLIALGPYRVQVVYERTYCMTGVLIEGKCFVPDQSVVSIIKHGIFDIASVHIVCFFVAVKGNTYKIFEQVKKSFESTCNDTENKVQGYYICIVGGNSAPIYAPTLDDFRSMEAFTGIFRSPHGEDHDLAGEEIASYSIVGPANAKVPHSASSDTLSLIAYSGIPSYSSLSIITSSTEAKHVFSPGLFPKLNHTNCDKGAIPLIWTGMIDLPGYYEAVHPCTVFCVLSGPGASCEAFSEGGIFNITSPMCLVSKQNRFRLTEQQVNFVCQRVDMDIVVYCNGQRKVILTKTLVIGQCIYTITSLFSLLPGVAHSIAVELCVPGFHGWATAALLVTFCFGWVLIPAITFIILTVLKFIANIFHTSNQENRLKSVLRKIKEEFEKTKGSMVCDICKYECETYKELKAHGVSCPQSQCPYCFTHCEPTEAAFQAHYKVCQVTHRFRDDLKKTVTPQNFTPGCYRTLNLFRYKSRCYIFTMWIFLLVLESILWAASASETPLTPVWNDNAHGVGSVPMHTDLELDFSLTSSSKYTYRRKLTNPLEEAQSIGLHIEIEEQTIGVDVHALGHWFDGRLNLKTSFHCYGACTKYEYPWHTAKCHYERDYQYETSWGCNPSDCPGVGTGCTACGLYLDQLKPVGSAYKIITIRYSRRVCVQFGEEHLCKIIDMNDCFVSRHVKVCIIGTVSKFSQGDTLLFFGPLEGGGLIFKHWCTSTCQFGDPGDIMSPRDKGFLCPEFPGSFRKKCNFATTPICEYDGNMVSGYKKVMATIDSFQSFNTSTMHFTDERIEWKDPDGMLRDHINILVTKDIDFDNLGENPCKIGLQTSSIEGAWGSGVGFTLTCLVSLTECPTFLTSIKACDKAICYGAESVTLTRGQNTVKVSGKGGHSGSTFKCCHGEECSQIGLHAAAPHLDKVNGISEIENSKVYDDGAPQCGIKCWFVKSGEWISGIFSGNWIVLIVLCVFLLFSLVLLSILCPVRKHKKS

SEQ ID NO: 1047 - protein, 1135 aa, Artificial Sequence
  derived and/or modified protein sequence (wt) from HTNV(CJilin93)__AY748307.1__GP
MGMWKWLVIASLVWPALALRNVYDMKIECPHTVSFGENSVIGYVELPPMPLADTAQMVPESSCSMDNHQSINTITKYTQVTWRGKADPGQSSQNSFETLSAEVDLKGTCVLKHKMVEESYRSRKSITCYDLSCNSTYCKPTLYMIVPIHACNMMKSCLIALGPYRVQVVYERTYCMTGVLIEGKCFVPDQSVVSIIKHGIFDIASVHIVCFFVAVKGNTYKLFEQVKKSFESTCNDTENKVQGYYICIVGGNSAPIYVPTLDDFRSMEAFTGIFKSPHGEDHDLAGEEIASYSIVGPANAKVPHSASSDTLSLIAYSGIPSYSSLSILTSSTDAKHVFSPGLFPKLNHTNCDKSAIPLTWTGMIDLPGYYEAIHPCTVFCVLSGPGASCEAFSEGGIFNITSPMCLVSKQNRFRLTEQQVNFVCQRVDMDIVVYCNGQRKVILTKTLVIGQCIYTITSLFSLLPGVAHSIAVELCVPGFHGWATAALLVTYCFGWVLIPAITFIILTVLKFIANIFHTSNQENRLKSVLRKIKEEFEKTKGSMVCDVCKYECETYKELKAHGVSCPQSQCPYCFTHCEPTEAAFQAHYKVCQVTHRFRDDLKKTVTPQNFTPGCYRTLNLFRYKSRCYIFTMWVFLLILESVLWAASASETPLTPVWNDNAHGVGSVPMHTDLELDFSLTSSSKYTYRRKLTNPLEEAQSIDLHIEIEEQTIGVDVHALGHWFDGRLNIKTSFHCYGACTKYEYPWHTAKCHYERDYQYETSWGCNPSDCPGVGTGCTACGLYLDQLKPVGSAYKIITIRYSRRVCVQFGEENLCKIIDMNDCFVSRHVKVCIIGTVSKFSQGDTLLFFGPLEGGGLIFKHWCTSTCQFGDPGDIMSPRDKGFLCPEFPGSFRKKCNFATTPICEYDGNMVSGYKKVMATIDSFQSFNTSTMHFTDERIEWKDPDGMLRDHINILVTKDIDFDNLGENPCKIGLQTSSIEGAWGSGVGFTLTCLVSLTECPTFLTSIKACDKAICYGAESVTLTRGQNTVKVSGKGGHSGSTFKCCHGEDCSKIGLHAAAPHLDKVNGISEIENSKVYDDGAPQCGIKCWFVKSGEWISGIFSGNWIVLIVLCVFLLFSLVLLSILCPVRKHKKS

SEQ ID NO: 1048 - protein, 1135 aa, Artificial Sequence
  derived and/or modified protein sequence (wt) from HTNV(KHF,clone:4)__LC209208.1__GP
MGIWKWLVMASLVWPVLTLRNVYDMKIECPHTVSFGENSVIGYVELPPMPLADTAQLVPESSCSMDNHQSLNTITKYTQVSWRGKADQSQSSQNSFETVSTEVDLKGTCVLKHKMVEESYRSRKSITCYDLSCNSTYCKPTLYMIVPIHACNMMKSCLIALGPYRVQVVYERTYCMTGVLIEGKCFVPDQSVVSIIKHGIFDIASVHIVCFFVAVKGNTYKIFEQVKKSFESTCNDTENKVQGYYICIVGGNSAPIYVPTLDDFRSMEAFTGIFRSPHGEDHDLAGEETATYSIVGPANAKVPHSASSDTLSLIAFSGIPSYSSLSILTSSTEAKHVFSPGLFPKLNHTNCDKGAIPLMWTGMIDLPGYYEAIHPCTVFCVLSGPGASCEAFSEGGIFNITSPMCLVSKQNRFRLTKQQVNFVCQRVDVDIVVYCNGQRKVILTKTLVIGQCIYTITSLFSLLPGVAHSIAVELCVPGFHGWATAALLVTFCFGWVLIPAVTFIILAILKFIANIFHTSNQENRLKSVLRKIKEEFEKTKGSMVCDVCKYECETYKELKAHGVSCPQSQCPYCFTHCEPTEAAFQAHYKVCQVTHRFRDDLKKTVTPQNFTPGCYRTLNLFRYKSRCYIFTMWIFLLVLESILWAASASETPLTPVWNDNAHGVGSIPMHTDLELDFSLTSSSKYTYRRKLTNPLEEAQSIDLHIEIEEQTIGVDVHALGHWFDGRLNLKTSFHCYGACTKYEYPWHTAKCHYERDYQYETSWGCNPSDCPGVGTGCTACGLYLDRLKPVGSAYKIITIRYSRRVCVQFGEENLCKIIDMNDCFVSRHVKVCIIGTVSKFSQGDTLLFFGPLEGGGLIFKHWCTSTCQFGDPGDIMSPRDKGFLCPEFPGSFRKKCNFATTPICEYDGNMVSGYKKVMATIDSFQSFNTSTMHFTDERIEWKDPDGMLRDHINILVTKDIDFDNLGENPCKIGLQTSSIEGAWGSGVGFTLTCLVSLTECPTFLTSIKACDKAICYGAESVTLTRGQNTVKVSGKGGHSGSTFKCCHGEDCSPNGLHAAAPHLDKVNGISEIENSKVYDDGAPQCGIKCWFVKSGEWISGIFSGNWIVLIVLCVFLLFSLVLLSILCPVRKHKKS

SEQ ID NO: 1049 - protein, 1135 aa, Artificial Sequence
  derived and/or modified protein sequence (wt) from HTNV(KHF,clone:5)__LC209209.1__GP
MGIWKWLVMASLVWPVLTLRNVYDMKIECPHTVSFGENSVIGYVELPPMPLADTAQLVPESSCSMDNHQSLNTITKYTQVSWRGKADQSQSSQNSFETVSTEVDLKGTCVLKHKMVEESYRSRKSITCYDLSCNSTYCKPTLYMIVPIHACNMMKSCLIALGPYRVQVVYERTYCMTGVLIEGKCFVPDQSVVSIIKHGIFDIASVHIVCFFVAVKGNTYKIFEQVKKSFESTCNDTENKVQGYYICIVGGNSAPIYVPTLDDFRSMEAFTGIFRSPHGEDHDLAGEETATYSIVGPANAKVPHSASSDTLSLIAFSGIPSYSSLSILTSSTEAKHVFSPGLFPKLNHTNCDKGAIPLMWTGMIDLPGYYEAIHPCTVFCVLSGPGASCEAFSEGGIFNITSPMCLVSKQNRFRLTEQQVNFVCQRVDVDIVVYCNGQRKVILTKTLVIGQCIYTITSLFSLLPGVAHSIAVELCVPGFHGWATAALLVTFCFGWVLIPAVTFIILAILKFIANIFHTSNQENRLKSVLRKIKEEFEKTKGSMVCDVCKYECETYKELKAHGVSCPQSQCPYCFTHCEPTEAAFQAHYKVCQVTHRFRDDLKKTVTPQNFTPGCYRTLNLFRYKSRCYIFTMWIFLLVLESILWAASASETPLTPVWNDNAHGVGSIPMHTDLELDFSLTSSSKYTYRRKLTNPLEEAQSIDLHIEIEEQTIGVDVHALGHWFDGRLNLKTSFHCYGACTKYEYPWHTAKCHYERDYQYETSWGCNPSDCPGVGTGCTACGLYLDRLKPVGSAYKIITIRYSRRVCVQFGEENLCKIIDMNDCFVSRHVKVCIIGTVSKFSQGDTLLFFGPLEGGGLIFKHWCTSTCQFGDPGDIMSPRDKGFLCPEFPGSFRKKCNFATTPICEYDGNMVSGYKKVMATIDSFQSFNTSTMHFTDERIEWKDPDGMLRDHINILVTKDIDFDNLGENPCKIGLQTSSIEGAWGSGVGFTLTCLVSLTECPTFLTSIKACDKAICYGAESVTLTRGQNTVKVSGKGGHSGSTFKCCHGEDCSPNGLHAAAPHLDKVNGISEIENSKVYDDGAPQCGIKCWFVKSGEWISGIFSGNWIVLIVLCVFLLFSLVLLSILCPVRKHKKS

SEQ ID NO: 1050 - protein, 1134 aa, Artificial Sequence
  derived and/or modified protein sequence (wt) from HTNV__D00376.1__GP
MGIWKWLVMASLVWPVLTLRNVYDMKIECPHTVSFGENSVIGYVELPPMPLADTAQLVPESSCSMDNHQSLNTITKYTQVSWRGKADQSQSSQNSFETVSTEVDLKGTCVLKHKMVEESYRSRKSITCYDLSCNSTYCKPTLYMIVPIHACNMMKSCLIALGPYRVQVVYERTYCMTGVLIEGKCFVPDQSVVSIIKHGIFDIASVHIVCFFVAVKGNTYKIFEQVKKSFESTCNDTENKVQGYYICIVGGNSAPIYVPTLDDFRSMEAFTGIFRSPHGEDHDLAGEETATYSIVGPANAKVPHSASSDTLSLIAFSGIPSYSSLSILTSSTEAKHVFSPGLFPKLNHTNCDKGAIPLMWTGMIDVPRYYDGIHPFTVFCVLSGPGASCEAFSEGGIFNITSPMCLVSKQNRFRLTEQQVNFVCQRVDVDIVVYCNGQRKVILTKTLVIGQCIYTITSLFSLLPGVAHSIAVELCVPGFHGWATAALLVTFCFGWVLIPAVTFIILAILKFIANIFHTSNQENRLKSVLRKIKEEFEKTKGSMVCDVCKYECETYKELKAHGVSCPQSQCPYCFTHCEPTEAAFQAHYKVCQVTHRFRDDLKKTVTPQNFTPGCYRTLNLFRYKSRCYIFTMWIFLLVLESILWAASASETPLTPVWNDNAHGVGSIPMHTDLELDFSLTSSSKYTYRRKLTNPLEAQSIDLHIEIEEQTIGVDVHALGHWFDGRLNLKTSFHCYGACTKYEYPWHTAKCHYERDYQYETSWGCNPSDCPGCGTGCTACGLYLDRLKPVGSAYKIITIRYSRRVCVQFGEENLCKIIDMNDCFVSRHVKVCIIGTVSKFSQGDTLLFFGPLEGGGLIFKHWRTSTCQFGDPGDIMSPRDKGFLCPEFPGSFRKKCNFATTPICEYDGNMVSGYKKVMATIDSFQSFNTSTMHFTDERIEWKDPDGMLRDHINILVTKDIDFDNLGENPCKIGLQTSSIEGAWGSGVGFTLTCLVSLTECPTFLTSIKACDKAICYGAESVTLTRGQNTVKVSGKGGHSGSTFKCCHGEDCSPNGLHAAAPHLDKVNGISEIENSKEYDDGAPQCGIKCWFVKSGEWISGIFSGNWIVLIVLCVFLLFSLVLLSILCPVRKHKKS

SEQ ID NO: 1051 - protein, 1138 aa, Artificial Sequence
  derived and/or modified protein sequence (wt) from LANV(510B)__AF005728.1__GP
MEGWLFTILGVCYIMTTVLPKTIYELKMECPHTVGLGQGYIIGSAELGLIDIATVPEIKLESSCNFDLHTTSSTQKSFTQLEWRKKAETTDTTQAASTTFEAQTKTVNIRGTCILASDLYDTLKRVKKTVLCYDLTCNQTQCQPTVYLITPVGTCMSIRSCMANLLSNRIQITFEKTHCVTGQLVEGQCFNPSHSLTLSQPPHTYDVVTLPTTCFFTAKKADQYKIVKTFEGIISKTGCTENSIQGYYVCFIGSHSEPLIIPTLEDIRSAELASRMLLHPRGEDHDPLQNAQAVLRIVGPITAKVPSSSSTETLQGIAFAGVPMYSSFSTLVRNADPEYVFSPGIIPESNQSVCDKKTLPLTWTGYLPISGEMEKVTGCTVFCTLAGPGANCEAYSESGIFNISSPTCLVNKVQRFRGSEQKINFMCQRIDNNVVVYCNGQKKVILTKTLVIGQCIYTFTSLFSLMPDVAHSLAVELCVPGLHGWATIALLSTFCFGWLLIPGITLIVLKILKILTYSCSHYSSESKFKMILEKVKVEYQKTMGSMVCDICHHECETVKELESHKQSCVEGQCPYCMTVTEATQSALQAHFSICKLTGRFHEALKKSLKKPEVHRGCYRTLGVFRYRSRCYVGLVWGCLLTIELVLWAASAETPLLEPGWSDTAHGVGELPLKTDLELDFSLPSSSSYSYRRRLTNPANKEESLPFHFQMEKQVIHAEIQSLGHWMDATFNIKTAFHCYGACKQYSYPWQTAKCFFEKDYQYETGWGCNPGDCPGVGTGCTACGIYLDKLKSVGKAYKVISLKYTRKVCIQLGTEQVCKHIDANDCLVTPSVKVCIIGTVSKIQPSDTLLFLGPLEQGGVILKQWCTTSCTFGDPGDIMSTTSGMRCPEHTGSFRKICGFATTPVCEYQGNTISGYQRLMATKDSFQSFNLTDPHITSSKLEWIDPDGNTRDHVNLILNRDVSFQDLSDNPCKVDLHTQSIDGAWGSGVGFTLTCVVGLTECPSFITSIKACDLAMCYGSTVATLARGSNTVKVVGKGGHSGSSFKCCHDSDCSSEGLMASAPHLERVTGFNQIDSDKVYDDGAPPCSFKCWFTKSGEWLLGILNGNWIVIAVLVIILIISIILFSFLCPRRSHKKNV

SEQ ID NO: 1052 - protein, 1133 aa, Artificial Sequence
  derived and/or modified protein sequence (wt) from LQUV(Longquan-Rs-32)__JX465402.1__GP
MKSILLILLLEQVRSKATNEIKLECPHDQRVETGFSHGFTDLSPILYTKGLFTKHLENNCPFDISIINRLVRDVRISTWQAKSTNTDATVASATSFETKDTDDKLAGVCGFFDDITKPKQGQRKAIICYDLSCNQTHCLPTLHLIFPQQFCQSLKQCSINAYDHKILITISLSFCPEGLIIGGNCIVPVLAQSQLLHNHMTYNIKVTCFFEYSMARESLDNKFLEEMNRLVLGRNCEKTEYLGGYVCFLAGYGTAIHVPYDNTYLSGAVVNSMKANLHGEDHDRLKLGDTSAVIAGNLKFVIDSTAPEKSYQGECFTGHMGYTSLYFYPVRSKGKYVTILTKGVIPVINKTTCMPKIVPLVWTGMVEMRGIEEKLEACTMHCIMVGNGATCEAFSATGIFDIKSTTCQIGKTHKYRRTEDQITFTCQDLNKDISVICNGENITVPVKSLIVGQCIYTITSIFSIFPATAHSIATEMCVQGIHGWLTIIIFFTFCFGWLLIPILTCLIINTIAYSLITLAYFKNGARLGNLIKRMKSEFQRTIGNTTCNICLRECESESEYKSHEELCKNGSCPYCMKDIGVSQVLLNEHYNACMLIDRYEKRLTHTLNQTPLYSRKVRKIQSFRYRNRCFILTVWIILLTVESLIWASSAEDIKPAPKWQNTAHGIGTIKLNSDYELDFSVVAGSEFTHKRMLQSPESGKKNIPFTVYLSEQLITSTVQILGNWMDAEINVKSVFHCYGTCKKYSYPWQSSPCHKEVDFEFQSSWGCNPISCPGINSGCTACGTYVDKLKTIAKAYRIITVKYSRKVCYQIGTKKACKTLESNDCLVSNGVKICAIGTISTLQTGMTLVFFGPLNGGALLIKDWCISSCKFGDPGDIMQISNNITCPSFDGTMQRVCRFGLEPMCSYSGNKISGVKRVLETKDSYLSVNLTKPKLVGSTLLWNSLDSSIKDHINIVVSNDIDFEDLAETPCKVTIKNLKIEGAWGSGIGIKLHCEVSLSECSEYLTTIKVCDNAICYGGNVAHLSRGLNTVIIKGAGGHSGSSFKCCHETSCSDIGFKAEAPHLARIVDDGITTSMSYSDGAPEAGIVSWIYKVAEWIKGMFNGNWFVLIIMILFLIISIVLLIFLCPVKKYK

SEQ ID NO: 1053 - protein, 1133 aa, Artificial Sequence
  derived and/or modified protein sequence (wt) from LQUV(Longquan-Ra-25)__JX465397.1__GP
MKSILLILLLGQVRSKATNEIKLECPHDQRVETGFSHGFTDLSPILYTKGLFTKHLENNCPFDISIINRLVRDVRISTWQAKSTNTDATVASATSFETKDTDDKLAGVCGFFDDITKPKQGQRKAIICYDLSCNQTHCLPTLHLIFPQQFCQSLKQCSINAYDHKILITISLSFCPEGLIIGGNCIVPVLAQSQLLHNHMTYNIKVTCFFEYSMARESLDNKFLEEMNRLVLGRNCEKTEYLGGYVCFLAGYGTAIHVPYDNTYLSGAVVNSMKANLHGEDHDRLKLGDTSAVIAGNLKFVIDSTAPEKSYQGECFTGHMGYTSLYFYPVRSKGKYVTILTKGVIPVINKTTCMPKIVPLVWTGMVEMRGIEEKLEACTMHCIMVGNGATCEAFSATGIFDIKSTTCQIGKTHKYRRTEDQITFTCQDLNKDISVICNGENITVPVKSLIVGQCIYTITSIFSIFPATAHSIATEMCVQGIHGWLTIIIFFTFCFGWLLIPILTCLIINTIAYSLITLAYFKNGARLGNLIKRMKSEFQRTIGNTTCNICLRECESESEYKSHEELCKNGSCPYCMKDIGVSQVLLNEHYNACMLIDRYEKRLTHTLNQTPLYSRKVRKIQSFRYRNRCFILTVWIILLTVESLIWASSAEDIKPAPKWQNTAHGIGTIKLNSDYELDFSVVAGSEFTHKRMLQSPESGKKNIPFTVYLSEQLITSTVQILGNWMDAEINVKSVFHCYGTCKKYSYPWQSSPCHKEVDFEFQSSWGCNPISCPGINSGCTACGTYVDKLKTIAKAYRIITVKYSRKVCYQIGTKKACKTLESNDCLVSNGVKICAIGTISTLQTGMTLVFFGPLNGGALLIKDWCISSCKFGDPGDIMQISNNITCPSFDGTMQRVCRFGLEPMCSYSGNKISGVKRVLETKDSYLSVNLTKPKLVGSTLLWNSLDSSIKDHINIVVSNDIDFEDLAETPCKVTIKNLKIEGAWGSGIGIKLHCEVSLSECSEYLTTIKVCDNAICYGGNVAHLSRGLNTVIIKGAGGHSGSSFKCCHETSCSDIGFKAEAPHLARIVDDGITTSMSYSDGAPEAGIISWIYKVAEWIKGMFNGNWFVLIIMILFLIISIVLLIFLCPVKKYK

SEQ ID NO: 1054 - protein, 1133 aa, Artificial Sequence
  derived and/or modified protein sequence (wt) from LQUV(Longquan-Ra-5)__JX465398.1__GP
MKSILLILLLGQVRSKATNEIKLECPHDQRVETGFSHGFTDLSPILYTKGLFTKHLENNCPFDISIINRLVRDVRISTWQAKSTNTDATVASATSFETKDTDDKLAGVCGFFDDITKPKQGQRKAIICYDLSCNQTHCLPTLHLIFPQQFCQSLKQCSINAYDHKILITISLSFCPEGLIIGGNCIVPVLAQSQLLHNHMTYNIKVTCFFEYSMARESLDNKFLEEMNRLVLGRNCEKTEYLGGYVCFLAGYGTAIHVPYDNTYLSGAVVNSMKANLHGEDHDRLKLGDTSAVIAGNLKFVIDSTAPEKSYQGECFTGHMGYTSLYFYPVRSKGKYVTILTKGVIPVINKTTCMPKIVPLVWTGMVEMRGIEEKLEACTMHCIMVGNGATCEAFSATGIFDIKSTTCQIGKTHKYRRTEDQITFTCQDLNKDIGVICNGENITVPVKSLIVGQCIYTITSIFSIFPATAHSIATEMCVQGIHGWLTIIIFFTFCFGWLLIPILTCLIINTIAYSLITLAYFKNGARLGNLIKRMKSEFQRTIGNTTCNICLRECESESEYKSHEELCKNGSCPYCMKDIGVSQVLLNEHYNACMLIDRYEKRLTHTLNQTPLYSRKVRKIQSFRYRNRCFILTVWITLLTVESLIWASSAEDIKPAPKWQNTAHGIGTIKLNSDYELDFSVVAGSEFTHKRMLQSPESGKKNIPFTVYLSEQLITSTVQILGNWMDAEINVKSVFHCYGTCKKYSYPWQSSPCHKEVDFEFQSSWGCNPISCPGINSGCTACGTYVDKLKTIAKAYRIITVKYSRKVCYQIGTKKACKTLESNDCLVSNGVKICAIGTISTLQTGMTLVFFGPLNGGALLIKDWCISSCKFGDPGDIMQISNNITCPSFDGTMQRVCRFGLEPMCSYSGNKISGVKRVLETKDSYLSVNLTKPKLVGSTLLWNSLDSSIKDHINIVVSNDIDFEDLAETPCKVTIKNLKIEGAWGSGIGIKLHCEVSLSECSEYLTTIKVCDNAICYGGNVAHLSRGLNTVIIKGAGGHSGSSFKCCHETSCSDIGFKAEAPHLARIVDDGITTSMSYSDGAPEAGIVSWIYKVAEWIKGMFNGNWFVLIIMILFLIISIVLLIFLCPVKKYK

SEQ ID NO: 1055 - protein, 1133 aa, Artificial Sequence
  derived and/or modified protein sequence (wt) from LQUV(Longquan-Ra-56)__JX465399.1__GP
MKSILLILLLGQVRSKATNEIKLECPHDQRVETGFSHGFTDLSPILYTKGLFTKHLENNCPFDISIINRLVRDVRISTWQAKSTNTDATVASATSFETKDTDDKLAGVCGFFDDITKPKQGQRKAIICYDLSCNQTHCLPTLHLIFPQQFCQSLKQCSINAYDHKILITISLSFCPEGLIIGGNCIVPVLAQSQLLHNHMTYNIKVTCFFEYSMARESLDNKFLEEMNRLVLGRNCEKTEYLGGYVCFLAGYGTAIHVPYDNTYLSGAVVNSMKANLHGEDHDRLKLGDTSAVIAGNLKFVIDSTAPEKSYQGECFTGHMGYTSLYFYPVRSKGKYVTILTKGVIPVINKTTCMPKIVPLVWTGMVEMRGIEEKLEACTMHCIMVGNGATCEAFSATGIFDIKSTTCQIGKTHKYRRTEDQITFTCQDLNKDISVICNGENITVPVKSLIVGQCIYTISSIFSIFPATAHSIATEMCVQSIHGWLTIIIFFTFCFGWLLIPILTCLIINTIAYSLITLAYFKNGARLGNLIKRMKSEFQRTIGNTTCNICLRECESESEYKSHEELCKNGSCPYCMKDIGVSQVLLNEHYNACMLIDRYEKRLTHTLNQTPLYSRKVRKIQSFRYRNRCFILTVWIILLTVESLIWASSAEDIKPAPKWQNTAHGIGTIKLNSDYELDFSVVAGSEFTHKRMLQSPESGKKNIPFTVYLSEQLITSTVQILGNWMDAEINVKSVFHCYGTCKKYSYPWQSSPCHKEVDFEFQSSWGCNPISCPGINSGCTACGTYVDKLKTIAKAYRIITVKYSRKVCYQIGTKKACKTLESNDCLVSNGVKICAIGTISTLQTGMTLVFFGPLNGGALLIKDWCISSCKFGDPGDIMQISNNITCPSFDGTMQRVCRFGLEPMCSYSGNKISGVKRVLETKDSYLSVNLTKPKLVGSTLLWNSLDSSIKDHINIVVSNDIDFEDLAETPCKVTIKNLKIEGAWGSGIGIKLHCEVSLSECSKYLTTIKVCDNAICYGGNVAHLSRGLNTVIIKGAGGHSGSSFKCCHETSCSDIGFKAEAPHLARIVDDGITTSMSYSDGAPEAGIVSWIYKVAEWIKGMFNGNWFVLIIMILFLIISIVLLIFLCPVKKYK

SEQ ID NO: 1056 - protein, 1133 aa, Artificial Sequence
  derived and/or modified protein sequence (wt) from LQUV(Longquan-Ra-90)__JX465400.1__GP
MKSILLILLLGQVRSKATNEIKLECPHDQRVETGFSHGFTDLSPILYTKGLFTKHLENNCPFDISIINRLVRDVRISTWQAKSTNTDATVASATSFETKDTDDKLAGVCGFFDDITKPKQGQRKAIICYDLSCNQTHCLPTLHLIFPQQFCQSLKQCSINAYDHKILITISLSFCPEGLIIGGNCIVPVLAQSQLLHNHMTYNIKVTCFFEYSMARESLDNKFLEEMNRLVLGRNCEKTEYLGGYVCFLAGYGTAIHVPYDNTYLSGAVVNSMKANLHGEDHDRLKLGDTSAVIAGNLKFVIDSTAPEKSYQGECFTGHMGYTSLYFYPVRSKGKYVTILTKGVIPVINKTTCMPKIVPLVWTGMVEMRGIEEKLEACTMHCIMVGNGATCEAFSATGIFDIKSTTCQIGKTHKYRRTEDQITFTCQDLNKDISVICNGENITVPVKSLIVGQCIYTITSIFSIFPATAHSIATEMCVQGIHGWLTIIIFFTFCFGWLLIPILTCLIINTIAYSLITLAYFKNGARLGNLIKRMKSEFQRTIGNTTCNICLRECESESEYKSHEELCKNGSCPYCMKDIGVSQVLLNEHYNACMLIDRYEKRLTHTLNQTPLYSRKVRKIQSFRYRNRCFILTVWIILLTVESLIWASSAEDIKPAPKWQNTAHGIGTIKLNSDYELDFSVVAGSEFTHKRMLQSPESGKKNIPFTVYLSEQLITSTVQILGNWMDAEINVKSVFHCYGTCKKYSYPWQSSPCHKEVDFEFQSSWGCNPISCPGINSGCTACGTYVDKLKTIAKAYRIITVKYSRKVCYQIGTKKACKTLESNDCLVSNGVKICAIGTISTLQTGMTLVFFGPLNGGALLIKDWCISSCKFGDPGDIMQISNNITCPSFDGTMQRVCRFGLEPMCSYSGNKISGVKRVLETKDSYLSVNLTKPKLVGSTLLWNSLDSSIKDHINIVVSNDIDFEDLAETPCKVTIKNLKIEGAWGSGIGIKLHCEVSLSECSEYLTTIKVCDNAICYGGNVAHLSRGLNTVIIKGAGGHSGSSFKCCHETSCSDIGFKAEAPHLARIVDDGITTSMSYSDGAPEAGIVSWIYKVAEWIKGMFNGNWFVLIIMILFLIISIVLLIFLCPVKKYK

SEQ ID NO: 1057 - protein, 1140 aa, Artificial Sequence
  derived and/or modified protein sequence (wt) from NYV(Rhode Island-1 (RI-1))__U36801.1__GP
MVGWVCIFLVVLATTTAGLTRNLYELKIECPHTVGLGQGYVTGSVETTPILLTQVTDLKIESSCNFDLHVPSTSIQKYNQVEWAKKSSTTESTSAGATTFEAKTKEVSLKGTCNIPVTTFEAAYKSRKTVICYDLACNQTYCLPTVHLIAPVQTCMSVRSCMIGLLSSRIQVIYEKTYCVTGQLVEGLCFIPTHTIALTQPGHTYDTMTLPITCFLVAKKLGTQLKIAVELEKLITASGCTENSFQGYYICFLGKHSEPLSVPMMDDYRSAELFTRMVLNPRGEDHDPDQNGQGLMRIAGPITAKVPSTETTETMQGIAFAGAPTYSSFSTLVRKADPDYVFSPGIIAESNHSVCDKKAIPLTWTGFLAVSGEIEKITGCTVFCTLVGPGASCKAYSETGIFNISSPTCLVNKVQKFRGSEQRINFMCQRVDQDVIVYCNGQKKVILTKTLIIGQCIYTFTSLFSLIPGVAHSLAVELCVPGLHGWATAALLITFCFGWLLIPTITMIILKILRLLTFSCSHYSTESKFKAILERVKVEYQKTMGSMVCDACHHECETAKELETHKKSCPEGQCPYCMTMTESTESALLAHFSICKLTNRFQENLKKSLKRPEVKQGRYRTLGVFRYKSRCYVGLVWGVLLTTELIVWAASADTPLMESGWSDTAHGVGIVPMKTDLELDFALASSSSYSYRRKLVNPANKEETLPFHFQLDKQVVHAEIQNLGHWMDGTFNIKTAFHCYGECKKYAYPWQTAKCFFEKDYQYETSWGCNPPDCPGVGTGCTACGVYLDKLRSGGKAYKIVSLKFTRKVCIQLGTEQTCKHIDVNDCLVTPSVKVCLIGTISKLQPGDTLLFLGPLEQGGIILKQWCTTSCVFGDPGDIMSTTTGMKCPEHTGSFRKICGFATTPTCEYQGNTISGFQRMMATRDSFQSFNVTEPHITSNRLEWIDPDSSIKDHINMVLNRDVSFQDLSDNPCKVDLHTQSIDGAWGSGVGFTLVCTVGLTECANFITSIKACDSAMCYGATVTNLLRGSNTVKVVGKGGHSSSLFKCCHDTDCTEEGLAASPPHLDRVTGYNQIDSDKVYDDGAPPCTIKCWFTKSGEWLLGILNGNWVVVAVLIVILILSILLFSFFCPIRGRKNKSN

SEQ ID NO: 1058 - protein, 1140 aa, Artificial Sequence
  derived and/or modified protein sequence (wt) from NYV(New York-1 (NY-1))__U36802.1__GP
MVGWVCISLVVLATTTAGLTRNLYELKIECPHTVGLGQGYVTGSVETTPILLTQVTDLKIESSCNFDLHVPSTSIQKYNQVEWAKKSSTTESTSAGATTFEAKTKEVSLKGTCNIPVTTFEAAYKSRKTVICYDLACNQTHCLPTVHLIAPVQTCMSVRSCMIGLLSSRIQVIYEKTYCVTGQLVEGLCFIPTHTIALTQPGHTYDTMTLPITCFLVAKKLGTQLKIAVELEKLITASGCTENSFQGYYICFLGKHSEPLFVPMMDDYRSAELFTRMVLNPRGEDHDPDQNGQGLMRIAGPITAKVPSTETTETMQGIAFAGAPMYSSFSTLVRKADPDYVFSPGIIAESNHSVCDKKTIPLTWTGFLAVSGEIEKITGCTVFCTLVGPGASCEAYSETGIFNISSPTCLVNKVQKFRGSEQRINFMCQRVDQDVIVYCNGQKKVILTKTLVIGQCIYTFTSLFSLIPGVAHSLAVELCVPGLHGWATTALLITFCFGWLLIPTITMIILKILRLLTFSCSHYSTESKFKAILERVKVEYQKTMGSMVCDVCHHECETAKELETHKKSCPEGQCPYCMTMTESTESALQAHFSICKLTNRFQENLKKSLKRPEVKQGCYRTLGVFRYKSRCYVGLVWGVLLTTELIVWAASADTPLMESGWSDTAHGVGIVPMKTDLELDFALASSSSYSYRRKLVNPANKEETLPFHFQLDKQVVHAEIQNLGHWMDGTFNIKTAFHCYGECKKYAYPWQTAKCFFEKDYQYETSWGCNPPDCPGVGTGCTACGVYLDKLRSVGKAYKIVSLKFTRKVCIQLGTEQTCKHIDVNDCLVTPSVKVCLIGTISKLQPGDTLLFLGPLEQGGIILKQWCTTSCVFGDPGDIMSTTTGMKCPEHTGSFRKICGFATTPTCEYQGNTISGFQRMMATRDSFQSFNVTEPHITSNRLEWIDPDSSIKDHINMVLNRDVSFQDLSDNPCKVDLHTQSIDGAWGSGVGFTLVCTVGLTECANFITSIKACDSAMCYGATVTNLLRGSNTVKVVGKGGHSGSLFKCCHDTDCTEEGLAASPPHLDRVTGYNQIDSDKVYDDGAPPCTIKCWFTKSGEWLLGILNGNWVVVAVLIVILILSILLFSFFCPIRGRKNKSN

SEQ ID NO: 1059 - protein, 1140 aa, Artificial Sequence
  derived and/or modified protein sequence (wt) from NYV(New York-2 (NY-2))__U36803.1__GP
MVGFVCIFLVVLATTTAGLTRNLYELKIECPHTVGLGQGYVTGSVGTTPILLTQVTDLKIESSCNFDLHVPSTSIQKYNQVEWAKKSSTTESTSAGATTFEAKTKEVSLKGTCNIPVTTFEAAYKSRKTVICYDLACNQTHCLPTVHLIAPVQTCMSVRSCMIGLLSSRIQVIYEKTYCVTGQLVEGLCFIPTHTIALTQPGHTYDTMTLPITCFLVAKKLGTQLKIAVELEKLITAGGCTENSFQGYYICFLGKHSEPLFVPMMDDYRSAELFTRMVLNPRGEDHDPDQNGQGLMRIAGPITAKVPSTETTEAMQGIAFAGAPMYSSFSTLVRKADPDYVFSPGIIAESNHSVCDKKTIPLTWTGFLAVSGEIEKITGCTVFCTLVGPGASCEAYSETGIFNISSPTCLVNKVQKFRGSEQRINFMCQRVDQDVIVYCNGQKKVILTKTLVIGQCIYTFTSLFSLIPGVAHSLAVELCVPGLHGWATTALLITFCFGWLLIPTITMIILKILRLLTFSCSHYSTESKFKAILERVKVEYQKTMGSMVCDVCHHECETAKELETHKKSCPEGQCPYCMTMTESTESALQAHFSICKLTNRFQENLKKSLKRPEVKQGCYRTLGVFRYKSRCYVGLVWGVLLTTELIVWAASADTPLMESGWSDTAHGVGIVPMKTDLELDFALASSSSYSYRRKLVDPANKEETLPFHFQLDKQVVHAEIQNLGHWMDGTFNIKTAFHCYGECKKYAYPWQTAKCFFEKDYQYETSWGCNPPDCPGVGTGCTACGVYLDKLRSVGKAYKIVSLKFTRKVCIQLGTEQTCKHIDVNDCLVTPSVKVCLIGTISKLQPGDTLLFLGPLEQGGIILKQWCTTSCVFGDPGDIMSTTTGMKCPEHTGSFRKICGFATTPTCEYQGNTISGFQRMMATRDSFQSFNVTEPHITSNRLEWIDPDSSIKDHINMVLNRDVSFQDLSDNPCKVDLHTQSIDGAWGSGVGFTLVCTVGLTECANFITSIKACDSAMCYGATVTNLLRGSNTVKVVGKGGHSGSLFKCCHDTDCTEEGLAASPPHLDRVTGYNQIDSDKVYDDGAPPCTIKCWFTKSGEWLLGILNGNWVVVAVLIVILILSILLFSFFCPIRGRKNKSN

SEQ ID NO: 1060 - protein, 1148 aa, Artificial Sequence
  derived and/or modified protein sequence (wt) from PUUV(K27)__L08754.1__GP
MGELSPVCLYLLLQGLLLCNTGAARNLNELKMECPHTIRLGQGLVVGSVELPSLPIQQVETLKLESSCNFDLHTSTAGQQSFTKWTWEIKGDLAENTQASSTSFQTKSSEVNLRGLCLIPTLVVETAARMRKTIACYDLSCNQTVCQPTVYLMGPIQTCITTKSCLLSLGDQRIQVNYEKTYCVSGQLVEGICFNPIHTMALSQPSHTYDIMTMMVRCFLVIKKVTSGDSMKIEKNFETLVQKNGCTANNFQGYYICLIGSSSEPLYVPALDDYRSAEVLSRMAFAPHGEDHDIEKNAVSAMRIAGKVTGKAPSTESSDTVQGIAFSGSPLYTSTGVLTSKDDPVYIWAPGIIMEGNHSICEKKTLPLTWTGFISLPGEIEKTTQCTVFCTLAGPGADCEAYSETGIFNISSPTCSINRVQRFRGSEQQIKFVCQRVDMDITVYCNGMKKVILTKTLVIGQCIYTFTSIFSLIPGVAHSLAVELCVPGLHGWATMLLLLTLCFGWVLIPTITMILLKILIAFAYLCSKYNTDSKFRILIEKVKREYQKTMGSMVCEVCQYECETAKELESHRKSCSIGSCPYCLNPSEATTSALQAHFKVCKLTSRFQENLRKSLTVYEPMQGCYRTLSLFRYRSRFFVGLVWCVLLVLELIVWAASAETQNLNAGWTDTAHGSGIIPMKTDLELDFSLPSSASYTYRRQLQNPANEQEKIPFHLQLSKQVIHAEIQHLGHWMDATFNLKTAFHCYGSCEKYAYPWQTAGCFIEKDYEYETGWGCNPPDCPGVGTGCTACGVYLDKLKSVGKVFKIVSLRYTRKVCIQLGTEQTCKTVDSNDCLITTSVKVCLIGTISKFQPSDTLLFLGPLQQGGLIFKQWCTTTCQFGDPGDIMSTPTGMKCPELNGSFRKKCAFATTPVCQFDGNTISGYKRMIATKDSFQSFNVTEPHISTSALEWIDPDSSLRDHINVIVSRDLSFQDLSETPCQIDLATASIDGAWGSGVGFNLVCTVSLTECSAFLTSIKACDAAMCYGSTTANLVRGQNTIHIVGKGGHSGSKFMCCHDTKCSSTGLVAAAPHLDRVTGYNQADSDKIFDDGAPECGMSCWFKKSGEWILGVLNGNWMVVAVLVVLLILSILLFTLCCPRRPSYRKEHKP

SEQ ID NO: 1061 - protein, 1148 aa, Artificial Sequence
  derived and/or modified protein sequence (wt) from PUUV(13891)__U22418.1__GP
MGKIIPVCLYLLFLCLLLWNRGDARNLNELKMECPHTIGLGQGLVIGSVELPPVPLTQVESLKLESSCNFDLHTSTSSQQSFTKWTWEIKNDLAENTQASSTSFQTKSSEINLRGLCLIPPLVIETAARTRKTIACFDLSCNQTACQPTVFLIGPIQTCITTKSCLLGLGDQRIQVNYEKTYCVSGQLVEGVCFNPVHTMALSQPSHTYDIVTVMVRCFLIVKKVSTGDSMKLEKSFETLVQKTGCTGNGFQGYYVCLVGSSSEPLYIPTLDDYRSAEILSRMAFAPHGEDHDVEKNAISAMRIVGKVTGKAPSTESSDTIQGIAFSGNPLYTSTGVLTAKDDPVYIWAPGIIMEGNHSVCDKKTLPLTWTGFIPLPGEIEKTTQCTVFCTLAGPGADCEAYSETGIFNISSPTCLINRVQRFRGAEQQIKFICQRVDMDITVYCNGLKKVILTKTLVIGQCIYTFTSIFSLIPGVAHSLAVELCVPGLHGWATMLLLLTFCFGWILIPFFSMILLKILIAFAYLCSKYNTDSKFKILIEKVKREYQKTMGSMVCEVCQYECETAKELESHRKSCPIGSCPYCLNPAEATTSALQAHFKVCKLTSRFQDNLRKSLGAYEPKQGCYRTLSLFRYRSRFFVGFNWCLLLVLELIVWAASAETQSLNSGWTDTAHGSGIIPMRTDLELDFSLPSSASYTYRRQLQNPANEQEKIPFHLQISKQVIHAEIQHLGHWMDGTFNLKTAFHCYGSCEKYAYPWQTAGCFIEKDYEYESGWGCNPPDCPGVGTGCTACGVYLDKLKSVGKAFKIVSLRYTRKACIQLGTEQTCKSVDSNDCLVTTSVKVCLIGTVSKFQPSDTLLFLGPLEQGGLIFKQWCTTTCQFGDPGDIMSTPVGMKCPELSGSFRKKCAFATTPVCQFDGNTLSGYKRMIATKDSFQSFNVTEPHISASSLEWIDPDSSLRDHINVIVGRDLSFQDLSETPCQVDLATTSIDGAWGSGVGFNLVCSVSLTECSTFLTSIKACDSAMCYGSTTANLLRGQNTVHIVGKGGHSGSKFMCCHDTKCSSTGLVAAAPHLDRVTGYNQADSDKIFDDGAPECGISCWFTKSGEWILGVLNGNWMVVAVLIALFIFSIFLFTLCCPRRPSYAKEHKP

SEQ ID NO: 1062 - protein, 1148 aa, Artificial Sequence
  derived and/or modified protein sequence (wt) from PUUV(CG17/Baskiria-2001)__AF442614.1__GP
MGELSPVCLYLLLQGLLLCNTGAARNLNELKMECPHTIGLGQGLVVGSVELPSLPIQQVETLKLESSCNFDLHTSTAGQQSFTKWTWEIKGDLAENTQASSTSFQTKSSEVNLRGLCLIPTLVVETAARMRKTIACYDLSCNQTVCQPTVYLMGPIQTCITTKSCLLSLGDQRIQVNYEKTYCVSGQLVEGICFNPIHTMALSQPSHTYDIMTMMVRCFLVIKKVTSGDSMKIEKNFETLVQKNGCTANNFQGYYICLIGSSSEPLYVPALDDYRSAEVLSRMAFAPHGEDHDIEKNAVSAMRIAGKVTGKAPSTESSDTVQGIAFSGSPLYTSTGVLTSKDDPVYIWAPGIIMEGNHSICEKKTLPLTWTGFISLPGEIEKTTQCTVFCTLAGPGADCEAYSETGIFNISSPTCLINRVQRFRGAEQQIKFVCQRVDMDITVYCNGMKKVILTKTLVIGQCIYTFTSIFSLIPGVAHSLAVELCVPGLHGWATMLLLLTFCFGWVLIPTITMILLKILIAFAYLCSKYNTDSKFRILIEKVKREYQKTMGSMVCEVCQYECETAKELESHRKSCSIGSCPYCLNPSEATTSALQAHFKVCKLTSRFQENLRKSLTVYEPMQGCYRTLSLFRYRSRFFVGLVWCVLLVLELIVWAASAETQNLNAGWTDTAHGSGIIPMKTDLELDFSLPSSASYTYRRQLQNPANEQEKIPFHLQLSKQVIHAEIQHLGHWMDATFNLKTAFHCYGSCEKYAYPWQTAGCFIEKDYEYETGWGCNPPDCPGVGTGCTACGVYLDKLKSVGKVFKIVSLRYTRKVCIQLGTEQTCKTVDSNDCLITTSVKVCLIGTISKFQPSDTLLFLGPLQQGGLIFKQWCTTTCQFGDPGDIMSTPTGMKCPELNGSFRKKCAFATTPVCQFDGNTISGYKRMIATKDSFQSFNVTEPHISTSALEWIDPDSSLRDHINVIVSRDLSFQDLSETPCQIDLATASIDGAWGSGVGFNLVCTVSLTECSAFLTSIKACDAAMCYGSTTANLVRGQNTIHIVGKGGHSGSKFMCCHDTKCSSTGLVAAAPHLDHVTGYNQADSDKIFDDGAPECGMSCWFKKSGEWILGVLNGNWMVVAVLVVLLILSILLFTLCCPRRPSYRKEHKP

SEQ ID NO: 1063 - protein, 1148 aa, Artificial Sequence
  derived and/or modified protein sequence (wt) from PUUV(CG215/Omsk)__AF442615.1__GP
MGKLSPVCLYLLLQCLLLGDRGDARNLNELKMECPHTIGLGQGLVVGSVELPPVPIQQVESLKLESSCNFDLHTSTAGQQSFTKWTWEIKNDLAENTQASSTSFQTKSSEVNLRGLCLIPTLVVETAARTRKTIACYDLTCNQTVCQPTVYLMGPIQTCVTTKSCLLGLGDQRIQVNYEKTYCVSGQLVEGVCFNPIHTMALSQPSHTYDVMTLMVRCFLIIKKVTSGDSMKIEKNFETLVQKTGCTGNNFQGYYICLIGSSSEPLYVPTLDDYRSAEVLSRMAFAPHGEDHDIEKNAVSTMRIAGKVTGRAPSTEASDTVQGIAFSGSPLYTSTGVLTAKDDPVYIWAPGIIMEGNHSSCDKKTLPLTWTGFISLPGEIEKTTQCTVFCTLAGPGADCEAYSETGIFNISSPTCLINRVQRFRGAEQQIKFVCQRVDMDIIVYCNGIKKVILTKTLVIGQCIYTFTSIFSLIPGVAHSLAVELCVPGLHGWTTMLLLLTFCFGWVLIPFITMILLKILIAFAYLCSKYNTDSKFRILVEKVKKEYQKTMGSMVCEVCQYECETAKELESHRKSCSIGSCPYCLNPSEATTSALQAHFKVCKLTSRFQENLRKSLTVYEPMQGCYRTLSLFRYRSKFFVGLVWCLLLVMELIVWAASAETQNLNSGWTDTAHGSGIIPMKTDLELDFSLPSSASYTYRRQLQNPANEQEKIPFHLQISKQVIHAEIQHLGHWMDATFNLKTAFHCYGSCEKYAYPWQTAGCFIEKDYEYETGWGCNPPDCPGVGTGCTACGVYLDKLKSVGKVFKIVSLKYTRKVCIQLGTEQTCKTVDSNDCLITTSVKVCMIGTISKFQPSDTLLFLGPLQQGGLIFKQWCTTTCQFGDPGDIMSTPTGMKCPELNGSFRKKCAFATTPVCQFDGNTISGYKRMIATKDSFQSFNVTEPHISASALEWIDPDSSLRDHINVVVGRDLSFQDLSETPCQVDLMTSTIDGAWGSGVGFNLVCTVSLTECSPFLTSIKACDSAMCYGSTTVNLVRGQNTVHIVGKGGHSGSKFMCCHDTKCSSTGLVAAAPHLDRVTGYNQADSDKIFDDGAPECGMSCWFKKSGEWILGVLNGNWMVVAVLIALLILSILMFTLCCPRRPSYRKEHKP

SEQ ID NO: 1064 - protein, 1148 aa, Artificial Sequence
  derived and/or modified protein sequence (wt) from PUUV(CG222/Omsk)__AF442616.1__GP
MGKLSPVCLYLLLQCLLLGDRGDARNLNELKMECPHTIGLGQGLVVGSVELPPVPIQQVESLKLESSCNFDLHTSTAGQQSFTKWTWEIKNDLAENTQASSTSFQTKSSEVNLRGLCLIPTLVVETAARTRKTIACYDLTCNQTVCQPTVYLMGPIQTCVTTKSCLLGLGDQRIQVNYEKTYCVSGQLVEGVCFNPIHTMALSQPSHTYDVMTLMVRCFLIIKKVTSGDSMKIEKNFETLVQKTGCTGNNFQGYYICLIGSSSEPLYVPTLDDYRSAEVLSRMAFAPHGEDHDIEKNAVSTMRIAGKVTGRAPSTEASDTVQGIAFSGSPLYTSTGVLTAKDDPVYIWAPGIIMEGNHSSCDKKTLPLTWTGFISLPGEIEKTTQCTVFCTLAGPRADCEAYSETGIFNISSPTCLINRVQRFRGAEQQIKFVCQRVDMDIIVYCNGIKKVILTKTLVIGQCIYTFTSIFSLIPGVAHSLAVELCVPGLHGWTTMLLLLTFCFGWVLIPFITMILLKILIAFAYLCSKYNTDSKFRILVEKVKKEYQKTMGSMVCEVCQYECETAKELESHRKSCSIGSCPYCLNPSEATTSALQAHFKVCKLTSRFQENLRKSLTVYEPMQGCYRTLSLFRYRSKFFVGLVWCLLLVMELIVWAASAETQNLNSGWTDTAHGSGIIPMKTDLELDFSLPSSASYTYRRQLQNPANEQEKIPFHLQISKQVIHAEIQHLGHWMDATFNLKTAFHCYGSCEKYAYPWQTAGCFIEKDYEYETGWGCNPPDCPGVGTGCTACGVYLDKLKSVGKVFKIVSLKYTRKVCIQLGTEQTCKTVDSNDCLITTSVKVCMIGTISKFQPSDTLLFLGPLQQGGLIFKQWCTTTCQFGDPGDIMSTPTGMKCPELNGSFRKKCAFATTPVCQFDGNTISGYKRMIATKDSFQSFNVTEPHISASALEWIDPDSSLRDHINVVVGRDLSFQDLSETPCQVDLMTSTIDGAWGSGVGFNLVCTVSLTECSAFLTSIKACDSAMCYGSTTVNLVRGQNTVHIVGKGGHSGSKFMCCHDTKCSSTGLVAAAPPLDRVTGYNQADSDKIFDDGAPECGMSCWFKKSGEWILGVLNGNWMVVAVLIALLILSILMFTLCCPRRPSYRKEHKP

SEQ ID NO: 1065 - protein, 1148 aa, Artificial Sequence
  derived and/or modified protein sequence (wt) from PUUV(CRF161)__AF367061.1__GP
MGKLSPVCLYLLLQCLLLGDRGDARNLNELKMECPHTIGLGQGLVVGSVELPPVPIQQVESLKLESSCNFDLHTSTAGQQSFTKWTWEIKNDLVENTQASSTSFQTKSSEVNLRGLCLIPTLVVETAARTRKTIACYDLTCNQTVCQPTVYLMGPIQTCITTKSCLLGLGDQRIQVNYEKTYCVSGQLVEGVCFNPIHTMALSQPSHTYDVMTLMVRCFLIIKKVTSGDSMKIEKNFETLVQKTGCTGNNFQGYYICLIGSSSEPLYVPTLDDYRSAEVLSRMAFAPHGEDHDIEKNAVSTMRIAGKVAGRAPSTEASDTVQGIAFSGSPLYTSTGVLTAKDDPVYIWAPGIIMEGNHSSCDKKTLPLTWTGFISLPGEIQKTTQCTVFCTLAGPRADCQAYSETGIFNISSPTCLINRVQRFRGAEQQIKFVCQRVDMDIIVYCNGIKKVILTKTLVIGQCIYTFTSIFSLIPGVAHSLAVELCVPGLHGWTTMLLLLTFCFGWVLIPFITMILLKILIAFAYLCSKYNTDSKFRILVEKVKKEYQKTMGSMVCEVCQYECETAKELESHRKSCSIGSCPYCLNPSEATTSALQAHFKVCKLTSRFQENLRKSLTVYEPMQGCYRTLSLFRYRSKFFVGLVWCLLLVMELIVWAASAETQNLNSGWTDTAHGSGIIPMKTDLELDFSLPSSASYTYRRQLQNPANEQEKIPFHLQISKQVIHAEIQHLGHWMDATFNLKTAFHCYGSCEKYAYPWQTAGCFIEKDYEYETGWGCNPPDCPGVGTGCTACGVYLDKLKSVGKVFKIVSLKYTRKVCIQLGTEQTCKTVDSNDCLITTSVKVCMIGTISKFQPSDTLLILGPLQQGGLIFKQWCTTTCQFGDPGDIMSTPTGMKCPELNGSFRKKCAFATTPVCQFDGNTISGYKRMIATKDSFQSFNVTEPHISASALEWIDPDSSLRDHINVVVGRDLSFQDLSETPCQVDLMTSTIDGAWGSGVGFNLVCTVSLTECSAFLTSIKACDSAMCYGSTTANLVKGQNTVHMVGKGGHSGSKFMCCHDTKCSSTGLVAAAPHLDRVTGYNQADSDKIFDDGAPECGMSCWFKKSGEWILGVLNGNWMVVAVLIALLILSILMFTLCCPRRPSYRKEHKP

SEQ ID NO: 1066 - protein, 1148 aa, Artificial Sequence
  derived and/or modified protein sequence (wt) from PUUV(CRF308/Omsk)__AF442617.1__GP
MGKLSPVCLYLLLQCLLLGDRGDARNLNELKMECPHTIGLGQGLVVGSVELPPVPIQQVESLKLESSCNFDLHTSTAGQQSFTKWTWEIKNDLAENTQASSTSFQTKSSEVNLRGLCLIPTLVVETAARTRKTIACYDLTCNQTVCQPTVYLMGPIQTCITTKSCLLGLGDQRIQVNYEKTYCVSGQLVEGVCFNPIHTMALSQPSHTYDVMTLMVRCFLIIKKVTSGDSMKIEKNFETLVQKTGCTGNNFQGYYICLIGSSSEPLYVPTLDDYRSAEVLSRMAFAPHGEDHDIEKNAVSTMRIAGKVAGRAPSTEASDTVQGIAFSGSPLYTSTGVLTAKDDPVYIWAPGIIMEGNHSSCDKKTLPLTWTGFISLPGEIEKTTQCTVFCTLAGPGADCEAYSETGIFNISSPTCLINRVQRFRGAEQQIKFVCQRVDMDIIVYCNGIKKVILTKTLVIGQCIYTFTSIFSLIPGIAHSLAVELCVPGLHGWTTMLLLLTFCFGWVLIPFITMILLKILIAFAYLCSKYNTDSKFRILVEKVKKEYQKTMGSMVCEVCQYECETAKELESHRKSCSIGSCPYCLNPSEATTSALQAHFKVCKLTSRFQENLRKSLTVYEPMQGCYRTLSLFRYRSKFFVGLVWCLLLVMELIVWAASAETQNLNSGWTDTAHGSGIIPMKTDLELDFSLPSSASYTYRRQLQNPANEQEKIPFHLQISKQVIHAEIQHLGHWMDATFNLKTAFHCYGSCEKYAYPWQTAGCFIEKDYEYETGWGCNPPDCPGVGTGCTACGVYLDKLKSVGKVFKIVSLKYTRKVCIQLGTEQTCKTVDSNDCLITTSVKVCMIGTISKFQPSDTLLFLGPLQQGGLIFKQWCTTTCQFGDPGDIMSTPTGMKCPELNGSFRKKCAFATTPVCQFDGNTISGYKRMIATKDSFQSFNVTEPHISASALEWIDPDSSLRDHINVVVGRDLSFQDLSETPCQVDLMTSTIDGAWGSGVGFNLVCTVSLTECSAFLTSIKACDSAMCYGSTTANLVRGQNTVHIVGKGGHSGSKFMCCHDTKCSSTGLVAAAPHLDRVTGYNQADSDKIFDDGAPECGMSCWFKKSGEWILGVLNGNWMVVAVLIALLILSILMFTLCCPRRPSYRKEHKP

SEQ ID NO: 1067 - protein, 1148 aa, Artificial Sequence
  derived and/or modified protein sequence (wt) from PUUV(Mu/07/1219)__KJ994777.1__GP
MEKIIPVCLYLPFLCLLLWSRGDTRNLNELKMECPHTIGLGQGLVIGSIELPPVPLIQVESLKLESSCNFDLHTSTSSQQAFTKWTWEVKSDLAENTQASSTSFQTKSSEVNLRGLCLVPPLVIETAARTRKTIACFDLSCNQTTCQPTVFLMGPIQTCITTKSCLLGLGDQRIQVNYEKTYCVSGQLIEGICFNPVHTMALSQPSHTYDIVTVMVRCFLIVKKVTTGDSMKIEKSFETLVQKTGCTDNGFQGYYVCLIGSSSEPLYIPTLDDYRSAEVLSRMAFAPHGEDHDIEKNAISAMRIVGKVTGKAPSTESSDTVQGIAFSGNPLYTSTGVLTAKDDPVYVWAPGIMMEGNHSVCEKKTLPLTWTGFIPLPGEIEKTTQCTVFCTLAGPGADCEAYSETGIFNISSPTCLINRVQRFRGAEQQIKFICQRVDMDITVYCNGLKKVILTKTLVIGQCIYTFTSIFSLIPGVAHSLAVELCVPGLHGWATMLLLLTFCFGWILIPFFAMILLKVLIALAYLCSKYNTDSKFKVLIEKVKKEYQKTMGSMVCEVCQYECETAKELESHRKSCPMGSCPYCLNPAEATTSALQAHFKVCKLTSRFQDNLRKSLGAYEPKQGCYRTLSLFRYRSRFFVGFIWCLLLVLELIVWAASAETQNLNSGWTDTAHGSGVIPMRTDLELDFSLPSSASYTYRRQLQNPANEQEKIPFHLQISKQVIHAEIQHLGHWMDGTFNLKTAFHCYGSCEKYAYPWQTAGCFVEKDYEYESGWGCNPADCPGVGTGCTACGVYLDKLKSVGKAFKIVSLRYTRKACIQLGTEQTCKNVDSNDCLVTTSVKVCLIGTVSKFQPSDTLLFLGPLEQGGLIFKQWCTTTCQFGDPGDIMSTPVGMKCPELSGSFRKKCAFATTPVCQFDGNTISGYKRMIATKDSFQSFNVTEPHISASSLEWIDPDSSLRDHINVIVGRDLSFQDLSETPCQVDLTTTSIDGAWGSGVGFNLICSVSLTECSTFLTSIKACDSAMCYGSTTANLVRGQNTVHIVGKGGHSGSKFMCCHDTKCSSTGLVAAAPHLDRVTGYNQADSDKIFDDGAPECGISCWFTKSGEWILGVLNGNWMVVAVLVALFILSIFLFTLCCPRRPSYAKEHKP

SEQ ID NO: 1068 - protein, 1148 aa, Artificial Sequence
  derived and/or modified protein sequence (wt) from PUUV(Puu/Kazan)__Z84205.1__GP
MGKLSPVCLYLLLQGLLLFNTGTARNLNELKMECPHTIGLGQGLVVGSVELPPVPIQQVETLKLESSCNFDLHTSTAGQQAFTKWTWEIKGDLAENTQASSTSFQTKSSEVNLRGLCLIPTLVIETAARMRKTIACYDLSCNQTVCQPTVYLMGPIQTCITTKSCLLGLGDQRIQVNYEKTYCVSGQLVEGVCFNPIHTMALSQPSHTYDIVTMMVRCFLVIKKVTSGDSMKIEKNFETLVQKNGCTANSFQGYYICLIGSSSEPLYVPTLDDYRSAEVLSRMAFAPHGEDHDVEKNAISALRIAGKVTGKAPSTESSDTVQGVAFSGSPLYTSTGVLTAKDDPVYIWAPGIIMEGNHSVCEKKTLPLTWTGFISLPGEIEKTTQCTVFCTLAGPGADCEAYSETGIFNISSPTCLINRVQRFRGAEQQIKFVCQRVDMDITVYCNGVKKVILTKTLVIGQCIYTFTSIFSLIPGVAHSLAVELCVPGLHGWATMLLLLTFCFGWVLIPTITMILLKILIAFAYLCSKYNTDSKFRILIEKVKKEYQKTMGSMVCEVCQYECETAKELESHRKSCSIGSCPYCLNPSEATTSALQAHFKVCKLTSRIQENLRKSLTVYEPMQGCYRTLSLFRYRSRFFVGLVWCVLLVLELIVWAASAETQNLNAGWTDTAHGSGIIPMKTDLELDFSLPSSASYTYRRQLQNPANEQENIPFHLQISKQVIHAEIQHLGHWMDATFNLKTAFHCYGSCEKYAYPWQTAGCFVEKDYEYETGWGCNPPDCPGVGTGCTACGAYLDKLKSVGKVFKIVSLRYTRKVCIQLGTEQTCKTVDSNDCLITTSVKVCLIGTISKFQPSDTLLFLGPLQQGGLIFKQWCTTTCQFGDPGDIMSTPTGMKCPDLNGSFRKKCAFATTPVCQFDGNTISGYKRMIATKDSFQSFNVTEPHISASALEWIDPDSSLRDHINVIVSRDLSFQDLSETPCQIDLSTASIDGAWGSGVGFNLVCTVSLTECSAFLTSIKACDAAMCYGSTTANLVRGQNTIHIVGKGGHSGSKFMCCHDTKCSTTGLVAAAPHLDRVTGYNQADSDKIFDDGAPECGMSCWFKKSGEWILGVLNGNWMVVAVLIALLILSILLFTLCCPRRPSYRKEHKP

SEQ ID NO: 1069 - protein, 1148 aa, Artificial Sequence
  derived and/or modified protein sequence (wt) from PUUV(PUUV/Ardennes/Mg156/2011)__KT247603.1__GP
MGKIIPVCLYLLFLCLLLWDRGDTRNLNELKMECPHTIGLGQGLVIGSVELPPVPLTQVESLKLESSCNFDLHTSTSSQQSFTKWTWEMKVDLAENTQASSTSFQTKSSEINLRGLCLVPPLVIETAARTRKTIACFDLSCNQTACQPTVFLIGPIQTCITTKSCLLGLGDQRIQVNYEKTYCVSGQLVEGICFNPVHTMALSQPSHTYDIVTVMVRCFLIVKKVSTGDSMKLEKSFETLVQKTGCTGNGFQGYYVCLIGSSSEPLYIPTLDDYRSAEVLSRMAFAPHGEDHDIEKNAISAMRIVGKVTGKAPSTESSDTVQGIAFSGNPLYTSTGVLTAKDDPIYIWAPGIIMEGNHSVCDKKTLPLTWTGFIPLPGEIEKTTQCTVFCTLAGPGADCEAYSETGIFNISSPTCLINRVQRFRGAEQQIKFICQRVDMDITVYCNGLKKVILTKTLVIGQCIYTFTSIFSLIPGVAHSLAVELCVPGLHGWATMLLLLTFCFGWILIPFFSMILLKILIAFAYLCSKYNTDSKFKILIEKVKKEYQKTMGSMVCEVCQYECETAKELESHRKSCPMGSCPYCLNPAEATTSALQAHFKVCKLTSRFQDNLRKSLGAYEPKQGCYRTLSLFRYRSRFFVGFIWCFLLVLELIVWAASAETQNLNSGWTDTAHGSGIIPMRTDLELDFSLPSSASYTYRRQLQNPANEQEKIPFHLQISKQVIHAEIQHLGHWMDGTFNLKTAFHCYGSCEKYAYPWQTAGCFVEKDYEYESGWGCNPPDCPGVGTGCTACGVYLDKLKSVGKAFKIVSLRYTRKACIQLGTEQTCKSVDSNDCLVTTSVKVCLIGTVSKFQPSDTLLFLGPLEQGGLIFKQWCTTTCQFGDPGDIMSTPVGMKCPELSGSFRKKCAFATTPVCQFDGNTLSGYKRMIATKDSFQSFNVTEPHISASSLEWIDPDSSLRDHINVIVGRDLSFQDLSETPCQVDLATSSIDGAWGSGVGFNLVCSVSLTECSTFLTSIKACDSAMCYGSTTANLLRGQNTVHIVGKGGHSGSKFMCCHDTKCSSTGLVAAAPHLDRVTGYNQADSDKIFDDGAPECGISCWFTKSGEWILGVLNGNWMVVAVLVALFILSIFLFTLCCPRRPSYAKEHKP

SEQ ID NO: 1070 - protein, 1148 aa, Artificial Sequence
  derived and/or modified protein sequence (wt) from PUUV(PUUV/Ardennes/Mg75/2011)__KT247602.1__GP
MGKIIPVCLYLLFLCLLLWDRGDTRNLNELKMECPHTIGLGQGLVIGSVELPPVPLTQVESLKLESSCNFDLHTSTSSQQSFTKWTWEMKVDLAENTQASSTSFQTKSSEINLRGLCLVPPLVIETAARTRKTIACFDLSCNQTACQPTVFLIGPIQTCITTKSCLLGLGDQRIQVNYEKTYCVSGQLVEGICFNPVHTMALSQPSHTYDIVTVMVRCFLIVKKVSTGDSMKLEKSFETLVQKTGCTGNGFQGYYVCLIGSSSEPLYIPTLDDYRSAEVLSRMAFAPHGEDHDIEKNAISAMRIVGKVTGKAPSTESSDTVQGIAFSGNPLYTSTGVLTAKDDPIYIWAPGIIMEGNHSVCDKKTLPLTWTGFIPLPGEIEKTTQCTVFCTLAGPGADCEAYSETGIFNISSPTCLINRVQRFRGAEQQIKFICQRVDMDITVYCNGLKKVILTKTLVIGQCIYTFTSIFSLIPGVAHSLAVELCVPGLHGWATMLLLLTFCFGWILIPFFSMILLKILIAFAYLCSKYNTDSKFKILIEKVKKEYQKTMGSMVCEVCQYECETAKELESHRKSCPMGSCPYCLNPAEATTSALQAHFKVCKLTSRFQDNLRKSLGAYEPKQGCYRTLSLFRYRSRFFVGFIWCFLLVLELIVWAASAETQNLNSGWTDTAHGSGIIPMRTDLELDFSLPSSASYTYRRQLQNPANEQEKIPFHLQISKQVIHAEIQHLGHWMDGTFNLKTAFHCYGSCEKYAYPWQTAGCFVEKDYEYESGWGCNPPDCPGVGTGCTACGVYLDKLKSVGKAFKIVSLRYTRKACIQLGTEQTCKSVDSNDCLVTTSVKVCLIGTVSKFQPSDTLLFLGPLEQGGLIFKQWCTTTCHFGDPGDIMSTPVSMKCPELSGSFRKKCAFATTPVCQFDGNTLSGYKRMIATKDSFQSFNVTEPHISASSLEWIDPDSSLRDHINVIVGRDLSFQDLSETPCQVDLATSSIDGAWGSGVGFNLVCSVSLTECSTFLTSIKACDSAMCYGSTTANLLRGQNTVHIVGKGGHSGSKFMCCHDTKCSSTGLVAAAPHLDRVTGYNQADSDKIFDDGAPECGISCWFTKSGEWILGVLNGNWMVVAVLVALFILSIFLFTLCCPRRPSYAKEHKP

SEQ ID NO: 1071 - protein, 1148 aa, Artificial Sequence
  derived and/or modified protein sequence (wt) from PUUV(PUUV/Jura/Mg2/2010)__KT247598.1__GP
MGKIIPVCLYLLFLCLLLWNRGDTRNLNELKMECPHTIGLGQGLVIGSVELPPVPLTQVESLKLESSCNFDLHTSTSSQQSFTKWTWEMKSDLAENTQASSTSFQTKSSEINLRGLCLVPPLVIETAARTRKTIACFDLSCNQTACQPTVFLIGPIQTCLTTKSCLLGLGDQRIQVNYEKTYCVSGQLVEGVCFNPIHTMALSQPSHTYDIVTVMVRCFLIVKKVSTGDSMKIEKSFETLVQKTGCTGNGFQGYYVCLIGSSSEPLYIPTLDDYRSAEVLSRMAFAPHGEDHDIEKNAISAMRIVGKVTGKAPSTESSDTVQGIAFSGNPLYTSTGVLTAKDDPIYIWAPGIIMEGNHSVCEKKTLPLTWTGFIPLPGEIEKTTQCTVFCTLAGPGADCEAYSETGIFNISSPTCLINRVQRFRGAEQQIKFICQRVDMDITVYCNGLKKVILTKTLVIGQCIYTFTSIFSLIPGVAHSLAVELCVPGLHGWATMLLLLTFCFGWILIPFTAMLLLKILIAFAYLCSKYNTDSKFKILIEKVKKEYQKTMGSMVCEVCQYECETAKELESHRKSCPMGSCPYCLNPAEATTSALQAHFKVCKLTSRFQDNLRKSLGAYEPKQGCYRTLSLFRYRSRFFVGLVWCFLLVLELIIWAASAETQNLNSGWTDTAHGSGVIPMRTDLELDFSLPSSASYTYRRQLQNPANEQEKIPFHLQISKQVIHAEIQHLGHWMDGTFNLKTAFHCYGSCEKYAYPWQTAGCFVEKDYEYESGWGCNPPDCPGVGTGCTACGVYLDKLKSVGKAFRIVSLKYTRKACIQLGTEQTCKSVDSNDCLVTTSVKVCLIGTVSKFQPSDTLLFLGPLEQGGLIFKQWCTTTCQFGDPRDIMSTPVGMRCPELSGSFRKKCAFATTPVCQFDGNTISGYKRMIATKDSFQSFNVTEPHISASSLEWIDPDSSLRDHINVIVGRDLSFQDLSETPCQVDLTTTSIDGAWGSGVGFNLICSVSLTECSTFLTSIKACDSAMCYGSTTANLMRGQNTIHIVGKGGHSGSKFMCCHDTKCSSTGLVAAAPHLDRVTGYNQADSDKIFDDGAPECGISCWFTKSGEWILGVLNGNWMVVAVLVVLFILSIFLFTLCCPRRPSYAKEHKP

SEQ ID NO: 1072 - protein, 1148 aa, Artificial Sequence
  derived and/or modified protein sequence (wt) from PUUV(PUUV/Jura/Mg214/2010)__KT247599.1__GP
MGKIIPVCLYLLFLCLLLWNRGDTRNLNELKMECPHTIGLGQGLVIGSVELPPVPLTQVESLKLESSCNFDLHTSTSSQQSFTKWTWEMKSDLAENTQASSTSFQTKSSEINLRGLCLVPPLVIETAARTRKTIACFDLSCNQTACQPTVFLIGPIQTCLTTKSCLLGLGDQRIQVNYEKTYCVSGQLVEGVCFNPIHTMALSQPSHTYDIVTVMVRCFLIVKKVSTGDSMKIEKSFETLVQKTGCTGNGFQGYYVCLIGSSSEPLYIPTLDDYRSAEVLSRMALAPHGEDHDIEKNAISAMRIVGKVTGKAPSTESSDTVQGIAFSGNPLYTSTGVLTAKDDPIYIWAPGIIMEGNHSVCEKKTLPLTWTGFIPLPGEIEKTTQCTVFCTLAGPGADCEAYSETGIFNISSPTCLINRVQRFRGAEQQIKFICQRVDMDITVYCNGLKKVILTKTLVIGQCIYTFTSIFSLIPGVAHSLAVELCVPGLHGWATMLLLLTFCFGWILIPFTAMLLLKILIAFAYLCSKYNTDSKFKILIEKVKKEYHKSMGSMVCEVCQYECETAKELESHRKSCPMGSCPYCLNPAEATTSALQAHFKVCKLTSRFQDNLRKSLGAYEPKQGCYRTLSLFRYRSRFFVGLVWCFLLVLELIIWAASAETQNLNSGWTDTAHGSGVIPMRTDLELDFSLPSSASYTYRRQLQNPANEQEKIPFHLQISKQVIHAEIQHLGHWMDGTFNLKTAFHCYGSCEKYAYPWQTAGCFVEKDYEYESGWGCNPPDCPGVGTGCTACGVYLDKLKSVGKAFRIVSLKYTRKACIQLGTEQTCKSVDSNDCLVTTSVKVCLIGTVSKFQPSDTLLFLGPLEQGGLIFKQWCTTTCQFGDPGDIMSTPVGMRCPELSGSFRKKCAFATTPVCQFDGNTISGYKRMIATKDSFQSFNVTEPHISASSLEWIDPDSSLRDHINVIVGRDLSFQDLSETPCQVDLTTTSIDGAWGSGVGFNLICSVSLTECSTFLTSIKACDSAMCYGSTTANLMRGQNTIHIVGKGGHSGSKFMCCHDTKCSSTGLVAAAPHLDRVTGYNQADSDKIFDDGAPECGISCWFTKSGEWILGVLNGNWMVVAVLVVLFILSIFLFTLCCPRRPSYAKEHKP

SEQ ID NO: 1073 - protein, 1148 aa, Artificial Sequence
  derived and/or modified protein sequence (wt) from PUUV(PUUV/Orleans/Mg23/2010)__KT247600.1__GP
MGKIIPVCLYLLFRCLLLWDRGNARNLNELKMECPHTIGLGQGLVIGSVELPPVPLTQIESLKLESSCNFDLHTSTSSQQSFTKWTWEIKSDLAENTQASSTSFQTKSSEVNLRGLCLVPPLVIETAARTRKTIACFDLSCNQTACQPTVFLIGPIQTCITTKSCLLGLGDQRIQVNYEKTYCVSGQLIEGICFNPVHTMALSQPSHTYDVVTVMVRCFLIVKKVSTGDSMKIEKSFETLVQKTGCTGNGFQGYYVCLIGSSSEPLYIPTLDDYRSAEVLSRMAFAPHGEDHDIEKNAISAMRIVGKVTGKAPSTEASDTVQGIAFSGNPLYTSTGVLTAKDDPIYIWAPGIIMEGNHSVCEKKTLPLTWTGFIPLPGEIEKTTQCTVFCTLAGPGADCEAYSETGIFNISSPTCLINRVQRFRGAEQQIKFICQRVDMDITVYCNGLKKVILTKTFIIGQCIYTFTSIFSLIPGVAHSLAVELCVPGLHGWATMLLLLTFCFGWVLIPFFSMILLKILIAFAYLCSKYNTDSKFRILIEKVKREYQKTMGSMVCEVCQYECETAKELESHRKSCPMGSCPYCLNPAEATTSALQAHFKVCKLTSRFQDNLRKSLGAYEPKQGCYRTLSLFRYRSRFFVGFIWCFLLVLELIIWAASAETQNLNSGWTDTAHGSGVIPMRTDLELDFSLPSSASYTYRRQLQNPANEQEKIPFHLQISKQVIHAEIQHLGHWMDGTFNLKTAFHCYGSCEKYAYPWQTAGCFIEKDYEYESGWGCNPPDCPGVGTGCTACGVYLDKLKSVGKAFKIVSLRYTRKACIQLGTEQTCKSVDSNDCLVTTSVKVCLIGTVSKFQPSDTLLFLGPLEQGGLIFKQWCTTTCHFGDPGDIMSTPAGMKCPELSGSFTKKCAFAPTPVCQFDGDTTSGYKKMIATKDSFQSFNVTEPHISASSLEWIDPDRSLRDHINVIVGRDLSFQDLSETPCQVDLTTTSIDGAWGSGVGFNLICSVSLTECSTFLTSIKACDSAMCYGSTTANLLRGQNTVHIVGKGGHSGSKFMCCHDTKCSSTGLVAAAPHLDRVTGYNQADSDKIFDDGAPECGISCWLTKSGEWILGVLNGNWMVVAVLVALFIFSIFLFTLCCPRRPSYAKEHKP

SEQ ID NO: 1074 - protein, 1148 aa, Artificial Sequence
  derived and/or modified protein sequence (wt) from PUUV(PUUV/Orleans/Mg29/2010)__KT247601.1__GP
MGKIIPVCLYLLFRCLLLWDRGNARNLNELKMECPHTIGLGQGLVIGSVELPPVPLTQIESLKLESSCNFDLHTSTSSQQSFTKWTWEIKSDLAENTQASSTSFQTKSSEVNLRGLCLVPPLVIETAARTRKTIACFDLSCNQTACQPTVFLIGPIQTCITTKSCLLGLGDQRIQVNYEKTYCVSGQLVEGVCFNPIHTMALSQPSHTYDIVTVMVRCFLIVKKVSTGDSMKIEKSFETLVQKTGCTGNGFQGYYVCLIGSSSEPLYIPTLDDYRSAEVLSRMAFAPHGEDHDIEKNAISAMRIVGKVTGKAPSTEASDTVQGIAFSGNPLYTSTGVLTAKDDPIYIWAPGIIMEGNHSVCEKKTLPLTWTGFIPLPGEIEKTTQCTVFCTLAGPGADCEAYSETGIFNISSPTCLINRVQRFRGAEQQIKFICQRVDMDITVYCNGLKKVILTKTFIIGQCIYTFTSIFSLIPGVAHSLAVELCVPGLHGWATMLLLLTFCFGWVLIPFFSMILLKILIAFAYLCSKYNTDSKFRILIEKVKREYQKTMGSMVCEVCQYECETAKELESHRKSCPMGSCPYCLNPAEATTSALQAHFKVCKLTSRFQDNLRKSLGAYEPKQGCYRTLSLFRYRSRFFVGFIWCFLLVLELIIWAASAETQNLNSGWTDTAHGSGVIPMRTDLELDFSLPSSASYTYRRQLQNPANEQEKIPFHLQISKQVIHAEIQHLGHWMDGTFNLKTAFHCYGSCEKYAYPWQTAGCFIEKDYEYESGWGCNPPDCPGVGTGCTACGVYLDKLKSVGKAFKIVSLRYTRKACIQLGTEQTCKSVDSNDCLVTTSVKVCLIGTVSKFQPSDTLLFLGPLEQGGLIFKQWCTTTCHFGDPGDIMSTPAGMKCPELSGSFRKKCAFAPTPVCHFDGKTISGYKRMIATKDSFQSFNVTEPHISASSLEWIDPDSSLRDHINVIVGRDLSFQDLSETPCQVDLTTTSIDGAWGSGVGFNLICSVSLTECSTFLTSIKACDSAMCYGSTTANLLRGQNTVHIVGKGGHSGSKFMCCHDTKCSSTGLVAAAPHLDRVTGYNQADSDKIFDDGAPECGISCWLTKSGEWILGVLNGNWMVVAVLVALFIFSIFLFTLCCPRRPSYAKEHKP

SEQ ID NO: 1075 - protein, 1148 aa, Artificial Sequence
  derived and/or modified protein sequence (wt) from PUUV(Vranica)__U14136.1__GP
MGKLSPVCLYLFLQCLLLWNRGSARNLNELKMECPHTIGLGQGLVIGSVELPPVPIQQVESLKLESSCNFDLHTSTATQQSFTKWTWEMKDDLAENTQASSTSFQTKSSEVNLRGLCLIPPLVVETASRTRKTIACFDISCNQTVCQPTVYLVGPIQTCITTKSCLLGLGDQRIQVNYEKTYCVSGQLIEGVCFNPVHTRALSQPSHTYDIVTMMVRCFLVVKKVTSGDSMKIEKNFETLVQKTDCNANGFQGYYICLVGSSSEPLYVPTLDDYRSAEVLSRMAFAPHGEDHDVERNAVSALRIVGKVTGKAPSTEASDTVQGIAFSGSPLYTSTGVLTAKDNPVYIWSPGIIMEGNHSVCEKKTLPLTWTGFIPLPGEIEKTPQCTVFCTLAGPGADCEAYSETGIFNISSPTCLLNRVQRFRGAEQQIKFVCQRVDMDITVYCNGMKKVILTKTLVIGQCIYTFTSIFSLIPGIAHSLAVELCVPGLHGWATVLLLLTFCFGWILIPFIAMILLKILIAFAYLCSKYNTDSKFKILIEKVKKEYQKTMGSMVCEVCQYECETAKELESHRKSCPIGSCPYCLNPSEATTSALQAHFKVCKLTSRFQDNLRKSLAAYEPKQGCYRTLSLFRYRSRFFVGFIWCILLVLELVIWAASAETQNLNSGWTDTAHGSGVVPMRTDLELDFSLPSSASYTYRRQLQNPANEHEKIPFHLQISKQVIHAEIQHLGHWMDATFNLKTAFHCYGLCEKYAYPWQTAGCFFEKDYEFESGWGCNPPDCPGIGTGCTACGVYLDKLKSVGKVFKIISLRYTRKACIQLGTEQTCKSVDSNDCLVTTSIKVCLIGTVSKFQPSDTLLFLGPLEQGGLIFKQWCTTTCQFGDPGDIMSTLTGMKCPELNGSFRKKCAFATTPVCQFDGNTISGYKRMMATKDSFQSFNVTEPHISTSALEWIDPDSSLRDHINVVVSRDLSFQDLSETPCQVDLTTSSIDGAWGSGVGFNLVCTVSLTECPTFLTSIKACDSAMCYGSTTTNLVRGQNTVHIVGKGGHSGSKFMCCHDTKCSSTGLIAAAPHLDRVTGFNQADSDKIFDDGAPGCGMSCWFKKSGEWILGVLNGNWLVVAVLIALFILSIFLFTLCCPRRPTYTKEHKP

SEQ ID NO: 1076 - protein, 1148 aa, Artificial Sequence
  derived and/or modified protein sequence (wt) from PUUV(CG1820/POR)__KT885051.1__GP
MGELSPVCLYLLLQGLLLCNTGAARNLNELKMECPHTIRLGQGLVVGSVELPSLPIQQVETLKLESSCNFDLHTSTAGQQSFTKWTWEIKGDLAENTQASSTSFQTKSSEVNLRGLCLIPTLVVETAARMRKTIACYDLSCNQTVCQPTVYLMGPIQTCITTKSCLLSLGDQRIQVNYEKTYCVSGQLVEGICFNPIHTMALSQPSHTYDIMTMMVRCFLVIKKVTSGDSMKIEKNFETLVQKNGCTANNFQGYYICLIGSSSEPLYVPALDDYRSAEVLSRMAFAPHGEDHDIEKNAVSAMRIAGKVTGKAPSTESSDTVQGIAFSGSPLYTSTGVLTSKDDPVYIWAPGIIMEGNHSICEKKTLPLTWTGFISLPGEIEKTTQCTVFCTLAGPGADCEAYSETGIFNISSPTCLINRVQRFRGSEQQIKFVCQRVDMDITVYCNGMKKVILTKTLVIGQCIYTFTSIFSLIPGVAHSLAVELCVPGLHGWATMLLLLTFCFGWVLIPTITMILLKILIAFAYLCSKYNTDSKFRILIEKVKREYQKTMGSMVCEVCQYECETAKELESHRKSCSIGSCPYCLNPSEATTSALQAHFKVCKLTSRFQENLRKSLTVYEPMQGCYRTLSLFRYRSRFFVGLVWCVLLVLELIVWAASAETQNLNAGWTDTAHGSGIIPMKTDLELDFSLPSSASYTYRRQLQNPANEQEKIPFHLQLSKQVIHAEIQHLGHWMDATFNLKTAFHCYGSCEKYAYPWQTAGCFIEKDYEYETGWGCNPPDCPGVGTGCTACGVYLDKLKSVGKVFKIVSLRYTRKVCIQLGTEQTCKTVDSNDCLITTSVKVCLIGTISKFQPSDTLLFLGPLQQGGLIFKQWCTTTCQFGDPGDIMSTPTGMKCPELNGSFRKKCAFATTPVCQFDGNTISGYKRMIATKDSFQSFNVTEPHISTSALEWIDPDSSLRDHINVIVSRDLSFQDLSETPCQIDLATASIDGAWGSGVGFNLVCTVSLTECSAFLTSIKACDAAMCYGSTTANLVRGQNTIHIVGKGGHSGSKFMCCHDTKCSSTGLVAAAPHLDRVTGYNQADSDKIFDDGAPECGMSCWFKKSGEWILGVLNGNWMVVAVLVVLLILSILLFTLCCPRRPSYRKEHKP

SEQ ID NO: 1077 - protein, 1148 aa, Artificial Sequence
  derived and/or modified protein sequence (wt) from PUUV(DTK/Ufa-97)__AB297666.2__GP
MGELSPVCLYLLLQGLLLCNTGAARNLNELKMECPHTVRLGQGLVVGSVELPSLPIQQVETLKLESSCNFDLHTSTAGQQSFTKWTWEIKGDLAENTQASSTSFQTKSSEVNLRGLCLIPTLVVETAARMRKTIACYDLSCNQTVCQPTVYLMGPIQTCITTKSCLLSLGDQRIQVNYEKTYCVSGQLVEGICFNPIHTMALSQPSHTYDIMTMMVRCFLVIKKVTSGDSMKIEKNFETLVQKNGCTANNFQGYYICLIGSSSEPLYVPALDDYRSAEVLSRMAFAPHGEDHDIEKNAVSAMRIAGKVTGKAPSTESSDTVQGIAFSGSPLYTSTGVLTSKDDPVYIWAPGIIMEGNHSICEKKTLPLTWTGFISLPGEIEKTTQCTVFCTLAGPGADCEAYSETGIFNISSPTCLINRVQRFRGSEQQIKFVCQRVDMDITVYCNGMKKVILTKTLVIGQCIYTFTSIFSLIPGVAHSLAVELCVPGLHGWATMLLLLTFCFGWVLIPTITMILLKILIAFAYLCSKYNTDSKFRILIEKVKREYQKTMGSMVCEVCQYECETAKELESHRKSCSIGSCPYCLNPSEATTSALQAHFKVCKLTSRFQENLRKSLTVYEPMQGCYRTLSLFRYRSRFFVGLVWCVLLVLELIVWAASAETQNLNAGWTDTAHGSGIIPMKTDLELDFSLPSSASYTYRRQLQNPANEQEKIPFHLQLSKQVIHAEIQHLGHWMDATFNLKTAFHCYGSCEKYAYPWQTAGCFIEKDYEYETGWGCNPPDCPGVGTGCTACGVYLDKLKSVGKVFKIVSLRYTRKVCIQLGTEQTCKTVDSNDCLITTSVKVCLIGTISKFQPSDTLLFLGPLQQGGLIFKQWCTTTCQFGDPGDIMSTPTGMKCPELNGSFRKKCAFATTPVCQFDGNTISGYKRMIATKDSFQSFNVTEPHISTSALEWIDPDSSLRDHINVIVSRDLSFQDLSETPCQIDLATASIDGAWGSGVGFNLVCTVSLTECSAFLTSIKACDAAMCYGSTTANLVRGQNTIHIVGKGGHSGSKFMCCHDTKCSSTGLVAAAPHLDRVTGYNQADSDKIFDDGAPECGMSCWFKKSGEWILGVLNGNWMVVAVLVVLLILSILLFTLCCPRRPSYRKEHKP

SEQ ID NO: 1078 - protein, 1148 aa, Artificial Sequence
  derived and/or modified protein sequence (wt) from PUUV(PUU/Cg-Erft)__AJ238778.1__GP
MGKIIPVCLYLLFLCLLLWNRGDARNLNELKIECPHTIGLGQGLVIGSVELPPVPLTQVESLKLESSCNFDLHTSTSSQQPFTKWTWEMKSDLAENTQASSTSFQTKSSEINLRGLCLVPPLVIETAARTRKTIACFDLSCNQTACQPTVFLIGPIQTCITTKSCLLGLGDQRIQVNYEKTYCVSGQLVEGVCFNPVHTMALSQPSHTYDIVTVMVRCFLIAKKVSTGDSMKLEKSFETLVQKTSCTGNGFQGYYICLVGSSSEPLYIPTLDDYRSAEVLSRMAFAPHGEDHDVEKNAISAMRIIGKVTGKAPSTESSDTIQGVAFSGNPLYTSTGVLTAKDDPVYIWAPGIIMEGNHSVCDKKTLPLTWTGFIPLPGEIEKTTQCTVFCTLAGPGADCEAYSETGIFNISSPTCLINRVQRFRGAEQQIKFICQRVDMDITVYCNGLKKVILTKTLIIGQCIYTFTSIFSLIPGVAHSLAVELCVPGLHGWATMLLLLTFCFGWILIPFFSMILLKILIAFAYLCSKYNTDSKFKILIEKVKKEYQKTMGSMVCEVCHYECETAKELESHRKSCPMGSCPYCLNPAEATTSALQAHFKVCKLTSRFQDNLRKSLGAYEPKQGCYRTLSLFRYRSRFFVGFIWCLLLVLELIVWAASAETQNLNSGWTDTAHGSGIIPMRTDLELDFSLPSSASYTYRRQLQNPANEQEKIPFHLQISKQVIHAEIQHLGHWMDGTFNLKTAFHCYGSCEKYAYPWQTAGCFIEKDYEYESGWGCNPPDCPGVGTGCTACGVYLDKLKSVGKAFKIVSLRYTRKACIQLGTEQTCKSVDSNDCLVTTSVKVCLIGTVSKFQPSDTLLFLGPLEQGGLIFKQWCTTTCQFGDPGDIMSTPVGMKCPELNGSFRKKCAFATTPVCQFDGNTLSGYKRMIATKDSFQSFNVTEPHISASSLEWIDPDSSLRDHINVIVGRDLSFQDLSETPCQVDLATTSIDGAWGSGVGFNLVCSVSLTECSTFLTSIKACDSAMCYGSTTANLLRGQNTVHIVGKGGHSGSKFMCCHDTKCSSTGLVAAAPHLDRVTGYNQADSDKIFDDGAPECGISCWFTKSGEWILGVLNGNWMVVAVLVALFILSIFLFTLCCPRRPSYAKEHKP

SEQ ID NO: 1079 - protein, 1148 aa, Artificial Sequence
  derived and/or modified protein sequence (wt) from PUUV(PUUV/Konnevesi/Mg_M105A/2005)__JQ319173.1__GP
MGKSSPVCLYLILQGLLLIGAVNARNLNELKMECPHTIGLGQGLVVGSVELPPVPIQQVESLKLESSCNFDLHTSTAGQQSFTKWTWETKSDLAENTQASSTSFQTKSSEVNLRGLCLIPTLVVETAARMRKTIACYDLSCNQTVCQPTVYLMGPIQTCLTTKSCLLGLGDQRIQVNYERTYCVSGQLVEGVCFNPIHTMALSQPSHTYDIVTVMVRCFLVIKKVTSGDSMKIEKNFETLVQKTGCTANSFQGYYICLVGSSSEPLYVPTLDDYRSAEVLSRMAFAPHGEDHDIEKNAISALRIAGKVTGKAPSTESSDTVQGIAFSGSPLYTSTGVLTAKDDPVYIWAPGIIMEGNHSVCEKKTLPLTWTGFIPLPGEIEKTTQCTVFCTLAGPGADCEAYSETGIFNISSPTCLINRVQRFRGAEQQIKFVCQRVDMDITVYCNGVKKVILTKTLVIGQCIYTFTSIFSLIPGIAHSLAVELCVPGLHGWATVLLLLTFCFGWVLIPTITMILLKILIAFAYLCSKYNTDSKFKILVEKVKKEYQKTMGSMVCEVCQYECETAKELESHRKSCSIGSCPYCLNPSEATPSALQAHFKVCKLTSRFQENLKKSLTMYEPMQGCYRTLSLFRYRSRFFVGLVWCMLLVLELIVWAASAETQNLNAGWTDTAHGSGIIPMKADLELDFSLPSSASYTYRRQLQNPANEQEKIPFHLQISKQVIHAEIQHLGHWMDATFNLKTAFHCYGSCEKYAYPWQTAGCFVEKDYEYETGWGCNPPDCPGVGTGCTACGVYLDKLKSVGKVFKIVSLRYTRKVCIQLGTEQTCKTVDSNDCLITTSVKVCLIGTISKFQPSDTLLFLGPLQQGGLIFKQWCTTTCQFGDPGDIMSTPTGMKCPELNGSFRKKCAFATTPVCQFDGNTISGYKRMIATKDSFQSFNVTEPHISTSALEWIDPDSSLRDHINVIVSRDLSFQDLSETPCQIDLTASAIDGAWGSGVGFNLVCTISLTECSTFLTSIKACDAAMCYGSTTTNLVRGQNTIHVVGKGGHSGSKFMCCHDTKCSSTGLVAAAPHLNRVTGFNQADSDKIFDDGAPECGVSCWFKKSGEWVLGVLNGNWMVVAVLIALLILSIFLFALCCPRRPSYKKEHKP

SEQ ID NO: 1080 - protein, 1148 aa, Artificial Sequence
  derived and/or modified protein sequence (wt) from PUUV(PUUV/Konnevesi/Mg_M114B/2005)__JQ319175.1__GP
MGKSSPVCLYLILQGLLLFGAVNARNLNELKMECPHTIGLGQGLVVGSVELPPVPIQQVESLKLESSCNFDLHTSTAGQQSFTKWTWEIKNDLAENTQASSTSFQTKSSEVNLRGLCLIPTLVVETAARMRKTIACYDLSCNQTVCQPTVYLMGPIQTCLTTKSCLLGLGDQRIQVNYERTYCVSGQLVEGVCFNPIHTMALSQPSHTYDIVTIMVRCFLVIKKVTSGDNMKIEKNFETLVQKTGCTANSFQGYYICLVGSSSEPLYVPTLDDYRSAEVLSRMAFAPHGEDHDIEKNAISALRIAGKVTGKAPSTESSDTVQGIAFSGSPLYTSTGVLTAKDDPVYIWAPGIIMEGNHSVCEKKTLPLTWTGFIPLPGEIEKTTQCTVFCTLAGPGADCEAYSETGIFNISSPTCLINRVQRFRGAEQQIKFVCQRVDMDITVYCNGVKKVILTKTLVIGQCIYTFTSIFSLIPGIAHSLAVELCVPGLHGWATVLLLLTFCFGWVLIPTITMILLKILIAFAYLCSKYNTDSKFKILVEKVKKEYQKTMGSMVCEVCQYECETAKELESHRKSCSIGSCPYCLNPSEATPSALQAHFKVCKLTSRFQENLKKSLTMYEPMQGCYRTLSLFRYRSRFFVGLVWCMLLVLELIVWAASAETQNLNAGWTDTAHGSGIIPMKADLELDFSLPSSASYTYRRQLQNPANEQEKIPFHLQISKQVIHAEIQHLGHWMDATFNLKTAFHCYGSCEKYAYPWQTAGCFVEKDYEYETGWGCNPPDCPGVGTGCTACGVYLDKLKSVGKVFKIVSLRYTRKVCIQLGTEQTCKTVDSNDCLITTSVKVCLIGTISKFQPSDTLLFLGPLQQGGLIFKQWCTTTCQFGDPGDIMSTPTGMKCPELNGSFRKKCAFATTPVCQFDGNTISGYKRMIATKDSFQSFNVTEPHISTSALEWIDPDSSLRDHINVIVSRDLSFQDLSETPCQIDLIASAIDGAWGSGVGFNLVCTVSLTECSTFLTSIKACDAAMCYGSTTINLIRGQNTIHVVGKGGHSGSKFMCCHDTKCSSTGLVAAAPHLDRVTGFNQADSDKIFDDGAPECGVSCWFKKSGEWVLGVLNGNWMVVAVLIALLILSIFLFALCCPRRPSYKKEHKP

SEQ ID NO: 1081 - protein, 1148 aa, Artificial Sequence
  derived and/or modified protein sequence (wt) from PUUV(PUUV/Konnevesi/Mg_M78B/2005)__JQ319174.1__GP
MGKSSPVCLYLILQGLLLFGAVNARNLNELKMECPHTIGLGQGLVVGSVELPPVPIQQVESLKLESSCNFDLHTSTAGQQSFTKWTWEIKNDLAENTQASSTSFQTKSSEVNLRGLCLIPTLVVETAARMRKTIACYDLSCNQTVCQPTVYLMGPIQTCLTTKSCLLGLGDQRIQVNYERTYCVSGQLVEGVCFNPIHTMALSQPSHTYDIVTIMVRCFLVIKKVTSGDNMKIEKNFETLVQKTGCTANGFQGYYICLVGSSSEPLYVPTLDDYRSAEVLSRMAFAPHGEDHDIEKNAISALRIAGKVTGKAPSTESSDTVQGIAFSGSPLYTSTGVLTAKDDPVYIWAPGIIMEGNHSVCEKKTLPLTWTGFIPLPGEIEKTTQCTVFCTLAGPGADCEAYSETGIFNISSPTCLINRVQRFRGAKQQIKFVCQRVDMDITVYCNGVKKVILTKTLVIGQCIYTFTSIFSLIPGIAHSLAVELCVPGLHGWATVLLLLTFCFGWVLIPTITMILLKILIAFAYLCSKYNTDSKFKILVEKVKKEYQKTMGSMVCEVCQYECETAKELESHRKSCSIGSCPYCLNPSEATPSALQAHFKVCKLTSRFQENLKKSLTMYEPMQGCYRTLSLFRYRSRFFVGLVWCMLLVLELIVWAASAETQNLNAGWTDTAHGSGIIPMKADLELDFSLPSSASYTYRRQLQNPANEQEKIPFHLQISKQVIHAEIQHLGHWMDATFNLKTAFHCYGSCEKYAYPWQTAGCFVEKDYEYETGWGCNPPDCPGVGTGCTACGVYLDKLKSVGKVFKIVSLRYTRKVCIQLGTEQTCKTVDSNDCLITTSVKVCLIGTISKFQPSDTLLFLGPLQQGGLIFKQWCTTTCQFGDPGDIMSTPTGMKCPELNGSFRKKCAFATTPVCQFDGNTISGYKRMIATKDSFQSFNVTEPHISTSALEWIDPDSSLRDHINVIVSRDLSFQDLSETPCQIDMTASAIDGAWGSGVGFNLVCTVSLTECSTFLTSIKACDAAMCYGSTTTNLVRGQNTIHVVGKGGHSGSKFMCCHDTKCSSKGLVAAAPHLDRVTGFNQADSDKIFDDGAPECGVSCWFKKSGEWVLGVLNGNWMVVAVLIALLILSIFLFALCCPRRPSYKKEHKP

SEQ ID NO: 1082 - protein, 1148 aa, Artificial Sequence
  derived and/or modified protein sequence (wt) from PUUV(PUUV/Konnevesi/Mg_O78A/2005)__JQ319172.1__GP
MGKSSPVCLYLILQGLLLFGAVNARNLNELKMECPHTIGLGQGLVVGSVELPPVPIQQVESLKLESSCNFDLHTSTAGQQSFTKWTWEIKSDLAENTQASSTSFQTKSSEVNLRGLCLIPTLVVETAARMRKTIACYDLSCNQTVCQPTVYLMGPIQTCLTTKSCLLGLGDQRIQVNYERTYCVSGQLVEGVCFNPIHTMALSQPSHTYDIVTIMVRCFLVIKKVTSGDSMKIEKNFETLVQKTGCTANSFQGYYICLVGSSSEPLYVPTLDDYRSAEVLSRMAFAPHGEDHDIEKNAISALRIAGKVTGKAPSTESSDTVQGIAFSGSPLYTSTGVLTAKDDPVYIWAPGIIMEGNHSVCEKKTLPLTWTGFIPLPGEIEKTTQCTVFCTLAGPGADCEAYSETGIFNISSPTCLINRVQRFRGAEQQIKFVCQRVDMDITVYCNGVKKVILTKTLVIGQCIYTFTSIFSLIPGIAHSLAVELCVPGLHGWATVLLLLTFCFGWVLIPTITMILLKILIAFAYLCSKYNTDSKFKILVEKVKKEYQKTMGSMVCEVCQYECETAKELESHRKSCSIGSCPYCLNPSEATPSALQAHFKVCKLTSRFQENLKKSLTMYEPMQGCYRTLSLFRYRSRFFVGLVWCMLLVLELIVWAASAETQNLNAGWTDTAHGSGIIPMKADLELDFSLPSSASYTYRRQLQNPANEQEKIPFHLQISKQVIHAEIQHLGHWMDATFNLKTAFHCYGSCEKYAYPWQTAGCFVEKDYEYETGWGCNPPDCPGVGTGCTACGVYLDKLKSVGKVFKIVSLRYTRKVCIQLGTEQTCKTVDSNDCLITTSVKVCLIGTISKFQPSDTLLFLGPLQQGGLIFKQWCTTTCQFGDPGDIMSTPTGMKCPELNGSFRKKCAFATTPVCQFDGNTISGYKRMIATKDSFQSFNVTEPHISTSALEWIDPDSSLRDHINVIVSRDLSFQDLSETPCQIDLTASAIDGAWGSGVGFNLVCTISLTECSTFLTSIKACDAAMCYGSTTTNLVRGQNTIHVVGKGGHSGSKFMCCHDTKCSSTGLVAAAPHLNRVTGFNQADSDKIFDDGAPECGVSCWFKKSGEWVLGVLNGNWMVVAVLIALLILSIFLFALCCPRRPSYKKEHKP

SEQ ID NO: 1083 - protein, 1148 aa, Artificial Sequence
  derived and/or modified protein sequence (wt) from PUUV(PUUV/Pieksamaki/human_kidney/2008)__JN831951.1__GP
MGKSSPVCLYLILQGLLLFGAVNARNLNELKMECPHTIGLGQGLVVGSVELPPVPIQQVESLKLESSCNFDLHTSTAGQQSFTKWTWEIKSDLAENTQASSTSFQTKSSEVNLRGLCLIPTLVVETAARMRKTIACYDLSCNQTVCQPTVYLMGPIQTCLTTKSCLLGLGDQRIQVNYERTYCVSGQLVEGVCFNPIHTMALSQPSHTYDVVTIMVRCFLVIKKVTSGDSMKIEKNFETLVQKTGCTANNFQGYYICLVGSSSEPLYVPTLDDYRSAEVLSRMAFAPHGEDHDIEKNAISALRIAGKVTGKAPSTESSDTVQGIAFSGSPLYTSTGVLTAKDDPVYIWAPGIIMEGNHSVCEKKTLPLTWTGFIPLPGEIEKTTQCTVFCTLAGPGADCEAYSETGIFNISSPTCLINRVQRFRGAEQQIKFVCQRVDMDITVYCNGVKKVILTKTLVIGQCIYTFTSIFSLIPGIAHSLAVELCVPGLHGWATVLLLLTFCFGWVLIPTITMILLKILIAFAYLCSKYNTDSKFKILVEKVKKEYQKTMGSMVCEVCQYECETAKELESHRKSCSIGSCPYCLNPSEATPSALQAHFKVCKLTSRFQENLKKSLTMYEPMQGCYRTLSLFRYRSRFFVGLVWCMLLVLELIVWAASAETQNLNAGWTDTAHGSGIIPMKADLELDFSLPSSASYTYRRQLQNPANEQEKIPFHLQISKQVIHAEIQHLGHWMDATFNLKTAFHCYGSCEKYAYPWQTAGCFVEKDYEYETGWGCNPPDCPGVGTGCTACGVYLDKLKSVGKVFKIVSLRYTRKVCIQLGTEQTCKTVDSNDCLITTSVKVCLIGTISKFQPSDTLLFLGPLQQGGLIFKQWCTTTCQFGDPGDIMSTPTGMKCPELNGSFRKKCAFATTPVCQFDGNTISGYKRMIATKDSFQSFNVTEPHISTSALEWIDPDSSLRDHINVIVSRDLSFQDLSETPCQIDLTASAIDGAWGSGVGFNLVCTISLTECSTFLTSIKACDAAMCYGSTTTNLVRGQNTIHVVGKGGHSGSKFMCCHDTKCSSTGLVAAAPHLDRVTGFNQADSDKIFDDGAPECGVSCWFRKSGEWVLGVLNGNWMVVAVLIALLILSIFLFALCCPRRPSYKKEHKP

SEQ ID NO: 1084 - protein, 1148 aa, Artificial Sequence
  derived and/or modified protein sequence (wt) from PUUV(Samara_49/CG/2005)__AB433850.2__GP
MGKLSPVCLYLLLQGLLLCKTGTARNLNELKMECPHTIGLGQGLVVGSVELPPVPIQQVETLKLESSCNFDLHTSTAGQQAFTKWTWEIKGDLAENTQASSTSFQTKSSEVNLRGLCLIPTLVIETAARMRKTIACYDLSCNQTVCQPTVYLMGPIQTCITTKSCLLGLGDQRIQVNYEKTYCVSGQLVEGVCFNPIHTMALSQPSHTYDIVTMMVRCFLVIKKVTSGDSMKIEKNFETLVQKNGCTANSFQGYYICLIGSSSEPLYVPTLDDYRSAEVLSRMAFAPHGEDHDVEKNAISALRIAGKVTGKAPSTESSDTVQGIAFSGSPLYTSTGVLTAKDDPVYIWAPGIIMEGNHSVCEKKTLPLTWTGFISLPGEIEKTTQCTVFCTLAGPGADCEAYSETGIFNISSPTCLINRVQRFRGAEQQIKFVCQRVDMDITVYCNGVKKVILTKTLVIGQCIYTFTSIFSLIPGVAHSLAVELCVPGLHGWATMLLLLTFCFGWVLIPTITMILLKILIAFAYLCSKYNTDSKFRILIEKVKREYQKTMGSMVCEVCQYECETAKELESHKKSCSIGSCPYCLNPSEATTSALQAHFKVCKLTSRFQENLRKSLTVYEPMQGCYRTLSLFRYRSRFFVGLVWCVLLVLELIVWAASAETQNLNAGWTDTAHGSGIIPMKTDLELDFSLPSSASYTYRRQLQNPANEQENIPFHLQISKQVIHAEIQHLGHWMDATFNLKTAFHCYGSCEKYAYPWQTAGCFVEKDYEYETGWGCNPPDCPGVGTGCTACGAYLDKLKSVGKVFKIVSLRYTRKVCIQLGTEQTCKTVDSNDCLITTSVKVCLIGTISKFQPSDTLLFLGPLQQGGLIFKQWCTTTCQFGDPGDIMSTPTGMKCPDLNGSFRKKCAFATTPVCQFDGNTISGYKRMIATKDSFQSFNVTEPHISASALEWIDPDSSLRDHINVIVSRDLSFQDLSETPCQIDLSTASIDGAWGSGVGFNLVCTVSLTECSAFLTSIKACDAAMCYGSTTANLIRGQNTIHIVGKGGHSGSKFMCCHDTKCSTTGLVAAAPHLDRVTGYNQADSDKIFDDGAPECGMSCWFKKSGEWILGVLNGNWMVVAVLIALLVLSILLFTLCCPRRPSYRKEHKP

SEQ ID NO: 1085 - protein, 1148 aa, Artificial Sequence
  derived and/or modified protein sequence (wt) from PUUV(Samara_94/CG/2005)__AB433852.2__GP
MGKLSPVCLYLLLQGLLLCNTGTARNLNELKIECPHTIGLGQGLVVGSVELPPVPIQQVETLKLESSCNFDLHTSTAGQQAFTKWTWEIKGDLAENTQASSTSFQTKSSEVNLRGLCLIPTLVIETAARMRKTIACYDLSCNQTVCQPTVYLMGPIQTCITTKSCLLGLGDQRIQVNYEKTYCVSGQLVEGVCFNPIHTMALSQPSHTYDIVTMMVRCFLIIKKVTSGDSMKIEKNFETLVQKNDCTANSFQGYYICFIGSSSEPLYVPTLDDYRSAEVLSRMAFAPHGEDHDVEKNAISALRIAGKVTGKAPSTESSDTVQGIAFSGSPLYTSTGVLAAKDDPVYIWAPGIIMEGNHSICEKKTLPLTWTGFISLPGEIEKTTQCTVFCTLAGPGADCEAYSETGIFNISSPTCLINRVQRFRGAEQQIKFVCQRVDMDITVYCNGVKKVILTKTLVIGQCIYTFTSIFSLIPGVAHSLAVELCVPGLHGWATMLLLLTFCFGWVLIPTITMILLKILIAFAYLCSKYNTDSKFRILIEKVKKEYQKTMGSMVCEVCQYECETAKELESHRKSCSIGSCPYCLNPSEATTSALQAHFKVCKLTSRFQENLRKSLTVYEPMQGCYRTLSLFRYRSRFFVGLVWCVLLVLELIVWAASAETQNLNAGWTDTAHGSGIIPMKTDLELDFSLPSSASYTYRRQLQNPANEQENIPFHLQISKQVIHAEIQHLGHWMDATFNLKTAFHCYGSCEKYAYPWQTAGCFVEKDYEYETGWGCNPPDCPGVGTGCTACGAYLDKLKSVGKVFKIVSLRYTRKVCIQLGTEQTCKTVDSNDCLITTSVKVCLIGTISKFQPSDTLLFLGPLQQGGLIFKQWCTTTCQFGDPGDIMSTPTGMKCPDLNGSFRKKCAFATTPVCQFDGNTISGYKRMIATKDSFQSFNVTEPHISASALEWIDPDSSLRDHINVIVSRDLSFQDLSETPCQIDLSTTSIDGAWGSGVGFNLVCTVSLTECSAFLTSIKACDAAMCYGSTTANLIRGQNTIHIVGKGGHSGSKFMCCHDTKCSTTGLVAAAPHLDRVTGYNQADSDKIFDDGAPECGMSCWFKKSGEWILGVLNGNWMVVAVLIALLVLSILLFTLCCPRRPSYRKEHKP

SEQ ID NO: 1086 - protein, 1148 aa, Artificial Sequence
  derived and/or modified protein sequence (wt) from PUUV(Sotkamo)__NC_005223.1__GP
MGKSSPVCLYLILQGLLLFDTVNAKNLNELKMECPHTIGLGQGLVVGSVELPPVPIQQIESLKLESSCNFDLHTSTAGQQSFTKWTWETKGDLAENTQASSTSFQTKSSEVNLRGLCLIPTLVVETAARMRKTIACYDLSCNQTVCQPTVYLMGPIQTCLTTKSCLLGLGDQRIQVNYERTYCVSGQLVEGVCFNPIHTMALSQPSHTYDIVTIMVRCFLVIKKVTSGDSMKIEKNFETLVQKTGCTANGFQGYYICLIGSSSEPLYVPTLDDYRSAEVLSRMAFAPHGEDHDIEKNAVSALRIAGKVTGKAPSTESSDTVQGIAFSGSPLYTSTGVLTAKDDPVYVWAPGIIMEGNHSVCEKKTLPLTWTGFIPLPGEIEKTTQCTVFCTLAGPGADCEAYSETGIFNISSPTCLINRVQRFRGAEQQIKFVCQRVDMDITVYCNGVKKVILTKTLVIGQCIYTFTSIFSMIPGIAHSLAVELCVPGLHGWATVLLLLTFCFGWVLIPTITMILLKILIAFAYLCSKYNTDSKFRILVEKVKKEYQKTMGSMVCEVCQYECETAKELESHRKSCSIGSCPYCLNPSEATPSALQAHFKVCKLTSRFQENLKKSLTMYEPMQGCYRTLSLFRYRSRFFVGLVWCMLLVLELIVWAASAETQNLNDGWTDTAHGSGIIPMKADLELDFSLPSSASYTYRRQLQNPANEQEKIPFHLQISKQVIHAEIQHLGHWMDATFNLKTAFHCYGSCEKYAYPWQTAGCFVEKDYEYETGWGCNPPDCPGVGTGCTACGVYLDKLKSVGKVFKIVSLRYTRKVCIQLGTGQTCKTVDSNDCLITTSVKVCLIGTISKFQPSDTLLFLGPLQQGGLIFKQWCTTTCQFGDPGDIMSTPTGMKCPELNGSFRKKCAFATTPVCQFDGNTISGYKRMVATKDSFQSFNVTEPHISTSALEWIDLDSSLRDHINVIVSRDLSFQDLSETPCQVDLTTSATDGAWGSGVGFNLVCTVSLTECSAFLTSIKACHAAMCYGSTTTNLVRGQNTIHVVGKGGHSGSKFMCCHDTKCSSTGLVAAAPHLDRVTGFNQADSDKIFDDGAPECGMSCWFKKLGEWVLGVLNGNWMVVAVLIALLILSIFLFALCCPRRPSYKKDHKP

SEQ ID NO: 1087 - protein, 1148 aa, Artificial Sequence
  derived and/or modified protein sequence (wt) from PUUV(2009)__HE801634.1__GP
MGKSSPVCLYLILQGLLLFDTVNARNLNELKMECPHTIGLGQGLVVGSVELPPVPIQQIESLKLESSCNFDLHTSTAGQQSFTKWTWETKGDLAENTQASSTSFQTKSSEVNLRGLCLIPTLVVETAARMRKTIACYDLSCNQTVCQPTVYLMGPIQTCLTTKSCLLGLGDQRIQVNYERTYCVSGQLVEGVCFNPIHTMALSQPSHTYDIVTIMVRCFLVIKKVTSGDSMKIEKNFETLVQKTGCTANGFQGYYICLIGSSSEPLYVPTLDDYRSAEVLSRMAFAPHGEDHDIEKNAVSALRIAGKVTGKAPSTESSDTVQGIAFSGSPLYTSTGVLTAKDDPVYVWAPGIIMEGNHSVCEKKTLPLTWTGFIPLPGEIEKTTQCTVFCTLAGPGADCEAYSETGIFNISSPTCLINRVQRFRGAEQQIKFVCQRVDMDITVYCNGVKKVILTKTLVIGQCIYTFTSIFSLIPGIAHSLAVELCVPGLHGWATVLLLLTFCFGWVLIPTITMILLKILIAFAYLCSKYNTDSKFKILVEKVKKEYQKTMGSMVCEVCQYECETAKELESHRKSCSIGSCPYCLNPSEATPSALQAHFKVCKLTSRFQENLKKSLTMYEPMQGCYRTLSLFRYRSRFFVGLVWCMLLVLELIVWAASAETQNLNAGWTDTAHGSGIIPMKADLELDFSLPSSASYTYRRQLQNPANEQEKIPFHLQISKQVIHAEIQHLGHWMDATFNLKTAFHCYGSCEKYAYPWQTAGCFVEKDYEYETGWGCNPPDCPGVGTGCTACGVYLDKLKSVGKVFKIVSLRYTRKVCIQLGTEQTCKTVDSNDCLITTSVKVCLIGTISKFQPSDTLLFLGPLQQGGLIFKQWCTTTCQFGDPGDIMSTPTGMKCPELNGSFRKKCAFATTPVCQFDGNTISGYKRMVATKDSFQSFNVTEPHISTSALEWIDPDSSLRDHINVIVSRDLSFQDLSETPCQVDLTTSAIDGAWGSGVGFNLVCTVSLTECSAFLTSIKACDAAMCYGSTTTNLVRGQNTIHVVGKGGHSGSKFMCCHDTKCSSTGLVAAAPHLDRVTGFNQADSDKIFDDGAPECGMSCWFKKLGEWVLGVLNGNWMVVAVLIALLILSIFLFALCCPRRPSYKKEHKP

SEQ ID NO: 1088 - protein, 1148 aa, Artificial Sequence
  derived and/or modified protein sequence (wt) from PUUV(Umea/hu)__AY526218.1__GP
MGKLSPVCLYLFLQCLLLWSRGSARNLNELKMECPHTIGLGQGLVIGSVELPPVPVQQVESLKLESSCNFDLHTSTATQQSFTKWTWEMKDDLAENTQASSTSFQTKSSEVNLRGLCLIPPLVVETASRTRKTIACFDISCNQTVCQPTVYLVGPIQTCITTKSCLLGLGDQRIQVNYEKTYCVSGQLVEGVCFNPVHTMVLSQPSHTYDIVTMMVRCFLVVKKVTSGDSMKIEKNLETLVQKTDCNANGFQGYYICLVGSSSEPLYVPTLDDYRSAEVLSRMAFAPHGEDHDIERNAVSALRIVGKVTGKAPSTEASDTIQGIAFSGSPLYTSTGVLTAKDNPVYVWSPGIIMEGNHSVCEKKTLPLTWTGFIPLPGEIGKTSQCTVFCTLAGPGADCEAYSETGIFNISSPTCLINRAQRFRGAEQQIKFVCQRVDMDITVYCNGMKKVILTKTLVIGQCIYTFTSIFSLIPGIAHSLAVELCVPGLHGWATVLLLLTFCFGWILIPFIAMISLKILIAFAYLCSKYNTDSKFKILIEKVKKEYQKTMGSMVCEVCQYECETAKELESHRKSCPIGSCPYCLNPSEATTSALQAHFKVCKLTSRVQDNLRKSLAAYEPKQGCYRTLSLFRYRSRFFVGFIWCILLVLELIIWAASAETQNLNSGWTDTAHGSGIIPMRTDLELDFSLPSSASYTYRRQLQNPANEHEKIPFHLQISKQVIHAEIQHLGHWMDATFNLKTAFHCYGSCEKYAYPWQTAGCFFEKDYEFESSWGCNPPDCPGVGTGCTACGVYLDKLKSVGKVFKIISLRYTRKACIQLGTEQTCKSVDSNDCLVTTSVKVCLIGTVSKFQPSDTLLFLGPLEQGGLIFKQWCTTTCQFGDPGDIMSTPTGMKCPELNGSFRKKCAFATTPVCQFDGNTISGYKRMIATKDSFQSFNVTDPHISTSALEWIDPDSSLRDHINVVVSRDLSFQDLSETPCQVDLTTSSIDGAWGSGVGFNLVCTVSLTECSTFLTSIKACDSAMCYGSTTINLMRGQNTVHIVGKGGHSGSKFMCCHDTKCSSTGLVAAAPHLDRVTGFNQADSDKIFDDGAPECGMSCWFKKSGEWILGVLNGNWLVVAVLVALFILSIFLFTLCCPRRPIYAKEHKP

SEQ ID NO: 1089 - protein, 1148 aa, Artificial Sequence
  derived and/or modified protein sequence (wt) from PUUV(P360)__L08755.1__GP
MGELSPVCLCLLLQGLLLCNTGAARNLNELKMECPHTIRLGQGLVVGSVELPSLPIQQVETLKLESSCNFDLHTSTAGQQSFTKWTWEIKGDLAENTQASSTSFQTKSSEVNLRGLCLIPTLVVETAARMRKTIACYDLSCNQTVCQPTVYLMGPIQTCITTKSCLLSLGDQRIQVNYEKTYCVSGQLVEGICFNPIHTMALSQPSHTYDIMTMMVRCFLVIKKVTSGDSMKIEKNFETLVQKNGCTANNFQGYYICLIGSSSEPLYVPALDDYRSAEVLSRMAFAPHGEDHDIEKNAVSAMRIAGKVTGKAPSTESSDTVQGIAFSGSPLYTSTGVLTSKDDPVYIWAPGIIMEGNHSICEKKTLPLTWTGFISLPGEIEKTTQCTVFCTLAGPGADCEAYSETGIFNISSPTCLINRVQRFRGSEQQIKFVCQRVDMDITVYCNGMKKVILTKTLVIGQCIYTFTSIFSLIPGVAHSLAVELCVPGLHGWATMLLLLTFCFGWVLIPTITMILLKILIAFAYLCSKYNTDSKFRILIEKVKREYQKTMGSMVCEVCQYECETAKELESHRKSCSIGSCPYCLNPSEATTSALQAHFKVCKLTSRFQENLRKSLTVYEPMQGCYRTLSLFRYRSRFFVGLVWCVLLVLELIVWAASAETQNLNAGWTDTAHGSGIIPMKTDLELDFSLPSSASYTYRRQLQNPANEQEKIPFHLQLSKQVIHAEIQHLGHWMDATFNLKTAFHCYGSCEKYAYPWQTAGCFIEKDYEYETGWGCNPPDCPGVGTGCTACGVYLDKLKSVGKVFKIVSLRYTRKVCIQLGTEQTCKTVDSNDCLITTSVKVCLIGTISKFQPSDTLLFLGPLQQGGLIFKQWCTTTCQFGDPGDIMSTPTGMKCPELNGSFRKKCAFATTPVCQFDGNTISGYKRMIATKDSFQSFNVTEPHISTSALEWIDPDSSLRDHINVIVSRDLSFQDLSETPCQIDLATASIDGAWGSGVGFNLVCTVSLTECSAFLTSIKACDAAMCYGSTTANLVRGQNTIHIVGKGGHSGSKFMCCHDTKCSSTGLVAAAPHLDRVTGYNQADSDKIFDDGAPECGMSCWFKKSGEWILGVLNGNWMVVAVLVVLLILSILLFTLCCPRRPSYRKEHKP

SEQ ID NO: 1090 - protein, 1148 aa, Artificial Sequence
  derived and/or modified protein sequence (wt) from MUV(11-1)__JX028272.1__GP
MGKISPVYLYLLFQGLLLWRDGLARNLNELKMECPHTIGLGQGLVIGSVELPPVPLRQVESLKLESSCNFDLHTSTATQQSFTKWIWESKNDLTDSTQASSTSYQTKSTEVNLKGLCLVPTLVIETAARTRKTIACFDLSCNQTVCQPTVYLIGPIQTCITTKSCLIGLGDQRIQVNYEKTYCVSGQLVEGVCFNPIHTMALSQPSHTYDVVTMMVRCFLVVKKVTSGDSMKIEKNFETLVQKTGCSNNNFQGYYVCLIGSSSEPLYVPTLDDYRSAEILSRMAFAPHGEDHDIERNAISAMRIVGKVTGKAPSSESSDTVQGVAFSGNPLYTSTGVLTSKDDPVYVWAPGIIMEGNHSVCDKKTLPLTWTGYIPLPGEIEKTTQCTVFCTLAGPGADCEAYSETGIFNISSPTCLINRVQRFRGAEQQIKFVCQRVDMDITVYCNGIKKVILTKTLVIGQCIYTFTSIFSLMPGVAHSLAVELCVPGLHGWATMLLLLTFCFGWILIPTITLILLKILLAFAYVCSKYNTDSKFKILIEKVKQEYQKTMGSMVCEVCQHECETAKELESHKKSCPIGSCPYCLNPAEATTSALQAHFKVCKLTSRFQENLRKSLTVYEPKQGCYRTLSLFRYRSRCFVGLIWCILLTLELIVWAASAETLNLNPGWTDTAHGSGIVPMKTDLELDFSLPSSASYTYRRSLQNPANEQEQVPFHLQIEKQVIHAEIQHLGHWMDATFNLKTAFHCYGACEKYAYPWQTAGCFVEKDFEFENGWGCNPPDCPGVGTGCTACGAYLDKLKSVGKVFKIVSLRYTRKACIQLGTEQTCKNVDSNDCLVTTSVKVCLIGTISKFQPSDTLLFLGPLEQGGIIFKQWCTTTCQFGDPGDIMSTPIGMKCPELNGSFRKKCSFATTPVCQFDGNTISGYKRMIATKDSFQSFNVTEPHISASALEWIDPDSSLRDHINVVVGRDLPFQDLSETPCQIDLSTSSIDGAWGSGVGFNLVCSVSLTECFTFLNSIKACDTAMCYGSTTANLVRGQNTVHVVGKGGHSGSKFMCCHDTKCSNTGLLAAAPHLDRVTGYNQADSDKVFDDGAPECGMTCWFKKSGEWIMGVLSGNWMVVAVLITLLVLSIFLFALCCPRRAAYKKEHKP

SEQ ID NO: 1091 - protein, 1148 aa, Artificial Sequence
  derived and/or modified protein sequence (wt) from MUV(11-4)__JX046483.1__GP
MGKISPVYLCLLLQGLLLWRDGLARNLNELKMECPHTIGLGQGLVIGSVELPPVPLRQVESLKLESSCNFDLHTSTATQQSFTKWIWESKNDLTDSTQASSTSYQTKSTEVNLKGLCLVPTLVIETAARTRKTIACFDLSCNQTVCQPTVYLIGPIQTCITTKSCLIGLGDQRIQVNYEKTYCVSGQLVEGVCFNPIHTMALSQPSHTYDVVTMMVRCFLVVKKVTSGDSMKIEKNFETLVQKTGCSNNNFQGYYVCLIGSSSEPLYVPTLDDYRSAEILSRMAFAPHGEDHDIERNAISAMRIVGKVTGKAPSSESSDTVQGIAFSGNPLYTSTGVLTSKDDPVYVWAPGIIMEGNHSVCDKKTLPLTWTGYIPLPGEIEKTTQCTVFCTLAGPGADCEAYSETGIFNISSPTCLINRVQRFRGAEQQIKFVCQRVDMDITVYCNGIKKVILTKTLVIGQCIYTFTSIFSLMPGVAHSLAVELCVPGLHGWATMLLLLTFCFGWILIPTITLILLKILLAFAYVCSKYNTDSKFKILIEKVKQEYQKTMGSMVCEVCQHECETAKELESHKKSCPIGSCPYCLNPAEATTSALQAHFKVCKLTSRFQENLRKSLTVYEPKQGCYRTLSLFRYRSRCFVGLIWCILLTLELIVWAASAETLNLNPGWTDTAHGSGIVPMRTDLELDFSLPSSASYTYRRSLQNPANEQEQIPFHLQIEKQVIHAEIQHLGHWMDATFNLKTAFHCYGACEKYAYPWQTAGCFVEKDFEFENGWGCNPPDCPGVGTGCTACGAYLDKLKSVGKVFKIVSLRYTRKACIQLGTEQTCKNVDSNDCLVTTSVKVCLIGTISKFQPSDTLLFLGPLEQGGIIFKQWCTTTCQFGDPGDIMSTPIGMKCPELNGSFRKKCSFATTPVCQFDGNTISGYKRMIATKDSFQSFNVTEPHISASALEWIDPDSSLRDHINVVVGRDLPFQDLSETPCQIDLSTSSIDGAWGSGVGFNLVCSVSLTECSTFLTSIKACDTAMCYGSTTANLVRGQNTVHVVGKGGHSGSKFVCCHDTKCSNTGLLAAAPHLDRVTGYNQADSDKVFDDGAPECGMTCWFKKSGEWIMGVLSGNWMVVAVLITLLVLSIFLFALCCPRRAAYKKEHKP

SEQ ID NO: 1092 - protein, 1148 aa, Artificial Sequence
  derived and/or modified protein sequence (wt) from MUV(11-5)__JX046486.1__GP
MGKISPVYLCLLLQGLLLWRDGLARNLNELKMECPHTIGLGQGLVIGSVELPPVPLRQVESLKLESSCNFDLHTSTATQQSFTKWIWESKNDLTDSTQASSTSYQTKSTEVNLKGLCLVPTLVIETAARTRKTIACFDLSCNQTVCQPTVYLIGPIQTCITTKSCLIGLGDQRIQVNYEKTYCVSGQLVEGVCFNPIHTMALSQPSHTYDVVTMMVRCFLVVKKVTSGDSMKIEKNFETLVQKTGCSNNNFQGYYVCLIGSSSEPLYVPTLDDYRSAEILSRMAFAPHGEDHDIERNAISAMRIVGKVTGKAPSSESSDTVQGIAFSGNPLYTSTGVLTSKDDPVYVWAPGIIMEGNHSVCDKKTLPLTWTGYIPLPGEIEKTTQCTVFCTLAGPGADCEAYSETGIFNISSPTCLINRVQRFRGAEQQIKFVCQRVDMDITVYCNGIKKVILTKTLVIGQCIYTFTSIFSLMPGVAHSLAVELCVPGLHGWATMLLLLTFCFGWILIPTITLILLKILLAFAYVCSKYNTDSKFKILIEKVKQEYQKTMGSMVCEVCQHECETAKELESHKKSCPIGSCPYCLNPAEATTSALQAHFKVCKLTSRFQENLRKSLTVYEPKQGCYRTLSLFRYRSRCFVGLIWCILLTLELVVWAASAETLNLNPGWTDTAHGSGIVPMRTDLELDFSLPSSASYTYRRSLQNPANEQEQIPFHLQIEKQVIHAEIQHLGHWMDATFNLKTAFHCYGACEKYAYPWQTAGCFVEKDFEFENGWGCNPPDCPGVGTGCTACGAYLDKLKSVGKVFKIVSLRYTRKACIQLGTEQTCKNVDSNDCLVTTSVKVCLIGTISKFQPSDTLLFLGPLEQGGIIFKQWCTTTCQFGDPGDIMSTPIGMKCPELNGSFRKKCSFATTPVCQFDGNTISGYKRMIATKDSFQSFNVTEPHISASALEWIDPDSSLRDHINVVVGRDLPFQDLSETPCQIDLSTSSIDGAWGSGVGFNLVCSVSLTECSTFLTSIKACDTAMCYGSTTANLVRGQNTVHVVGKGGHSGSKFVCCHDTKCSNTGLLAAAPHLDRVTGYNQADSDKVFDDGAPECGMTCWFKKSGEWIMGVLSGNWMVVAVLITLLVLSIFLFALCCPRRAAYKKEHKP

SEQ ID NO: 1093 - protein, 1135 aa, Artificial Sequence
  derived and/or modified protein sequence (wt) from SANGV(SA14)__NC_034516.1__GP
MIMWGLLLLAAITFPCQSLKNVYDMKIECPHSVNFGESSVMGKVQLPSLSITEAEQLVPESSCNMDNHQSLSVLQKATKTTWRKKADHSNAGKDSYELITSEIQFKGVCSLTHKMIEESHRLRRSVICYDLSCNTTHCKPTLYMVVPVHSCNMMKSCLIGLGPYRIQVVYERTYCTVGVLNEGKCFVPDQSVANIVKNGIFDIVSVQIICFFIRIKGSTYKILETVKTAMNGKCNGTDDKVQGYYICLLGGNSGPIYVPSGTDFRAMEALANMLRAPHGEDHDLPGEELASYSIAGTIEGKIPHTASSQNLEFTAYSGIPSYSSFSVHTLTQDGQLSYSPGLFPNLNQSDCKKNALPLIWEGTIELPGYYEAIHPCNVFCVFSGPGASCEAFSEGGIFNITSPTCLVSKQNRFRAAEQQITFVCQRVDMDIIIYCNGQRKVILTKTLVIGQCIYSITSLFSLLPSVAHSIAIELCVPGFHGWATAALLTTFCFGWLLIPSITYIVLLILKFIAAIFHNTTQENKFKAILRKIKEEFEKTKGSMVCDICKYECETGKELKAHNLSCNQSQCPYCFTHCEMTESAFQAHYKVCQATHRFREDLKKTITPQTISPGCYRTLNLFRYKSRCYILTVWLCLLILESIAWAASASETSLNPLWTDNAHGVGSVPMHTDLELDFSLPSSSKYTYKRKLTSPTNPEQAVSLHIEIESQGIAADVHSLGHWYDARLNLKTSFHCYGACTKYQYPWHTAKCHFEHDFQYENSWGCNPPDCPGVGTGCTACGLYLDQLKPVGSAYKLITVRYSRKVCVQFGEENLCKTIDMNDCFMSRHVKVCIIGTVSKFSQGDTLVFLGPLEGGGLIFKDWCTSTCQYGDPGDIMSPRDRGFSCPEFPGSFRKKCNFATTPVCEYSGNMVSGYKKVMATIDSFQSFNTSLIHFTEERIEWKDPDGMLRDHLNILVTKDIDFENLGENPCKVGLQTSSIEGAWGSGVGFTLVCQVSLIDCARFLTSIKACDMAICYGAQSVSLVRGQNTVKITGKGGHSGSSFKCCHEVDCSSTGLQASAPHLDKVNGISEQENDKVYDDGAPQCGVSCWFVKSGEWISGILHGNWVVVVVLVILLLFSLILLSILCPVRKHKRS

SEQ ID NO: 1094 - protein, 1135 aa, Artificial Sequence; identical to SEQ ID NO: 1093
  derived and/or modified protein sequence (wt) from SANGV(SA14)__NC_034516.1__GP

SEQ ID NO: 1095 - protein, 1133 aa, Artificial Sequence
  derived and/or modified protein sequence (wt) from SEOV(L99)__AF288298.1__GP
MWSLLLLAALVGQGFALKNVFDMRIQCPHSVNFGETSVSGYTELPPLSLQEAEQLVPESSCNMDNHQSLSTINKLTKVVWRKKANQELANQNSFEVVESEVSFKGLCMLKHRMVEESYRNRRSVICYDLACNSTFCKPTVYMIVPIHACNMMKSCLIGLGPYRIQVVYERTYCTTGILTEGKCFVPDKAVVSALKRGMYAIASIETICFFIHKKGNTYKIVTAITSAMGSKCNNTDTKVQGYYICIIGGNSAPVYAPAGEDFRAMEVFSGIITSPHGEDHDLPGEEIATYQISGQIEAKIPHTVSSKSLKLIAFAGIPSYSSTSILAASEDGRFIFSPGLFPNLNQSVCDNNALPLIWRGLIDLTGYYEAVHPCNVFCVLSGPGASCEAFSEGGIFNITSPMCLVSKQNRFRAAEQQISFICQRVDMDIIVYCNGQKKTILTKTLVIGQCIYTITSLFSLLPGVAHSIAIELCVPGFHGWATAALLITFCFGWVLIPACTLAILLVLKFFANILHTSNQENRFKAILRKIKEEFEKTKGSMVCEICKYECETLKELKAHNLSCVQGECPYCFTHCEPTETAIQAHYKVCQATHRFREDLKKTVTPKNIGPGCYRTLNLFRYKSRCYILTMWTLLLIIESILWAASAAEIPLVPLWTDNAHGVGSVPMHTDLELDFSLPSSSKYAYKRHLTNPVNDQQSVSLHIEIESQGIGADVHHLGHWYDARLNLKTSFHCYGACTKYQYPWHTAKCHFEKDYEYENSWACNPPDCPGVGTGCTACGLYLDQLKPVGTAFKIISVRYSRKVCVQFGEEYLCKTIDMNDCFVTRHAKICIIGTVSKFSQGDTLLFLGPMEGGGIIFKHWCTSTCHFGDPGDVMGPKDKPFSCPEFPGQFRKKCNFATTPICEYDGNIISGYKKVLATIDSFQSFNTSNIHFTDERIEWRDPDGMLRDHINIVISKDIDFENLAESPCKVGLQAANIEGAWGSGVGFTLTCQVSLTECPTFLTSIKACDMAICYGAESVTLSRGQNTVRITGKGGHSGSSFKCCHGKECSSTGLQASAPHLDKVNGISELENEKVYDDGAPECGVTCWFKKSGEWVMGIINGNWVVLIVLCVLLLFSLILLSILCPVRKHKKS

SEQ ID NO: 1096 - protein, 1133 aa, Artificial Sequence
  derived and/or modified protein sequence (wt) from SEOV(Rn10-134)__JF693883.2__GP
MWSLLLLAALVGQGFALKNVFDMRIQCPHSVNFGETSVSGYTELPPLSLQEAEQLVPESSCNMDNHQSLSTINKLTKVIWRKKANQESANQNSFEVVESEVSFKGLCMLKHRMVEESYRNRRSVICYDLACNSTFCKPTVYMIVPIHACNMMKSCLIGLGPYRIQVVYERTYCTTGILTEGKCFVPDKAVVSALKRGMYAIASIETICFFIHQKGNTYKIVTAITSAMGSKCNNTDTKVQGYYICIIGGNSAPVYAPAGEDFRAMEVFSGIITSPHGEDHDLPGEEIATYQISGQIEAKIPHTVSSKNLKLTAFAGIPSYSSTSILAASEDGRFIFSPGLFPNLNQSVCDNNALPLIWRGLIDLTGYYEAVHPCNVFCVLSGPGASCEAFSEGGIFNITSPMCLVSKQNRFRAAEQQISFVCQRVDMDIIVYCNGQKKTILTKTLVIGQCIYTITSLFSLLPGVAHSIAIELCVPGFHGWATAALLITFCFGWVLIPACTLAILLVLKFFANILHTSNQENRFKAILRKIKEEFEKTKGSMVCEICKYECETLKELKAHNLSCVQGECPYCFTHCEPTETAIQAHYKVCQATHRFREDLKKTVTPQNIGPGCYRTLNLFRYKSRCYILTMWTLLLIIESILWAASAVEIPLVPLWTDNAHGVGSVPMHTDLELDFSLPSSSRYTYKRHLTNPVNDQQSVSLHIEIESQGIGADVHHLGHWYDARLNLKTSFHCYGACTKYQYPWHTAKCHFEKDYEYENSWACNPPDCPGVGTGCTACGLYLDQLKPVGTAFKIISVRYSRKVCVQFGEEYLCKTIDMNDCFVTRHAKICIIGTVSKFSQGDTLLFLGPMEGGGIIFKHWCTSTCHFGDPGDVMGPKDKPFICPEFPGQFRKKCNFATTPVCEYDGNIISGYKKVLATIDSFQSFNTSNIHFTDERIEWRDPDGMLRDHINIVISKDIDFENLAENPCKVGLQAANIEGAWGSGVGFTLTCQVSLTECPTFLTSIKACDMAICYGAESVTLSRGQNTVKITGKGGHSGSSFKCCHGKECSLTGLQASAPHLDKVNGISELENEKVYDDGAPECGITCWFKKSGEWVMGIINGNWVVLIVLCVLLLFSLILLSILCPVRKHKKS

SEQ ID NO: 1097 - protein, 1133 aa, Artificial Sequence
  derived and/or modified protein sequence (wt) from SEOV(Gou3-e5)__AF288650.1__GP
MWGLLLLAALVGQGLALKNVFDMKIQCPHSVNFGETSVSGYTELPPLPLQEAEQLVPESSCNMDNHQSLSTINKLTKVIWRKKANQESASQNSFEVVENEVSFKGLCMLKHRMVEESYRNRRSVICYDLACNTTFCKPTVYMIVPIHACNMMKSCLIGLGPYRIQVIYERTYCTTGILTEGKCFVPDKAVVSALKRGMYAIASIETICFFVHQKGNTYKIVSAITSAMGSKCNNTDSKVQGYYICIIGGNSAPVYAPAGEDFRAMEVFSGIITSPHGEDHDLPGEEIATYQISGQIEAKIPHTVSSKNLKLTAFAGIPSYSSTSILAASEDGRFIFSPGLFPNLNQSVCDNNALPLIWRGLIDLTGYYEAIHPCNVFCVLSGPGASCEAFSEGGIFNITSPMCLVSKQNRFRAAEQQISFICQRVDMDIVVYCNGQKKTILTKTLVIGQCIYTITSLFSLLPGVAHSIAIELCVPGFHGWATAALLVTFCFGWVLIPACTLAVLLFLKFFANILHTSNQENRFKAILRKIKEEFEKTKGSMVCEICKYECETLKELKAHNLSCVQGECPYCFTHCEPTETAIQAHYKVCQATHRFREDLKKTVTPQNIGPGCYRTLNLFRYKSRCYILTMWILLLVIESILWAASAAEIPLVPLWTDNAHGVGSVPMHTDLELDFSLPSSSKYTYKRHLTNPVNDQQSVSLHIEIESQGIGADVHHLGHWYDARLNLKTSFHCYGACTKYQYPWHTAKCHFEKDYEYENSWACNPPDCPGVGTGCTGCGLYLDQLKPVGTAFKIISVRYSRKVCVQFGEEYLCKTIDMNDCFVTRHAKICIIGTVSKFSQGDTLLFLGPMEGGGIIFKHWCTSTCHFGDPGDVMGPKDKPFICPEFPGQFRKKCNFATTPVCEYDGNVISGYRKVLATIDSFQSFNTSNVHFTDERIEWKDPDGMLRDHINIVISKDIDFENLAENPCKVGLQAANIEGAWGSGVGFTLTCQVSLTECPTFLTSIKACDMAICYGAESVTLSRGQNTIKITGRGGHSGSSFKCCHGKECSANGLQASAPHLDKVNGISELENEKVYDDGAPECGITCWFKKSGEWVMGIINGNWVVLIVLCVLLLFSLILLSILCPVRKHKKS

SEQ ID NO: 1098 - protein, 1133 aa, Artificial Sequence
  derived and/or modified protein sequence (wt) from SEOV(China)__EU163437.1__GP
MWSLLLLAALVGQGFALKNVFDMRIQCPHSVKFGETSVSGYTELPPLSLQEAEQLVPESSCNMDNHQSLSTINKLTKVIWRKKANQESANQNSFEILESEVSFKGLCMLKHRMVEESYRNRRSVICYDLACNSTFCKPTVYMIVPIHACNIMKSCLIGLGPYRIQVVYERTYCTTGILTEGKCFVPDKAVVSALKRGMYAIASIETICFFIHQKGNKYKIVTAITSAMGSKCNNTDTKVQGYYICIIGGNSAPVYAPAGEDFRAMEVFSGIITSPHGEDHDLPGEEIATYQISGQIEAKIPHTVSSQNLKLTAFAGIPSYSSTSILAASEDGRFIFSPGLFPNLNQSVCDNNALPLIWRGLIDLTGYYEAVHPCNVFCVLSGPGASCEAFSEGGIFNITSPMCLVSKQNRFRAAEQQISFICQRVDMDIIVYCNGQKKTILTKTLVIGQCIYTITSLFSLLPGVAHSIAIELCVPGFHGWATAALLITFCFGWVLIPACTLAILLVLKFFANILQTSNQENRFKAILRKIKEEFEKTKGSMVCEICKYECETLKELKAHNLSCVQGECPYCFTHCEPTETAIQAHYKVCQATHRFREDLKKTVTPQNIGPGCYRTLNLFRYKSRCYILTMWTLLLIIESILWAASAAEIPLVPLWTDNAHGVGSVPMHTDLELDFSLPSSSKYTYKRHLTNPVNDQQSVSLHIEIESQGIGADVHHLGHCYDARLNLKTSFHCYGACTKYQYPWHTAKCHFEKDYEYENSWACNPPDCPGVGTGCTACGLYLDQLKPVGTAFKIISVRYSRKVCVQFGEEYLCKTIDMNDCFVTRHAKICIIGTVSKFSQGDTLLFLGPMEGGGIIFKHWCTSTCHFGDPGDVMGPKDKPFICPEFPGQFRKKCNFATTPVCEYDGNIISGYKKVLATIDSFQSFNRSYIHFTDERIEWRDPDGMLRDHINIVISKDIDFENLAENPCKVGLQAANIEGAWGLGVGFTLTCQVSLTECPTFLTSIKACDMAICYGAESVTLSRGQNTVKITGKGGHSGSSFKCCHGKECSSTGLQASAPHLDKVNGISELENEKVYDDGAPECGITCWFKKSGEWVMGIINGNWVVLIVLCVLLLFSLILLSILCPVRKHKKS

SEQ ID NO: 1099 - protein, 1133 aa, Artificial Sequence
  derived and/or modified protein sequence (wt) from SEOV(DPRK08)__JX853576.1__GP
MWSLLLLAALVGQGFALKNVFDMRIQCPHSVNFGETSVSGYTELPPLSLQEAEQLVPESSCNMDNHQSLSTINKLTKVIWRKKANQESANQNSFEVVESEVSFKGLCMLKHRMVEESYRNRRSVICYDLACNSTFCKPTVYMIVPIHACNMMKSCLIGLGPYRIQVVYERTYCTTGILTEGKCFVPDKAVVSALKRGMYAIASIETICFFIHQKGNTYKIVTAITSAMGSKCNNTDTKVQGYYICIIGGNSAPVYAPAGEDFRAMEVFSGIITSPHGEDHDLPGEEIATYQISGQIEAKIPHTVSSKNLKLTAFAGIPSYSSTSILAASEDGRFIFSPGLFPNLNQSVCDNNALPLIWRGLIDLTGYYEAVHPCNVFCVLSGPGASCEAFSEGGIFNITSPMCLVSKQNRFRAAEQQISFVCQRVDMDIIVYCNGQKKTILTKTLVIGQCIYTITSLFSLLPGVAHSIAIELCVPGFHGWATAALLITFCFGWVLIPACTLAILLVLKFFANILHTSNQENRFKAILRKIKEEFEKTKGSMVCEICKYECETLKELKAHNLSCVQGECPYCFTHCEPTETAIQAHYKVCQATHRFREDLKKTVTPQNIGPGCYRTLNLFRYKSRCYILTMWTLLLIIESILWAASAAEIPLVPIWTDNAHGVGSVPMHTDLELDFSLPSSSKYTYKRHLTNPVNDQQSVSLHIEIESQGIGADVHHLGHWYDARLNLKTSFHCYGACTKYQYPWHTAKCHFEKDYEYENSWACNPPDCPGVGTGCTACGLYLDQLKPVGTAFKIISVRYSRKVCMQFGEEYLCKTIDMNDCFVTRHAKICIIGTVSKFSQGDTLLFLGPMEGGGIIFKHWCTSTCHFGDPGDVMGPKDKPFICPEFPGQFRKKCNFATTPVCEYDGNIISGYKKVLATIDSFQSFNTSNIHFTDERIEWRDPDGMLRDHINIVISKDIDFENLAENPCKVGLQAANIEGAWGSGVGFTLTCQVSLTECPTFLTSIKACDMAICYGAESVTLSRGQNTVKITGKGGHSGSSFKCCHGKECSSTGLQASAPHLDKVNGISELENEKVYDDGAPECGVTCWFKKSGEWVMGIINGNWVVLIVLCVLLLFSLILLSILCPVRKHKKS

SEQ ID NO: 1100 - protein, 1133 aa, Artificial Sequence
  derived and/or modified protein sequence (wt) from SEOV(Fj372/2013)__KP645197.1__GP
MWSLLLLAALVGPGFALKNVFDMRIQCPHSVNFGETSVSGYTELPPLSLQEAEQLVPESSCNMDNHQSLSTINKLTKVIWQKKANQESANQNSFEVVESEVSFKGLCMLKHRMVEESYRNRRSVICYDLACNSTFCKPTVYMIVPIHACNMMKSCLIGLGPYRIQVVYERTYCTTGILTEGKCFVPDKAVVSALKRGMYAIASIETICFFIHQKGNTYKIVTAITSAMGSKCNNTDTKVQGYYICIIGGNSAPVYAPAGEDFRAMEVFSGIITSPHGEDHDLPGEEIATYQISGQIEAKIPHTVSSKNLKLTAFAGIPSYSSTSILAASEDGRFIFSPGLFPNLNQSVCDNNALPLIWRGLIDLTGYYEAVHPCNVFCVLSGPGASCEAFSEGGIFNITSPMCLVSKQNRFRAAEQQISFVCQRVDMDIIVYCNGQKKTILTKTLVIGQCIYTITSLFSLLPGVAHSIAIELCVPGFHGWATAALLITFCFGWVLIPACTLAILLVLKFFANILHTSNQENRFKAILRKIKEEFEKTKGSMVCEICKYECETLKELKAHNLSCVQGECPYCFTHCEPTETAIQAHYKVCQATHRFREDLKKTVTPQNIGPGCYRTLNLFRYKSRCYILTMWTLLLIIESILWAASAAEIPLVPLWTDNAHGVGSVPMHTDLELDFSLPSSSKYTYKRHLTNPVNDQQSVSLHIEIESQGIGADVHHLGHWYDARLNLKTSFHCYGACTKYQYPWHTAKCHFEKDYEYENSWACNPPDCPGVGTGCTACGLYLDQLKPVGTAFKIISVRYSRKVCVQFGEEYLCKTIDMNDCFVTRHAKICIIGTVSKFSQGDTLLFLGPMEGGGIIFKHWCTSTCHFGDPGDVMGPKDKPFICPEFPGQFRKKCNFATTPVCEYDGNIISGYKKVLATIDSFQSFNTSNIHFTDERIEWRDPDGMLRDHINIVISKDIDFENLAENPCKVGLQAANIEGAWGSGVGFTLTCQVSLTECPTFLTSIKACDMAICYGAESVTLSRGQNTVKITGKGGHSGSSFKCCHGKECSSTGLQASAPHLDKVNGISELENEKVYDDGAPECGITCWFKKSGEWVMGIINGNWVVLIVLCVLLLFSLILLSILCPVRKHKKS

SEQ ID NO: 1101 - protein, 1133 aa, Artificial Sequence
  derived and/or modified protein sequence (wt) from SEOV(HeB38)__JN377554.1__GP
MWSLLLLAALVGQGFALKNVFDMRIQCPHSVKFGETSVSGYTELPPLSLQEAEQLVPESSCNMDNHQSLSTINKLTKVIWQKKANQESANQNSFEVAESEVSFKGLCMLKHRMVEESYRNRRSVICYDLACNSTFCKPTVYMIVPIHACNMMKSCLIGLGPYRIQVVYERTYCTTGILTEGKCFVPDKAVVSALKRGMYAIASIETICFFIHQKGNTYKIVTAITSAMGSKCNNTDTKVQGYYICIIGGNSAPVYAPSGEDFRAMEVFSGIIMSPHGEDHDLPGEEIATYQISGQIEAKIPHTVSSKNLKLTAFAGIPSYSSTSILAASEDGRFIFSPGLFPNLNQSVCDNNALPLIWRGLIDLTGYYEAVHPCNVFCVLSGPGASCEAFSEGGIFNITSPMCLVSKQNRFRAAEQQISFVCQRVDMDIIVYCNGQKKTILTKTLVIGQCIYTITSLFSLLPGVAHSIAIELCVPGFHGWATAALLITFCFGWVLIPACTLAILLVLKFFANILHTSNQENRFKAILRKIKEEFEKTKGSMVCEICKYECETLKELKAHNLSCVQGECPYCFTHCEPTETAIQAHYKVCQATHRFREDLKKTVTPQNIGPGCYRTLNLFRYKSRCYILTMWTLLLIIESILWAASAAEIPLVPLWTDNAHGVGSVPMHTDLELDFSLPSSSKYTYKRHLTNPVNDQQSVSLHIEIESQGIGADVHHLGHWYDARLNLKTSFHCYGACTKYQYPWHTAKCHFEKDYEYENSWACNPPDCPGVGTGCTACGLYLDQLKPVGTAFKIISVRYSRKVCVQFGEEYLCKTIDMNDCFVTRHAKICIIGTVSKFSQGDTLLFLGPMEGGGIIFKHWCTSTCHFGDPGDVMGPKDKPFICPEFPGQFRKKCNFATTPVCEYDGNIISGYKKVLATIDSFQSFNTSNIHFTDERIEWRDPDGMLRDHINIVISKDIDFENLAENPCKVGLQAANIEGAWGSGVGFTLTCQVSLTECPTFLTSIKACDMAICYGAESVTLLRGQNTVKITGKGGHSGSSFKCCHGKECSSTGLQASAPHLDKVNGISELENEKVYDDGAPECGITCWFKKSGEWVMGIINGNWVVLIVLCVLLLFSLILLSILCPVRKHKKS

SEQ ID NO: 1102 - protein, 1133 aa, Artificial Sequence
  derived and/or modified protein sequence (wt) from SEOV(JiangxiXinjianRn-07-2011)__KP859513.1__GP
MWSLLLLAALVGQCFALKNVFDMRIQCPHSVNFGETSVSGYTELPPLSLQEAEQLVPESSCNMDNHQSLSTINKLTKVIWRKKANQESANQNSFEVVESEVSFKGLCMLKHRMVEESYRNRRSVICYDLACNSTFCKPTVYMIVPIHACNMMKSCLIGLGPYRIQVVYERTYCTTGILTEGKCFVPDKAVVSALKRGMYAIASIETICFFIHQKGNTYKIVTAITSAMGSKCNNTDTKVQGYYICIIGGNSAPVYAPAGEDFRAMEVFSGIITSPHGEDHDLPGEEIATYQISGQIEAKIPHTVSSKNLKLTAFAGIPSYSSTSILAASEDGRFIFSPGLFPNLNQSVCDNNALPLIWRGLIDLTGYYEAVHPCNVFCVLSGPGASCEAFSEGGIFNITSPMCLVSKQNRFRAAEQQISFVCQRVDMDIIVYCNGQKKTILTKTLVIGQCIYTITSLFSLLPGVAHSIAIELCVPGFHGWATAALLITFCFGWVLIPACTLAILLVLKFFANILHTSNQENRFKAILRKIKEEFEKTKGSMVCEICKYECETLKELKAHNLSCVQGECPYCFTHCEPTETAIQAHYKVCQATHRFREDLKKTVTPQNIGPGCYRTLNLFRYKSRCYILTMWTLLLIIESILWAASAAEIPLVPLWTDNAHGVGSVPMHTDLELDFSLPSSSKYTYKRHLTNPVNDQQSVSLHIEIESQGIGADVHHLGHWYDARLNLKTSFHCYGACTKYQYPWHTAKCHFEKDYEYENSWACNPPDCPGVGTGCTACGLYLDQLKPVGTAFKIISVRYSRKVCVQFGEEYFCKTIDMNDCFVTRHAKICIIGTVSKFSQGDTLLFLGPMEGGGIIFKHWCTSTCHFGDPGDVMGPKDKPFICPEFPGQFRKKCNFATTPVCEYDGNIISGYKKVLATIDSFQSFNTSNIHFTDERIEWRDPDGMLRDHINIVISKDIDFENLAENPCKVGLQAANIEGAWGSGVGFTLTCQVSLTECPTFLTSIKACDMAICYGAESVTLSRGQNTVKITGKGGHSGSSFKCCHGKECSSTGLQASAPHLDKVNGISELENEKVYDDGAPECGITCWFKKSGEWVMGIINGNWVVLIVLCVLLLFSLILLSILCPVRKHKKS

SEQ ID NO: 1103 - protein, 1133 aa, Artificial Sequence
  derived and/or modified protein sequence (wt) from SEOV(LYON/Rn/FRA/2013/LYO852)__KF387724.1__GP
MWSLLLLAALAGQGFALKNVFDMRIQCPHSVNFGETSVSGYTELPPLSLQEAEQLVPESSCNMDNHQSLSTINKLTKVIWRKKANQESASQNSFEVVESEVSFKGLCMLRHRMVEESYKNRRSVICYDLACNSTFCKPTVYMIVPIHACNMMKSCLIGLGPYRIQVVYERTYCTTGILTEGKCFVPDKAVVSALKRGMYAIASIETICFFIHQKGNTYKIVTAITSAMGSKCNNTDTKVQGYYICIIGGNSAPVYAPAGEDFRAMEVFSGIITSPHGEDHDLPGEEIATYQISGQIEAKIPHTVSSKNLKLTAFAGIPSYSSTSILAASEDGRFIFSPGLFPNLNQSVCDNNALPLIWRGLIDLTGYYEAVHPCNVFCVLSGPGASCEAFSEGGIFNITSPMCLVSKQNRFRAAEQQISFVCQRVDMDIIVYCNGQKKTILTKTLVIGQCIYTITSLFSLLPGVAHSIAIELCVPGFHGWATAALLITFCFGWVLIPACTLAILLVLKFFANILHTSNQENRFKAILRKIKEEFEKTKGSMVCEICKYECETLKELKAHNLSCVQGECPYCFTHCEPTETAIQAHYKVCQATHRFREDLKKTVTPQNIGPGCYRTLNLFRYKSRCYILTMWTLLLIIESILWAASAAEIPLVPLWTDNAHGVGSVPMHTDLELDFSLPSSSKYTYKRHLTNPVNDQQSVSLHIEIESQGIGADVHHLGHWYDARLNLKTSFHCYGACTKYQYPWHTAKCHFEKDYEYENSWACNPPDCPGVGTGCTACGLYLDQLKPVGTAFKIISVRYSRKVCVQFGEEYLCKTIDMNDCFVTRHAKICIIGTVSKFSQGDTLLFLGPMEGGGIIFKHWCTSTCHFGDPGDVMGPKDKPFICPEFPGQFRKKCNFATTPVCEYDGNIISGYKKVLATIDSFQSFNTSNIHFTDERIEWRDPDGMLRDHINIIISKDIDFENLAENPCKVGLQAANIEGAWGSGVGFTLTCQVSLTECPTFLTSIKACDMAICYGAESVTLSRGQNTVKITGKGGHSGSSFKCCHGKECSLTGLQASAPHLDKVNGISELENEKVYDDGAPECGITCWFKKSGEWVMGIINGNWVVLIVLCVFLLFSLILLSILCPVRKHKKS

SEQ ID NO: 1104 - protein, 1133 aa, Artificial Sequence
  derived and/or modified protein sequence (wt) from SEOV(Seoul-Baxter/NYC-D1_M)__KJ950863.1__GP
MWSLLLLAALVGQGFALKNVFDMKIQCPHSVNFGETSVSGYTELPPLSLQEAEQLVPESSCNMDNHQSLSTINKLTKVIWRKKANQESANQNSFEVAESEVSFKGLCMLKHRMVEESYRNRRSVICYDLACNSTFCKPTVYMIVPIHACNMMKSCLIGLGPYRIQVVYERTYCTTGILTEGKCFVPDKAVVSALKRGMYAIASIETICFFIHQKGNTYKIVTAITSAMGSKCNDTDTKVQGYYICIIGGNSAPVYAPAGEDFRAMEVFSGIITSPHGEDHDLPGEEIATYQISGQIEAKIPHTVSSKNLKLTAFAGIPSYSSTSILAASEDGRFIFSPGLFPNLNQSVCDNNALPLVWRGLIDLTGYYEAVHPCNVFCVLSGPGASCEAFSEGGIFNITSPMCLVSKQNRFRAAEQQISFVCQRVDMDIIVYCNGQKKTILTKTLVIGQCIYTITSLFSLLPGVAHSIAIELCVPGFHGWATAALLITFCFGWVLIPACTLAILLVLKFFANILHTSNQENRFKAILRKIKEEFEKTKGSMVCEICKYECETLKELKAHNLSCVQGECPYCFTHCEPTETAIQAHYKVCQATHRFREDLKKTVTPQNIGPGCYRTLNLFRYKSRCYILTMWTLLLIIESILWAASAAEIPLVPLWTDNAHGVGSVPMHTDLELDFSLPSSSKYTYKRHLTNPVNDQQSVSLHIEIESQGIGADVHHLGHWYDARLNLKTSFHCYGACTKYQYPWHTAKCHFEKDYEYENSWACNPPDCPGVGTGCTACGLYLDQLKPVGTAFKIISVRYSRKVCLQFGEEYLCKTIDMNDCFVTRHVKICIIGTVSKFSQGDTLLFLGPMEGGGIIFKHWCTSTCHFGDPGDVMGPKDKPFICPEFPGQFRKKCNFATTPVCEYDGNIISGYKKVLATIDSFQSFNTSNIHFTDERIEWRDPDGMLRDHINIVISKDIDFENLAENPCKVGLQAANIEGAWGSGVGFTLTCQVSLTECPTFLTSIKACDMAICYGAESVTLSRGQNTVKITGKGGHSGSSFKCCHGKECSSTGLQASAPHLDKVNGISELENEKVYDDGAPECGITCWFKKSGEWVMGIINGNWVVLIVLCVLLLFSLILLSILCPVRKHKKS

SEQ ID NO: 1105 - protein, 1133 aa, Artificial Sequence
  derived and/or modified protein sequence (wt) from SEOV(Singapore/06(RN41))__GQ274942.1__GP
MWSLLLLAALAGQGFALKNVFDMRIQCPHSVNFGETSVSGYTELPPLSLQEAEQLVPESSCNMDNHQSLSTINKLTKVIWRKKANQESASQNSFEVVESEISFKGLCMLKHRMVEESYRNRRSVICYDLACNSTFCKPTVYMIVPIHACNMMKSCLIGLGPYRIQVVYERTYCTTGILTEGKCFVPDKAVVSALKRGMYAIASIETICFFIHQKGNTYKIVTAITSAMGSKCNNTDTKVQGYYICIIGGNSAPVYAPAGEDFRAMEVFSGIITSPHGEDHDLPGEEIATYQISGQIEAKIPHTVSSKNLKLTAFAGIPSYSSTSILAASEDGRFIFSPGLFPNLNQSVCDNNALPLIWRGLIDLTGYYEAVHPCNVFCVLSGPGASCEAFSEGGIFNITSPMCLVSKQNRFRAAEQQISFVCQRVDMDIIVYCNGQKKTILTKTLVIGQCIYTITSLFSLLPGVAHSIAIELCVPGFHGWATAALLITFCFGWVLIPACTLAILLVLKFFANILHTSNQENRFKAILRKIKEEFEKTKGSMVCEICKYECETLKELKAHNLSCVQGECPYCFTHCEPTETAIQAHYKVCQATHRFREDLKKTVTPQNIGPGCYRTLNLFRYKSRCYILTMWTLLLIIESILWAASAAEIPLVPLWTDNAHGVGSVPMHTDLELDFSLPSSSKYTYKRHLTNPVNDQQSVSLHIEIESQGIGADVHHLGHWYDARLNLKTSFHCYGACTKYQYPWHTAKCHFEKDYEYENSWACNPPDCPGVGTGCTACGLYLDQLKPVGTAFKIISVRYSRKVCVQFGEEYLCKTIDMNDCFVTRHAKICIIGTVSKFSQGDTLLFLGPMEGGGIIFKHWCTSTCHFGDPGDVMGPKDKPFICPEFPGQFRKKCNFATTPVCEYDGNIISGYKKVLATIDSFQSFNTSNIHFTDERIEWRDPDGMLRDHINIVISKDIDFENLAENPCKVGLQAANIEGAWGSGVGFTLTCQVSLTECPTFLTSIKACDMAICYGAESVTLSRGQNTVKITGKGGHSGSSFKCCHGKECSSTGLQASAPHLDKVNGISELENEKVYDDGAPECGITCWFKKSGEWVMGIINGNWVVLIVLCVLLLFSLILLSILCPVRKHKKS

SEQ ID NO: 1106 - protein, 1133 aa, Artificial Sequence
  derived and/or modified protein sequence (wt) from SEOV(11CSG)__AB618131.1__GP
MWSLLLLAALAGQGFALKNVFDMRIQCPHSVNFGETSVSGYTELPPLSLQEAEQLVPESSCNMDNHQSLSTINKLTKVIWRKKANQESASQNSFEVVESEVSFKGLCMLKHRMVEESYRNRRSVICYDLACNSTFCKPTVYMIVPIHACNMMKSCLIGLGPYRIQVVYERTYCTTGILTEGKCFVPDKAVVSALKRGMYAIASIETICFFVHQKGNTYKIVTAITSAMGSKCNNTDTKVQGYYICIIGGNSAPVYAPAGEDFRAMEVFSGIITSPHGEDHDLPGEEIATYQISGQIEAKFPHTVSSKNLKLTAFAGIPSYSSTSILAASEDGRFIFSPGLFPNLNQSVCDNNALPLIWRGLIDLTGYYEAVHPCNVFCVLSGPGASCEAFSEGGIFNITSPMCLVSKQNRFRAAEQQISFVCQRVDMDIIVYCNGQKKTILTKTLVIGQCIYTITSLFSLLPGVAHSIAIELCVPGFHGWATAALLITFCFGWVLIPACTLAILLVLKFFANILHTSNQENRFKAILRKIKEEFEKTKGSMVCEICKYECETLKELKAHNLSCVQGECPYCFTHCEPTETAIQAHYKVCQATHRFREDLKKTVTPQNIGPGCYRTLNLFRYKSRCYILTMWTLLLIIESILWAASAAEIPLVPLWTDNAHGVGSVPMHTDLELDFSLPSSSKYTYKRHLTNPVNDQQSVSLHIEIESQGIGADVHHLGHWYDARLNLKTSFHCYGACTKYQYPWHTAKCHFEKDYEYENSWACNPPDCPGVGTGCTACGLYLDQLKPVGTAFKIISVRYSRKVCVQFGEEYLCKTIDMNDCFVTRHAKICIIGTVSKFSQGDTLLFLGPMEGGGIIFKHWCTSTCHFGDPGDVMGPKDKPFICPEFPGQFRKKCNFATTPVCEYDGNTISGYKKVLATIDSFQSFNTSNIHFTDERIEWRDPDGMLRDHINIVISKDIDFENLAENPCKVGLQAANIEGAWGSGVGFTLTCQVSLTECPTFLTSIKACDMAICYGAESVTLSRGQNTVKITGKGGHSGSSFKCCHGKECSSTGLQASAPHLDKVNGISELENEKVYDDGAPECGITCWFKKSGEWVMGIINGNWIVLIVLCVLLLFSLILLSILCPVRKHKKS

SEQ ID NO: 1107 - protein, 1133 aa, Artificial Sequence
  derived and/or modified protein sequence (wt) from SEOV(5CSG)__AB618130.1__GP
MWSLLLLAALAGQGFALKNVFDMRIQCPHSVNFGETSVSGYTELPPLSLQEAEQLVPESSCNMDNHQSLSTINKLTKVIWRKKANQESASQNSFEVVESEVSFKGLCMLKHRMVEESYRNRRSVICYDLACNSTFCKPTVYMIVPIHACNMMKSCLIGLGPYRIQVVYERTYCTTGILTEGKCFVPDKAVVSALKRGMYAIASIETICFFIHQKGNTYKIVTAITSAMGSKCNNTDTKVQGYYICIIGGNSAPVYAPAGEDFRAMEVFSGIITSPHGEDHDLPGEEIATYQISGQIEAKIPHTVSSKNLKLTAFAGIPSYSSTSILAASEDGRFIFSPGLFPNLNQSVCDNNALPLIWRGLIDLTGYYEAIHPCNVFCVLSGPGASCEAFSEGGIFNITSPMCLVSKQNRFRAAEQQISFVCQRVDMDIIVYCNGQKKTILTKTLVIGQCIYTITSLFSLLPGVAHSIAIELCVPGFHGWATAALLITFCFGWVLIPACTLAILLVLKFFANILHTSNQENRFKAILRKIKEEFEKTKGSMVCEICKYECETLKELKAHNLSCVQGECPYCFTHCEPTETAIQAHYKVCQATHRFREDLKKTVTPQNIGPGCYRTLNLFRYKSRCYILTMWTLLLIIESILWAASAAEIPLVPLWTDNAHGVGSVPMHTDLELDFSLPSSSKYTYKRHLTNPVNDQQSVSVHIEIESQGIGADVHHLGHWYDARLNLKTSFHCYGACTKYQYPWHTAKCHFEKDYEYENSWACNPPDCPGVGTGCTACGLYLDQLKPVGTAFKIISVRYSRKVCVQFGEEYLCKTIDMNDCFVTRHAKICIIGTVSKFSQGDTLLFLGPMEGGGIIFKHWCTSTCHFGDPGDVMGPKDKPFICPEFPGQFRKKCNFATTPVCEYDGNTISGYKKVLATIDSFQSFNTSNIHFTDERIEWRDPDGMLRDHINIVISKDIDFENLAENPCKVGLQAANIEGAWGSGVGFTLTCQVSLTECPTFLTSIKACDMAICYGAESVTLSRGQNTVKITGKGGHSGSSFKCCHGKECSSTGLQASAPHLDKVNGISELENEKVYDDGAPECGITCWFKKSGEWVMGIINGNWVVLIVLCVLLLFSLILLSILCPVRKHKKS

SEQ ID NO: 1108 - protein, 1133 aa, Artificial Sequence
  derived and/or modified protein sequence (wt) from SEOV(80-39)__S47716.1__GP
MWSLLLLAALVGQGFALKNVFDMRIQCPHSVKFGETSVSGYTELPPLSLQEAEQLVPESSCNMDNHQSLSTINKLTKVIWRKKANQESANQNSFELMESEVSFKGLCMLKHRMVEESYRNRRSVICYDLACNSTFCKPTVYMIVPIHACNMMKSCLIGLGPYRVQVVYERTYCTTGILTEGKCFVPDKAVVSALKRGMYAIASIETICFFIHQKGNTYKIVTAITSAMGSKCNNTDTKVQGYYICIIGGNSAPVYAPAGEDFRAMEVFSGIITSPHGEDHDLPGEEIATYQISGQIEAKIPHTVSSKNLKLTAFAGIPSYSSTSILTASEDGRFIFSPGLFPNLNQSVCDNNALPLIWRGLIDLTGYYEAVHPCNVFCVLSGPGASCEAFSEGGIFNITSPMCLVSKQNRFRAAEQQISFVCQRVDMDIIVYCNGQKKTILTKTLVIGQCIYTITSLFSLLPGVAHSIAIELCVPGFHGWATAALLITFCFGWVLIPACTLAILLVLKFFANILHTSNQENRFKAILRKIKEEFEKTKGSMVCEICKYECETLKELKAHNLSCVQGECPYCFTHCEPTETAIQAHYKVCQATHRFREDLKKTVTPQNIGPGCYRTLNLFRYKSRCYILTMWTLLLIIESILWAASAAEIPLVPLWTDNAHGVGSVPMHTDLELDFSLPSSSRYTYKRHLTNPVNDQQSVSLHIEIESQGIGADVHHLGHWYDARLNLKTSFHCYGACTKYQYPWHTAKCHFEKDYEYENSWACNPPDCPGVGTGCTACGLYLDQLKPVGTAFKIISVRYSRKVCVQFGEEYLCKTIDMNDCFVTRHAKICIIGTVSKFSQGDTLLFLGPMEGGGIIFKHWCTSTCHFGDPGDVMGPKDKPFICPEFPGQFRKKCNFATTPVCEYDGNIISGYKKVLATIDSFQSFNTSNIHFTDERIEWRDPDGMLRDHINIVISKDIDFENLAENPCKVGLQAANIEGAWGSGVGFTLTCQVSLTECPTFLTSIRACDMAICYGAESVTLSRGQNTVKITGKGGHSGSSFKCCHGKECSLTGLQASAPHLDKVNGISELENEKVYDDGAPECGITCWFKKSGEWVMGIINGNWVVLIVLCVLLLFSLILLSILCPVRKHKKS

SEQ ID NO: 1109 - protein, 1133 aa, Artificial Sequence
  derived and/or modified protein sequence (wt) from SEOV(93HBQ3)__KM115585.1__GP
MWSLLLLAALVGQGFALKNVFDMRIQCPHSVKFGETSVSGYTELPPLSLQEAEQLVPESSCNMDNHQSLSTINKLTKVIWQKKANQESANQNSFEVAESEVSFKGLCMLKHRMVEESYRNRRSVICYDLACNSTFCKPTVYMIVPIHACNMMKSCLIGLGPYRIQVVYERTYCTTGILTEGKCFVPDKAVVSALKRGMYAIASIETICFFIHQKGNTYKIVTAITSAMGSKCNNTDTKVQGYYICIIGGNSAPVYAPSGEDFRAMEVFSGIIMSPHGEDHDLPGEEIATYQISGQIEAKIPHTVSSKNLKLTAFAGIPSYSSTSILAASEDGRFIFSPGLFPNLNQSVCDNNALPLIWRGLIDLTGYYEAVHPCNVFCVLSGPGASCEAFSEGGIFNITSPMCLVSKQNRFRAAEQQISFVCQRVDMDIIVYCNGQKKTILTKTLVIGQCIYTITSLFSLLPGVAHSIAIELCVPGFHGWATAALLITFCFGWVLIPACTLAILLVLKFFANILHTSNQENRFKAILRKIKEEFEKTKGSMVCEICKYECETLKELKAHNLSCVQGECPYCFTHCEPTETAIQAHYKVCQATHRFREDLKKTVTPQNIGPGCYRTLNLFRYKSRCYILTMWTLLLIIESILWAASAAEIPLVPLWTDNAHGVGSVPMHTDLELDFSLPSSSKYTYKRHLTNPVNDQQSVSLHIEIESQGIGADVHHLGHWYDARLNLKTSFHCYGACTKYQYPWHTAKCHFEKDYEYENSWACNPPDCPGVGTGCTACGLYLDQLKPVGTALKIISVRYSRKVCVQFGEEYLCKTIDMNDCFVTRHAKICIIGTVSKFSQGDTLLFLGPMEGGGIIFKHWCTSTCHFGDPGDVMGPKDKPFICPEFPGQFRKKCNFATTPVCEYDGNIISGYKKVLATIDSFQSFNTSNIHFTDERIEWRDPDGMLRDHINIVISKDIDFENLAENPCKVGLQAANIEGAWGSGVGFTLTCQVSLTECPTFLTSIKACDMAICYGAESVTLLRGQNTVKITGKGGHSGSSFKCCHGKECSSTGLQASAPHLDKVNGISELENEKVYDDGAPECGITCWFKKSGEWVMGIINGNWVVLIVLCVLLLFSLILLSILCPVRKHKKS

SEQ ID NO: 1110 - protein, 1133 aa, Artificial Sequence
  derived and/or modified protein sequence (wt) from SEOV(93HBQ4)__KM115586.1__GP
MWSLLLLAALVGQGFALKNVFDMRIQCPHSVNFGETSVSGYTELPPLSLQEAEQLVPESSCNMDNHQSLSTINKLTKVIWRKKANQESANQNSFEVAESEVSFKGLCMLKHRMVEESYRNRRSVICYDLACNSTFCKPTVYMIVPIHACNMMKSCLIGLGPYRIQVVYERTYCTTGILTEGKCFVPDKAVVSALKRGMYAIASIETICFFIHQKGNTYKIVTAITSAMGSKCNNTDTKVQGYYICIIGGNSAPVYAPSGEDFRAMEVFSGIIMSPHGEDHDLPGEEIATYQISGQIEAKIPHTVSSKNLKLTAFAGIPSYSSTSILAASGDSRFIFSPGLFPNLNQSVCDNNALPLIWRGLIDLTGYYEAVHPCNVFCVLSGPGASCEAFSEGGIFNITSPMCLVSKQNRFRAAEQQISFVCQRVDMDIIVYCNGQKKTILTKTLVIGQCIYTITSLFSLLPGVAHSIAIELCVPGFHGWATAALLITFCFGWVLIPACTLAILLVLKFFANILHTSNQENRFKAILRKIKEEFEKTKGSMVCEICKYECETLKELKAHNLSCVQGECPYCFTHCEPTETAIQAHYKVCQATHRFREDLKKTVTPQNIGPGCYRTLNLFRYKSRCYILTMWTLLLIIESILWAASAAEIPLVPLWTDNAHGVGSVPMHTDLELDFSLPSSSKYTYKRHLTNPVNDQQSVSLHIEIESQGIGADVHHLGHWYDARLNLKTSFHCYGACTKYQYPWHTAKCHFEKDYEYENSWACNPPDCPGVGTGCTACGLYLDQLKPVGTAFKIISVRYSRKVCVQFGEEYLCKTIDMNDCFVTRHAKICIIGTVSKFSQGDTLLFLGPMEGGGIIFKHWCTSTCHFGDPGDVMGPKDKPFICPEFPGQFRKKCNFATTPVCEYDGNIISGYKKVLATIDSFQSFNTSNIHFTDETIEWRDPDGMLRDHINIVISKDIDFENLAENPCKVGLQAANIEGAWGSGVGFTLTCQVSLTECPTFLTSIKACDMAICYGAESVTLSRGQNTVKITGKGGHSGSSFKCCHGKECSSTGLQASAPHLDKVNGISELENERVYDDGAPECGITCWFKKSGEWVMGIINGNWVVLIVLCVLLLFSLILLSILCPVRKHKKS

SEQ ID NO: 1111 - protein, 1133 aa, Artificial Sequence
  derived and/or modified protein sequence (wt) from SEOV(B1)__AB457790.1__GP
MWSLLLLAALVGQGFALKNVFDMRIQCPHSVNFGETSVSGYTELPPLSLQEAEQLVPESSCNMDNHQSLSTINKLTKVIWRKKANQESANQNSFEVVESEVSFKGLCMLKHRMVEESYRNRRSVICYDLACNSTFCKPTVYMIVPIHACNMMKSCLIGLGPYRIQVVYERTYCTTGILTEGKCFVPDKAVVSALKRGMYAIASIETICFFIHQKGNTYKIVTAITSAMGSKCNNTDTKVQGYYICIIGGNSAPVYAPAGEDFRAMEVFSGIITSPHGEDHDLPGEEIATYQISGQIEAKIPHTVSSKNLRLTAFAGIPSYSSTSILAASEDGRFIFSPGLFPNLNQSVCDNNALPLIWRGLIDLTGYYEAVHPCNVFCVLSGPGASCEAFSEGGIFNITSPMCLVSKQNRFRAAEQQISFVCQRVDMDIIVYCNGQKKTILTKTLVIGQCIYTITSLFSLLPGVAHSIAIELCVPGFHGWATAALLITFCFGWILIPAWTLAILLVLKFFANILHTSNQENRFKAILRKIKEEFEKTKGSMVCEICKYECETLKELKAHNLSCVQGECPYCFTHCEPTETAIQAHYKICQATHRFREDLKKTVTPQNIGPGCYRTLNLFRYKSRCYILTMWTLLLIIESILWAASAAEIPLVPLWTDNAHGVGSVPMHTDLELDFSLPSSSKYTYKRHLTNPVNDQQSVSLHIEIESQGIGADVHHLGHWYDARLNLKTSFHCYGACTKYQYPWHTAKCHFEKDYEYENSWACNPPDCPGVGTGCTACGLYLDQLKPVGTAFKIISVRYSRKVCVQFGEEYLCKTIDMNDCFVTRHAKICIIGTVSKFSQGDTLLFLGPMEGGGIIFKHWCTSTCHFGDPGDVMGPKDKPFICPEFPGQFRKKCNFATTPVCEYDGNIISGYKKVLATIDSFQSFNTSNIHFTDERIEWRDPDGMLRDHINIVISKDIDFENLAENPCKVGLQAANIEGAWGSGVGFTLTCQVSLTECPTFLTSIKACDMAICYGAESVKLSRGQNTVKITGKGGHSGSSFKCCHGKECSSTGLQASAPHLDKVNGISELENEKVYDDGAPECGVTCWFKKSGEWVMGIINGNWVVLIVLCLLLLFSLILLSILCPVRKHKKS

SEQ ID NO: 1112 - protein, 1133 aa, Artificial Sequence
  derived and/or modified protein sequence (wt) from SEOV(B1)__AB457791.1__GP
MWSLLLLAALVGQGFALKNVFDMRIQCPHSVNFGETSVSGYTELPPLSLQEAEQLVPESSCNMDNHQSLSTINKLTKVIWQKKANQESANQNSFEVVESEVSFKGLCMLKHRMVEESYRNRRSVICYDLACNSTFCKPTVYMIVPIHACNMMKSCLIGLGPYRIQVAYERTYCTTGILTEGKCFVPDKAVVSALKRGMYAIASIETICFFIHQKGNTYKIVTAITSAMGSKCNNTDTKVQGYYICIIGGNSAPVYAPAGEDFRAMEVFSGIITSPHGEDHDLPGEEIATYQISGQIEAKIPHTVSSKNLRLTAFAGIPSYSSTSILAASKDGRFIFSPGLFPNLNQSVCDNNALPLIWRGLIDLTGYYEAVHPCNVFCVLSGPGASCEAFSEGGIFNITSPMCLVSKQNRFRAAEQQISFVCQRVDMDIIVYCNGQKKTILTKTLVIGQCIYTITSLFSLLPGVAHSIAIELCVPGFHGWATAALLITFCFGWILIPACTLAILLVLKFFANILHTSNQENRFKAILRKIKEEFEKTKGSMVCEICKYECETLKELKAHNLSCVQGECPYCFTHCEPTETAIQAHYKICQATHRFREDLKKTVTPQNIGPGCYRTLNLFRYKSRCYILTMWTLLLIIESILWAASAAEIPLVPLWTDNAHGVGSVPMHTDLELDFSLPSSSKYTYKRHLTNPVNDQQSVSLHIEIESQGIGADVHHLGHWYDARLNLKTSFHCYGACTKYQYPWHTAKCHFEKDYEYENSWACNPPDCPGVGTGCTACGLYLDQLKPVGTAFKIISVRYSRKVCVQFGEEYLCKTIDMNDCFVTRHAKICIIGTVSKFSQGDTLLFLGPMEGGGIIFKHWCTSTCHFGDPGDVMGPKDKPFICPEFPGQFRKKCNFATTPVCEYDGNIISGYKKVLATIDSFQSFNTSNIHFTDERIEWRDPDGMLRDHINIVISKDIDFENLAENPCKVGLQAANIEGAWGSGVGFTLTCQVSLTECPTFLTSIKACDMAICYGAESVTLSRGQNTVKITGKGGHSGSSFKCCHGKECSSTGLQASAPHLDKVNGISELENEKVYDDGAPECGVTCWFKKSGEWVMGIINGNWVVLIVLCLLLLFSLILLSILCPIRKHKKS

SEQ ID NO: 1113 - protein, 1133 aa, Artificial Sequence
  derived and/or modified protein sequence (wt) from SEOV(B1)__AB457792.1__GP
MWSLLLMAALVGQGFALKNVFDMRIQCPHSVNFGETSVSGYTELPPLSLQEAEQLVPESSCNMDNHQSLSTINKLTKVIWQKKANQESANQNSFEVVESEVSFKGLCMLKHRMVEESYRNRRSVICYDLACNSTFCKPTVYMIVPIHACNMMKSCLIGLGPYRIQVAYERTYCTTGILTEGKCFVPDKAVVSALKRGMYAIASIETICFFIHQKGNTYKIVTAITSAMGSKCNNTDTKVQGYYICIIGGNSAPVYAPAGEDFRAMEVFSGIITSPHGEDHDLPGEEIATYQISGQIEAKIPHTVSSKNLRLTAFAGIPSYSSTSILAASKDGRFIFSPGLFPNLNQSVCDNNALPLIWRGLIDLTGYYEAVHPCNVFCVLSGPGASCEAFSEGGIFNITSPMCLVSKQNRFRAAEQQISFVCQRVDMDIIVYCNGQKKTILTKTLVIGQCIYTITSLFSLLPGVAHSIAIELCVPGFHGWATAALLITFCFGWILIPACTLAILLVLKFFANILHTSNQENRFKAILRKIKEEFEKTKGSMVCEICKYECETLKELKAHNLSCVQGECPYCFTHCEPTETAIQAHYKICQATHRFREDLKKTVTPQNIGPGCYRTLNLFRYKSRCYILTMWTLLLIIESILWAASAAEIPLVPLWTDNAHGVGSVPMHTDLELDFSLPSSSKYTYKRHLTNPVNDQQSVSLHIEIESQGIGADVHHLGHWYDARLNLKTSFHCYGACTKYQYPWHTAKCHFEKDYEYENSWACNPPDCPGVGTGCTACGLYLDQLKPVGTAFKIISVRYSRKVCVQFGEEYLCKTIDMNDCFVTRHAKICIIGTVSKFSQGDTLLFLGPMEGGGIIFKHWCTSTCHFGDPGDVMGPKDKPFICPEFPGQFRKKCNFATTPVCEYDGNIISGYKKVLATIDSFQSFNTSNIHFTDERIEWRDPDGMLRDHINIVISKDIDFENLAENPCKVGLQAANIEGAWGSGVGFTLTCQVSLTECPTFLTSIKACDMAICYGAESVTLSRGQNTVKITGKGGHSGSSFKCCHGKECSSTGLQASAPHLDKVNGISELENEKVYDDGAPECGVTCWFKKSGEWVMGIINGNWVVLIVLCLLLLFSLILLSILCPIRKHKKS

SEQ ID NO: 1114 - protein, 1133 aa, Artificial Sequence
  derived and/or modified protein sequence (wt) from SEOV(B1)__AB457793.1__GP
MWSLLLLAALVGQGFALKNVFDMRIQCPHSVNFGETSVSGYTELPPLSLQEAEQLVPESSCNMDNHQSLSTINKLTKVIWQKKANQESANQNSFEVVESEVSFKGLCMLKHRMVEESYRNRRSVICYDLACNSTFCKPTVYMIVPIHACNMMKSCLIGLGPYRIQVAYERTYCTTGILTEGKCFVPDKAVVSALKRGMYAIASIETICFFIHQKGNTYKIVTAITSAMGSKCNNTDTKVQGYYICIIGGNSAPVYAPAGEDFRAMEVFSGIITSPHGEDHDLPGEEIATYQISGQIEAKIPHTVSSKNLRLTAFAGIPSYSSTSILAASKDGHFIFSPGLFPNLNQSVCDNNALPLIWRGLIDLTGYYEAVHPCNVFCVLSGPGASCEAFSEGGIFNITSPMCLVSKQNRFRAAEQQISFVCQRVDMDIIVYCNGQKKTILTKTLVIGQCIYTITSLFSLLPGVAHSIAIELCVPGFHGWATAALLITFCFGWILIPACTLAILLVLKFFANILHTSNQENRFKAILRKIKEEFEKTKGSMVCEICKYECETLKELKAHNLSCVQGECPYCFTHCEPTETAIQAHYKICQATHRFREDLKKTVTPQNIGPGCYRTLNLFRYKSRCYILTMWTLLLIIESILWAASAAEIPLVPLWTDNAHGVGSVPMHTDLELDFSLPSSSKYTYKRHLTNPVNDQQSVSLHIEIESQGIGADVHHLGHWYDARLNLKTSFHCYGACTKYQYPWHTAKCHFEKDYEYENSWACNPPDCPGVGTGCTACGLYLDQLKPVGTAFKIISVRYSRKVCVQFGEEYLCKTIDMNDCFVTRHAKICIIGTVSKFSQGDTLLFLGPMEGGGIIFKHWCTSTCHFGDPGDVMGPKDKPFICPEFPGQFRKKCNFATTPVCEYDGNIISGYKKVLATIDSFQSFNTSNIHFTDERIEWRDPDGMLRDHINIVISKDIDFENLAENPCKVGLQAANIEGAWGSGVGFTLTCQVSLTECPTFLTSIKACDMAICYGAESVTLSRGQNTVKITGKGGHSGSSFKCCHGKECSSTGLQASAPHLDKVNGISELENEKVYDDGAPECGVTCWFKKSGEWVMGIINGNWVVLIVLCLLLLFSLILLSILCPIRKHKKS

SEQ ID NO: 1115 - protein, 1133 aa, Artificial Sequence
  derived and/or modified protein sequence (wt) from SEOV(B1)__AB457794.1__GP
MWSLLLMAALVGQGFALKNVFDMRIQCPHSVNFGETSVSGYTELPPLSLQEAEQLVPESSCNMDNHQSLSTINKLTKVIWQKKANQESANQNSFEVVESEVSFKGLCMLKHRMVEESYRNRRSVICYDLACNSTFCKPTVYMIVPIHACNMMKSCLIGLGPYRIQVAYERTYCTTGILTEGKCFVPDKAVVSALKRGMYAIASIETICFFIHQKGNTYKIVTAITSAMGSKCNNTDTKVQGYYICIIGGNSAPVYAPAGEDFRAMEVFSGIITSPHGEDHDLPGEEIATYQISGQIEAKIPHTVSSKNLRLTAFAGIPSYSSTSILAASKDGHFIFSPGLFPNLNQSVCDNNALPLIWRGLIDLTGYYEAVHPCNVFCVLSGPGASCEAFSEGGIFNITSPMCLVSKQNRFRAAEQQISFVCQRVDMDIIVYCNGQKKTILTKTLVIGQCIYTITSLFSLLPGVAHSIAIELCVPGFHGWATAALLITFCFGWILIPACTLAILLVLKFFANILHTSNQENRFKAILRKIKEEFEKTKGSMVCEICKYECETLKELKAHNLSCVQGECPYCFTHCEPTETAIQAHYKICQATHRFREDLKKTVTPQNIGPGCYRTLNLFRYKSRCYILTMWTLLLIIESILWAASAAEIPLVPLWTDNAHGVGSVPMHTDLELDFSLPSSSKYTYKRHLTNPVNDQQSVSLHIEIESQGIGADVHHLGHWYDARLNLKTSFHCYGACTKYQYPWHTAKCHFEKDYEYENSWACNPPDCPGVGTGCTACGLYLDQLKPVGTAFKIISVRYSRKVCVQFGEEYLCKTIDMNDCFVTRHAKICIIGTVSKFSQGDTLLFLGPMEGGGIIFKHWCTSTCHFGDPGDVMGPKDKPFICPEFPGQFRKKCNFATTPVCEYDGNIISGYKKVLATIDSFQSFNTSNIHFTDERIEWRDPDGMLRDHINIVISKDIDFENLAENPCKVGLQAANIEGAWGSGVGFTLTCQVSLTECPTFLTSIKACDMAICYGAESVTLSRGQNTVKITGKGGHSGSSFKCCHGKECSSTGLQASAPHLDKVNGISELENEKVYDDGAPECGVTCWFKKSGEWVMGIINGNWVVLIVLCLLLLFSLILLSILCPIRKHKKS

SEQ ID NO: 1116 - protein, 1133 aa, Artificial Sequence
  derived and/or modified protein sequence (wt) from SEOV(B-1)__X53861.1__GP
MWSLLLLAALVGQGFALKNVFDMRIQCPHSVNFGETSVSGYTELPPLSLQEAEQLVPESSCNMDNHQSLSTINKLTKVIWRKKANQESANQNSFEVVESEVSFKGLCMLKHRMVEESYRNRRSVIYYDLAGNSTFCKPTVYMIVPIHACNMMKSCLIGLGPYRIQVVYERTYCTTGILTEGKCFVPDKAVVSALKRGMYAIASIETICFFIHQKWNKYKIVTAITSAMGSKCNNTDTKVQGYYICIIGGNSAPVYAPAGEDFRAMEVFSGIITSPHGEDHDLPGEEIATYHISGQIEAKIPHTVSSKNLRLAAFAGIPSYSSTSILAASEDGRFIFSPGLFPNLNQSVCDNNALPLIWRGLIDLTGYYEAVHPCNVFCVLSGPGASCEAFSEGGIFNITSPMCLVSKQNRFRAAEQQISFVCQRVDMDIIVYCNGQKKTILTKTLVIGQCIYTITSLFSLLPGVAHSIAIELCVPGFHGWATAALLITFCFGWVLIPACTLAILLVLKFFANILHTSNQENRFKAILRKIKEEFEKRKGSMVCEICKYECETLKELKAHNLSCVQGECPYCFTHCEPTETAIQAHYKVCQATHRFREDLKKTVTPQNIGPGCYRTLNLFRYKSRCYILTMWTLLLIIESILWAASAAEIPLVPLWTDNAHGVGSVPMHTDLELDFSLPSSSKYTYKRHLTNPVNDQQSVSLHIEIESQGIGADVHHLGHWYDARLNLKTSFHCYGACTKYQYPWHTAKCHFEKDYEYENSWACNPPDCPGVGTGCTACGLYLDQLKPVGTAFKIISVRYSRKVCVQFGEEHLCKTIDMNDCFVTRHAKICIIGTVSKFSQGDTLLFLGPMEGGGIIFKHWCTSTCHFGDPRDVMGPKDKPFICPEFPGQFRKKCNFATTPVCEYDGNIISGYKKVLATIDSFQSFNTSNIHFTDERIEWRDPDGMLRDHINIVISKDIDFENLAENPCKVGLQAANIEGAWGSGVGFTLTCQVSLTECPTFLTSIKACDMAICYGAESVTLSRGQNTVKITGKGGHSGSSFKCCHGKECSSTGLQASAPHLDKVNGISELENEKVYDDGAPECGVTCWFKKSGEWVMGIINGNWVVLIVLCVLLLFSLILLSILCPVRKHKKS

SEQ ID NO: 1117 - protein, 1133 aa, Artificial Sequence
  derived and/or modified protein sequence (wt) from SEOV(BjHD01)__DQ133505.1__GP
MWSLLFLAALVGQGFALKNVFDMRIQCPHSVNFGETSVSGYTELPPLSLQEAEQLVPESSCNMDNHQSLSTINKLTKVIWRKKANQESANQNSFEVVESEVSFKGLCMLKHRMVEESYRNRRSVICYDLACNSTFCKPTVYMIVPIHACNMMKSCLIGLGPYRIQVVYERTYCTTGILTEGKCFVPDKAVVSALKRGMYAIASIETICFFIHQKGNTYKIVTAITSAMGSKCNNTDTKVQGYYICIIGGNSAPVYAPAGEDFRAMEVFSGIITSPHGEDHDLPGEEVATYQISGQIEAKIPHTVSSKNLKLTAFAGIPSYSSTSILAASEDGRFIFSPGLFPNLNQSVCDNNALPLIWRGLIDLTGYYEAVHPCNVFCVLSGPGASCEAFSEGGIFNITSPMCLVSKQNRFRAAEQQISFVCQRVDMDIIVYCNGQKKTILTKTLVIGQCIYTITSLFSLLPGVAHSIAIELCVPGFHGWATAALLITFCFGWVLIPACTLAILLVLKFFANILHTSNQENRFKAILRKIKEEFEKTKGSMVCEICKYECETLKELKAHNLSCVQGECPYCFTHCEPTETAIQAHYKVCQATHRFREDLKKTVTPQNIGPGCYRTLNLFRYKSRCYILTMWTLLLIIESILWAASAAEIPLVPLWTDNAHGVGSVPMHTDLELDFSLPSSSKYTYKRHLTNPVNDQQSVSLHIEIESQGIGADVHHLGHWYDARLNLKTSFHCYGACTKYQYPWHTAKCHFEKDYEYENSWACNPPDCPGVGTGCTACGLYLDQLKPVGTAFKIISVRYSRKVCVQFGEEYLCKTIDMNDCFVTRHAKICIIGTVSKFSQGDTLLFLGPMEGGGIIFKHWCTSTCHFGDPGDVMGPKDKPFICPEFPGQFRKKCNFATTPVCEYDGNIISGYKKVLATIDSFQSFNTSNIHFTDERIEWRDPDGMLRDHINIVISKDIDFENLAENPCKVGLQAANIEGAWGSGVGFTLTCQVSLTECPTFLTSIKACDMAICYGAESVTLSRGQNTVKITGKGGHSGSSFKCCHGEECSSTGLQASAPHLDKVNGISELENEKVYDDGAPECGVTCWFKKSGEWVMGIINGNWVVLIVLCVLLLFSLILLSILCPVRKHKKS

SEQ ID NO: 1118 - protein, 1133 aa, Artificial Sequence
  derived and/or modified protein sequence (wt) from SEOV(Cherwell)__KM948593.1__GP
MWSLLLLAALVGQGSALKNVFDMRIQCPHSVNFGETSVSGYTELPPLSLQEAEQLVPESSCNMDNHQSLSTINKLTKVIWRKKANQESANQNSFEVVESEVSFKGLCMLKHRMVEESYRNRRSVICYDLACNSTFCKPTVYMIVPIHACNMMKSCLIGLGPYRIQVVYERTYCTTGILTEGKCFVPDKAVVSALKRGMYAIASIETICFFIHQKGNTYKIVTAITSAMGSKCNNTDTKVQGYYICIIGGNSAPVYAPAGEDFRAMEVFSGIITSPHGEDHDLPGEEIATYQISGQIEAKIPHTVSSKNLKLTAFAGIPSYSSTSILAASEDGRFIFSPGLFPNLNQSVCDNNALPLIWRGLIDLTGYYEAVHPCNVFCVLSGPGASCEAFSEGGIFNITSPMCLVSKQNRFRAAEQQISFVCQRVDMDIIVYCNGQKKTILTKTLVIGQCIYTITSLFSLLPGVAHSIAIELCVPGFHGWATAALLITFCFGWVLIPACTLAILLVLKFFANILHTSNQENRFKAILRKIKEEFEKTKGSMVCEICKYECETLKELKAHNLSCVQGECPYCFTHCEPTETAIQAHYKVCQATHRFREDLKKTVTPPNIGPGCYRTLNLFRYKSRCYILTMWTLLLIIESILWAASAAEIPLVPLWTDNAHGVGSVPMHTDLELDFSLPSSSKYTYKRHLTNPVNDQQSVSLHIEIESQGIGADVHHLGHWYDARLNLKTSFHCYGACTKYQYPWHTAKCHFEKDYEYENSWACNPPDCPGVGTGCTACGVYLDQLKPVGTAFKIVSVRYSRKVCVQFGEEYLCKTIDMNDCFVTRHAKICIIGTVSKFSQGDTLLFLGPMEGGGIIFKHWCTSTCHFGDPGDVMGPKDKPFICPEFPGQFRKKCNFATTPVCEYDGNIISGYKKVLATIDSFQSFNTSNIHFTDERIEWRDPDGMLRDHINIVISKDIDFENLAENPCKVGLQAANIEGAWGSGVGFTLTCQVSLTECPTFLTSIKACDMAICYGAESVTLSRGQNTVKITGKGGHSGSSFKCCHGKECSSTGLQASAPHLDKVNGISELENEKVYDDGAPECGVTCWFKKSSEWVMGIINGNWVVLIVLCVLLLFSLILLSILCPVRKHKKS

SEQ ID NO: 1119 - protein, 1133 aa, Artificial Sequence
  derived and/or modified protein sequence (wt) from SEOV(HaixingRn40)__GU592924.1__GP
MWSLLFLAALVGQGFALKNVFDMRIQCPHSVNFGETSVSGYTELPPLSLQEAEQLVPESSCNMDNHQSLSTINKLTKVIWRKKANQESANQNSFEVVESEVSFKGLCMLKHRMVEESYRNRRSVICYDLACNSTFCKPTVYMIVPIHACNMMKSCLIGLGPYRIQVVYERTYCTTGILTEGKCFVPDKAVVSALKRGMYAIASIETICFFIHQKGNTYKIVTAITSAMGSKCNNTDTKVQGYYICIIGGNSAPVYAPAGEDFRAMEVFSGIITSPHGEDHDLPGEEIATYQISGQIEAKIPHTVSSKNLKLTAFAGIPSYSSTSILAASEDGRFIFSPGLFPNLNQSVCDNNALPLIWRGLIDLTGYYEAVHPCNVFCVLSGPGASCEAFSEGGIFNITSPMCLVSKQNRFRAAEQQISFVCQRVDMDIIVYCNGQKKTILTRTLVIGQCIYTITSLFSLLPGVAHSIAIELCVPGFHGWATAALLITFCFGWVLIPACTLAILLVLKFFANILHTSNQENRFKAILRKIKEEFEKTKGSMVCEICKYECETLKELKAHNLSCVQGECPYCFTHCEPTETAIQAHYKVCQATHRFREDLKKTVTPQNIGPGCYRTLNLFRYKSRCYILTMWTLLLIIESILWAASAAEIPLVPLWTDNAHGVGSVPMHTDLELDFSLPSSSKYTYKRHLTNPVNDQQSVSLHIEIESQGIGADVHHLGHWYDARLNLKTSFHCYGACTKYQYPWHTAKCHFEKDYEYENSWACNPPDCPGVGTGCTACGLYLDQLKPVGTAFKIISVRYSRKVCVQFGEEYLCKTIDMNDCFVTRHAKICIIGTVSKFSQGDTLLFLGPMEGGGIIFKHWCTSTCHFGDPGDVMGPKDKPFICPEFPGQFRKKCNFATTPVCEYDGNIISGYKKVLATIDSFQSFNTSNIHFTDERIEWRDPDGMLRDHINIVISKDIDFENLGQNPCKVGLQAANIEGAWGSGVGFTLTCQVSLTECPTFLTSIKACDMAICYGAESVTLSRGQNTVKITGKGGHSGSSFKCCHGKECSSTGLQASAPHLDKVNGISDLENEKVYDDGAPECGVTCWFKKSGEWVMGIINGNWVVLIVLCVLLLFSLILLSILCPVRKHKKS

SEQ ID NO: 1120 - protein, 1133 aa, Artificial Sequence
  derived and/or modified protein sequence (wt) from SEOV(HBQ17)__KM233655.1__GP
MWSLLFVAALIGQGFALENAFDMRIRCPHSVHFGETSVSGYTELPPLSLQEAEQLVPESSCNMDNHQSLSTINKLTKVIWRKKANQESANQNSFEVVESALKIKGLCMLKHRMVEESYRNRRSVICYDLACNSTFCKPTVYMIVPIHACNMMKSCLIGLGPYRIQVVYERTYCTTGILTEGKCFVPDKAVVSALKRGMYAIASIETICFFIHQKGNTYKIVTAITSAMGSKCNNTDTKVQGYYICIIGGNSAPVYAPAGEDFRAMEVFSGIITSPHGEDHDLPGEEIATYQISGQIEAKIPHTVSSKNLKLTAFAGIPSYSSTSILAASEDGRFIFSPGLFPNLNQSVCDNNALPLIWRGLIDLTGYYEAVHPCNVFCVLSGPGASCEAFSEGGIFNITSPMCLVSKQNRFRAAEQQISFVCQRVDMDIIVYCNGQKKTILTKTLVIGQCIYTITSLFSLLPGVAHSIAIELCVPGFHGWATAALLITFCFGWVLIPACTLAILLVLKFFANILHTSNQENRFKAILRKIKEEFEKTKGSMVCEICKYECETLKELKAHNLSCVQGECPYCFTHCEPTETAIQAHYKVCQATHRFREDLKKTVTPQNIGPGCYRTLNLFRYKSRCYILTMWTLLLIIESILWAASAAEIPLVPLWTDNAHGVGSVPMHTDLELDFSLPSSSKYTYKRHLTNPVNDQQSVSLHIEIESQGIGADVHHLGHWYDARLNLKTSFHCYGACTKYQYPWHTAKCHFEKDYEYENSWACNPPDCPGVGTGCTACGLYLDQLKPVGTAFKIISVRYSRKVCVQFGEEYLCKTIDMNDCFVTRHAKICIIGTVSKFSQGDTLLFLGPMEGGGIIFKHWCTSTCHFGDPGDVMGPKDKPFICPEFPGQFRKKCNFATTPVCEYDGNIISGYKKVLATIDSFQSFNTSNIHFTDERIEWRDPDGMLRDHINIVISKDIDFENLAENPCKVGLQAANIEGAWGSGVGFTLTCQVSLTECPTFLTSIKACDMAICYGAESVTLSRGQNTVKITGKGGHSGSSFKCCHGKECSSTGLQASAPHLDKVNGISELENEKVYDDGAPECGVTCWFKKSGEWVMGIINGNWVVLIVLCVLLLFSLILLSILCPVRKHKKS

SEQ ID NO: 1121 - protein, 1133 aa, Artificial Sequence
  derived and/or modified protein sequence (wt) from SEOV(HBQ20)__KM233656.1__GP
MWSLLFLAALVGQGFALKNVFDMRIQCPHSVNFGETSVSGYTELPPLSLQEAEQLVPESSCNMDNHQSLSTINKLTKVIWRKKANQESANQNSFEVVESEVSFKGLCMLKHRMVEESYRNRRSVICYDLACNSTFCKPTVYMIVPIHACNMMKSCLIGLGPYRIQVVYERTYCTTGILTEGKCFVPDKAVVSALKRGMYAIASIETICFFIHQKGNTYKIVTVITSAMGSKCNNTDTKVQGYYICIIGGNSAPVYAPAGEDFRAMEVFSGIITSPHGEDHDLPGEEIATYQISGQIEAKIPHTVSSKNLKLTAFAGIPSYSSTSILAASEDGRFIFSPGLFPNLNQSVCDNNALPLIWRGLIDLTGYYEAVHPCNVFCVLSGPGASCEAFSEGGIFNITSPMCLVSKQNRFRAAEQQISFVCQRVDMDIIVYCNGQKKTILTKTLVIGQCIYTITSLFSLLPGVAHSIAIELCVPGFHGWATAALLITFCFGWVLIPACTLAILLVLKFFANILHTSNQENRFKAILRKIKEEFEKTKGSMVCEICKYECETLKELKAHNLSCVQGECPYCFTHCEPTETAIQAHYKVCQATHRFREDLKKTVTPQNIGPGCYRTLNLFRYKSRCYILTMWTLLLIIESILWAASAAEIPLVPLWTDNAHGVGSVPMHTDLELDFSLPSSSKYTYKRHLTNPVNDQQSVSLHIEIESQGIGADVHHLGHWYDARLNLKTSFHCYGACTKYQYPWHTAKCHFEKDYEYENSWACNPPDCPGVGTGCTACGLYLDQLKPVGTAFKIISVRYSRKVCVQFGEEYLCKTIDMNDCFVTRHAKICIIGTVSKFSQGDTLLFLGPMEGGGIIFKHWCTSTCHFGDPGDVMGPKDKPFICPEFPGQFRKKCNFATTPVCEYDGNIISGYKKVLATIDSFQSFNTSNIHFTDERIEWRDPDGMLRDHINIVISKDTDFENLAENPCKVGLQAANIEGAWGSGVGFTLTCQVSLTECPTFLTSIKACDMAICYGAESVTLSRGQNTVKITGKGGHSGSSFKCCHGKECSSTGLQASAPHLDKVNGISELENEKVYDDGAPECGVTCWFKKSGEWVMGIINGNWVVLIVLCVLLLFSLILLSILCPVRKHKKS

SEQ ID NO: 1122 - protein, 1133 aa, Artificial Sequence
  derived and/or modified protein sequence (wt) from SEOV(HBQ43)__KM233657.1__GP
MWSLLFLAALVGQGVALKNVFDMRIQCPHSVNFGETSVSGYTELPPLSLQEAEQLVPESSCNMDNHQSLSTINKLTKVIWRKKANQESANQNSFEVVESEVSFKGLCMLKHRMVEESYRNRRSVICYDLACNSTFCKPTVYMIVPIHACNMMKSCLIGLGPYRIQVVYERTYCTTGILTEGKCFVPDKAVVSALKRGMYAIASIETICFFIHQKGNTYKIVTAITSAMGSKCNNTDTKVQGYYICIIGGNSAPVYAPAGEDFRAMEVFSGIITSPHGEDHDLPGEEIATYQISGQIEAKIPHTVSSKNLKLTAFAGIPSYSSTSILAASEDGRFIFSPGLFPNLNQSVCDNNALPLIWRGLIDLTGYYEAVHPCNVFCVLSGPGASCEAFSEGGIFNITSPMCLVSKQNRFRAAEQQISFVCQRVDMDIIVYCNGQKKTILTKTLVIGQCIYTITSLFSLLPGVAHSIAIELCVPGFHGWATAALLITFCFGWVLIPACTLAILLVLKFFANILHTSNQENRFKAILRKIKEEFEKTKGSMVCEICKYECETLKELKAHNLSCVQGECPYCFTHCEPTETAIQAHYKVCQATHRFREDLKKTVTPQNIGPGCYRTLNLFRYKSRCYILTMWTLLLIIESILWAASAAEIPLVPLWTDNAHGVGSVPMHTDLELDFSLPSSSKYTYKRHLTNPVNDQQSVSLHIEIESQGIGADVHHLGHWYDARLNLKTSFHCYGACTKYQYPWHTAKCHFEKDYEYENSWACNPPDCPGVGTGCTACGLYLDQLKPVGTAFKIISVRYSRKVCVQFGEEYLCKTIDMNDCFVTRHAKICIIGTVSKFSQGDTLLFLGPMEGGGIIFKHWCTSTCHFGDPGDVMGPKDKPFICPEFPGQFRKKCNFATTPVCEYDGNIISGYKKVLATIDSFQSFNTSNIHFTDERIEWRDPDGMLRDHINIVISKDIDFENLAENPCKVGLQAANIEGAWGSGVGFTLTCQVSLTECPTFLTSIKACDMAICYGAESVTLSRGQNTVKITGKGGHSGSSFKCCHGKECSSTGLQASAPHLDKVNGFSELENEKVYDDGAPECGVTCWFKKSGEWVMGIINGNWVVLIVLCILLLFSLILLSILCPVRKHKKS

SEQ ID NO: 1123 - protein, 1133 aa, Artificial Sequence
  derived and/or modified protein sequence (wt) from SEOV(HBQ5)__KM233653.1__GP
MWSLLFLAALVGQGFALKNVFDMRIQCPHSVNFGETSVSGYTELPPLSLQEAEQLVPESSCNMDNHQSLSTINKLTKVIWRKKANQESANQNSFEVVESEVSFKGLCMLKHRMVEESYRNRRSVICYDLACNSTFCKPTVYMIVPIHACNMMKSCLIGLGPYRIQVVYERTYCTTGILTEGKCFVPDKAVVSALKRGMYAIASIETICFFIHQKGNTYKIVTAITSAMGSKCNNTDTKVQGYYICIIGGNSAPVYAPAGEDFRAMEVFSGIITSPHGEDHDLPGEEIATYQISGQIEAKIPHTVSSKNLKLTAFAGIPSYSSTSILAASEDGRFIFSPGLFPNLNQSVCDNNALPLIWRGLIDLTGYYEAVHPCNVFCVLSGPGASCEAFSEGGIFNITSPMCLVSKQNRFRAAEQQISFVCQRVDMDIIVYCNGQKKTILTKTLVIGQCIYTITSLFSLLPGVAHSIAIELCVPGFHGWATAALLITFCFGWVLIPACTLAILLVLKFFANILHTSNQENRFKAILRKIKEEFEKTKGSMVCEICKYECETLKELKAHNLSCVQGECPYCFTHCEPTETAIQAHYKVCQATHRFREDLKKTVTPQNIGPGCYRTLNLFRYKSRCYILTMWTLLLIIESILWAASAAEIPLVPLWTDNAHGVGSVPMHTDLELDFSLPSSSKYTYKRHLTNPVNDQQSVSLHIEIESQGIGADVHHLGHWYDARLNLKTSFHCYGACTKYQYPWHTAKCHFEKDYEYENSWACNPPDCPGVGTGCTACGLYLDQLKPVGTAFKIISVRYSRKVCVQFGEEYLCKTIDMNDCFVTRHAKICIIGTVSKFSQGDTLLFLGPMEGGGIIFKHWCTSTCHFGDPGDVMGPKDKPFICPEFPGQFRKKCNFATTPVCEYDGNIISGYKKVLATIDSFQSFNTSNIHFTDERIEWRDPDGMLRDHINIVISKDIDFENLAENPCKVGLQAANIEGAWGSGVGFTLTCQVSLTECPTFLTSIKACDMAICYGAESVTLSRGQNTVKITGKGGHSGSSFKCCHGKECSSTGLQASAPHLDKVNGISELENEKVYDDGAPECGVTCWFKKSGEWVMGIINGNWVVLIVLCVLLLFSLILLSILCPVRKHKKS

SEQ ID NO: 1124 - protein, 1133 aa, Artificial Sequence
  derived and/or modified protein sequence (wt) from SEOV(HBT14)__KM233658.1__GP
MWSLLFLAALVGQGFALKNVFDMRIQCPHSVNFGETSVSGYTGLPPLSLQEAEQLVPESSCNMDNHQSLSIINKLTKVIWRKKANQESANQNSFEVVESEVSFKGLCMLKHRMVEESYRNRRSVICYDLACNSTFCKPTVYMIVPIHACNMMKSCLIGLGPYRIQVVYERTYCTTGILTEGKCFVPDKAVVSALKRGMYAIASIETICFFIHQKGNTYKIVTAITSAMGSKCNNTDTKVQGYYICIIGGNSAPVYAPAGEDFRAMEVFSGIITSPHGEDHDLPGEEIATYQISGQIEAKIPHTVSSKNLKLTAFAGIPSYSSTSILAASEDGRFIFSPGLFPNLNQSVCDNNALPLIWRGLIDLTGYYEAVHPCNVFCVLSGPGASCEAFSEGGIFNITSPMCLVSKQNRFRAAEQQISFVCQRVDMDIIVYCNGQKKTILTKTLVIGQCIYTITSLFSLLPGVAHSIAIELCVPGFHGWATAALLITFCFGWVLIPACTLAILLVLKFFANILHTSNQENRFKAILRKIKEEFEKTKGSMVCEICKYECETLKELKAHNLSCVQGECPYCFTHCEPTETAIQAHYKVCQATHRFREDLKKTVTPQNIGPGCYRTLNLFRYKSRCYILTMWTLLLIIESILWAASAAEIPLVPLWTDNAHGVGSVPMHTDLELDFSLPSSSKYTYKRHLTNPVNDQQSVSLHIEIESQGIGADVHHLGHWYDARLNLKTSFHCYGACTKYQYPWHTAKCHFEKDYEYENSWACNPPDCPGVGTGCTACGLYLDQLKPVGTAFKIISVRYSRKVCVQFGEEYLCKTIDMNDCFVTRHAKICIIGTVSKFSQGDTLLFLGPMEGGGIIFKHWCTSTCHFGDPGDVMGPKDKPFICPEFPGQFRKKCNFATTPVCEYDGNIISGYKKVLATIDSFQSFNTSNIHFTDERIEWRDPDGMLRDHINIVISKDIDFENLAENPCKVGLQAANIEGAWGSGVGFTLTCQVSLTECPTFLTSIKACDMAICYGAESVTLSRGQNTVKITGKGGHSGSSFKCCHGKECSSTGLQASAPHLDKVNGISELENEKVYDDGAPECGVTCWFKKSGEWVMGIINGNWVVLIVLCVLLLFSLILLSILCPVRKHKKS

SEQ ID NO: 1125 - protein, 1133 aa, Artificial Sequence
  derived and/or modified protein sequence (wt) from SEOV(HBT-3)__KM233661.1__GP
MWSLLFLAALVGQGFALKNVFDMRIQCPHSVNFGETSVSGYTELPPLSLQEAEQLVPESSCNMDNHQSLSTINKLTKVIWRKKANQESANQNSFEVVESEVSFKGLCMLKHRMVEESYRNRRSVICYDLPCNSTFCKPTVYMIVPIHACNMMKSCLIGLGPYRIQVVYERTYCTTGILTEGKCFVPDKAVVSALKRGMYAIASIETICFFIHQKGNTYKIVTAITSAMGSKCNNTDTKVQGYYICIIGGNSAPVYAPAGEDFRAMEVFSGIITSPHGEDHDLPGEEIATYQISGQIEAKIPHTVSSKNLKLTAFAGIPSYSSTSILAASEDGRFIFSPGLFPNLNQSVCDNNALPLIWRGLIDLTGYYEAVHPCNVFCVLSGPGASCEAFSEGGIFNITSPMCLVSKQNRFRAAEQQISFVCQRVDMDIIVYCNGQKKTILTKTLVIGQCIYTITSLFSLLPGVAHSIAIELCVPGFHGWATAALLITFCFGWVLIPACTLAILLVLKFFANILHTSNQENRFKAILRKIKEEFEKTKGSMVCEICKYECETFKELKAHNLSCVQGECPYCFTHCEPTETAIQAHYKVCQATHRFREDLKKTVTPQNIGPGCYRTLNLFRYKSRCYILTMWTLLLIIESILWAASAAEIPLVPLWTDNAHGVGSVPMHTDLELDFSLPSSSKYTYKRHLTNPVNDQQSVSLHIEIESQGIGADVHHLGHWYDARLNLKTSFHCYGACTKYQYPWHTAKCHFEKDYEYENSWACNPPDCPGVGTGCTACGLYLDQLKPVGTAFKIISVRYSRKVCVQFGEEYLCKTIDMNDCFVTRHAKICIIGTVSKFSQGDTLLFLGPMEGGGIIFKHWCTSTCHFGDPGDVMGPKDKPFICPEFPGQFRKKCNFATTPVCEYDGNIISGYKKVLATIDSFQSFNTSNIHFTDERIEWRDPDGMLRDHINIVISKDIDFENLAENPCKVGLQAANIEGAWGSGVGFTLTCQVSLTECPTFLTSIKACDMAICYGAESVTLSRGQNTVKITGKGGHSGSSFKCCHGKECSSTGLQASAPHLDKVNGISELENEKVYDDGAPECGVTCWFKKSGEWVMGIINGNWVVLIVLCVLLLFSLILLSILCPVRKHKKS

SEQ ID NO: 1126 - protein, 1133 aa, Artificial Sequence
  derived and/or modified protein sequence (wt) from SEOV(HBT49)__KM233659.1__GP
MWSLLFLAALVGQGFALKNVFDMRIQCPHSVNFGETSVSGYTELPPLSLQEAEQLVPESSCNMDNHQSLSTINKLTKVIWRKKANQESANQNSFEVVESEVSFKGLCMLKHRMVEESYRNRRSVICYDLACNSTFCKPTVYMIVPIHACNMMKSCLIGLGPYRIQVVYERTYCTTGILTEGKCFVPDKAVVSALKRGMYAIASIETICFFIHQKGNTYKIVTAITSAMGSKCNNTDTKVQGYYICIIGGNSAPVYAPAGEDFRAMEVFSGIITSPHGEDHDLPGEEIATYQISGQIEAKIPHTVSSKNLKLTAFAGIPSYSSTSILAASEDGRFIFSPGLFPNLNQSVCDNNALPLIWRGLIDLTGYYEAVHPCNVFCVLSGPGASCEAFSEGGIFNITSPMCLVSKQNRFRAAEQQISFVCQRVDMDIIVYCNGQKKTILTKTLVIGQCIYTITSLFSLLPGVAHSIAIELCVPGFHGWATAALLITFCFGWVLIPACTLAILLVLKFFANILHTSNQENRFKAILRKIKEEFEKTKGSMVCEICKYECETLKELKAHNLSCVQGECPYCFTHCEPTETAIQAHYKVCQATHRFREDLKKTVTPQNIGPGCYRTLNLFRYKSRCYILTMWTLLLIIESILWAASAAEIPLVPLWTDNAHGVGSVPMHTDLELDFSLPSSSKYTYKRHLTNPVNDQQSVSLHIEIESQGIGADVYHLGHWYDARLNLKTSFHCYGACTKYQYPWHTAKCHFEKDYEYENSWACNPPDCPGVGTGCTACGLYLDQLKPVGTAFKIISVRYSRKVCVQFGEEYLCKTIDMNDCFVTRHAKICIIGTVSKFSQGDTLLFLGPMEGGGIIFKHWCTSTCHFGDPGDVMGPKDKPFICPEFPGQFRKKCNFATTPVCEYDGNIISGYKKVLATIDSFQSFNTSNIHFTDERIEWRDPDGMLRDHINIVISKDIDFENLAENPCKVGLQAANIEGAWGSGVGFTLTCQVSLTECPTFLTSIKACDMAICYGAESVTLSRGQNTVKITGKGGHSGSSFKCCHGKECSSTGLQASAPHLDKVNGISELENEKVYDDGAPECGVTCWFKKSGEWVMGIINGNWVVLIVLCVLLLFSLILLSILCPVRKHKKS

SEQ ID NO: 1127 - protein, 1133 aa, Artificial Sequence
  derived and/or modified protein sequence (wt) from SEOV(HBT50)__KM233660.1__GP
MWSLLFLAALVGQGFALKNVFDMRIQCPHSVNFGETSVSGYTELPPLSLQEAEQLVPESSCNMDNHQSLSTINKLTKVIWRKKANQESANQNSFEVVESEVSFKGLCMLKHRMVEESYRNRRSVICYDLACNSTFCKPTVYMIVPIHACNMMKSCLIGLGPYRIQVVYERTYCTTGILTEGKCFVPDKAVVSALKRGMYAIASIETICFFIHQKGNTYKIVTAITSAMGSKCNNTDTKVQGYYICIIGGNSAPVYAPAGEDFRAMEVFSGIITSPHGEDHDLPGEEIATYQISGQIEAKIPHTVSSKNLKLTAFAGIPSYSSTSILAASEDGRFIFSPGLFPNLNQSVCDNNALPLIWRGLIDLTGYYEAVHPCNVFCVLSGPGASCEAFSEGGIFNITSPMCLVSKQNRFRAAEQQISFVCQRVDMDIIVYCNGQKKTILTKTLVIGQCIYTITSLFSLLPGVAHSIAIELCVPGFHGWATAALLITFCFGWVLIPACTLAILLVLKFFANILHTSNQENRFKAILRKIKEEFEKTKGSMVCEICKYECETLKELKAHNLSCVQGECPYCFTHCEPTETAIQAHYKVCQATHRFREDLKKTVTPQNIGPGCYRTLNLFRYKSRCYILTMWTLLLIIESILWAASAAEIPLVPLWTDNAHGVGSVPMHTDLELDFSLPSSSKYTYKRHLTNPVNDQQSVSLHIEIESQGIGADVHHLGHWYDARLNLKTSFHCYGACTKYQYPWHTAKCHFEKDYEYENSWACNPPDCPGVGTGCTACGLYLDQLKPVGTAFKIISVRYSRKVCVQFGEEYLCKTIDMNDCFVTRHAKICIIGTVSKFSQGDTLLFLGPMEGGGIIFRHWCTSTCHFGDPGDVMGPKDKPFICPEFPGQFRKKCNFATTPVCEYDGNIISGYKKVLATIDSFQSFNTSNIHFTDERIEWRDPDGMLRDHINIVISKDIDFENLAENPCKVGLQAANIEGAWGSGVGFTLTCQVSLTECPTFLTSIKACDMAICYGAESVTLSRGQNTVKITGKGGHSGSSFKCCHGKECSSTGLQASAPHLDKVNGISELENEKVYDDGAPECGVTCWFKKSGEWVMGIINGNWVVLIVLCVLLLFSLILLSILCPVRKHKKS

SEQ ID NO: 1128 - protein, 1133 aa, Artificial Sequence
  derived and/or modified protein sequence (wt) from SEOV(HuludaoRn101)__GU592923.1__GP
MWSLLLLAALVGQGFALKNVFDMRIQCPHSVNFGETSVSGYTELPPLSLQEAEQLVPESSCNMDNHQSLSTINKLTKVVWRKKANQESANQNSFEVVESEVSFKGLCMLKHRMVEESYRNRRSVICYDLACNSTFCKPTVYMIVPIHACNMMKSCLIGLGPYRIQVVYERTYCTTGILTEGKCFVPDKAVVSALKRGMYAIASIETICFFIHQKGNTYKIVTAITSAMGSKCNNTDTKVQGYYICIIGGNSAPVYAPAGEDFRAMEVFSGIITSPHGEDHDLPGEEIATYQISGQIEAKIPHTVSSKNLKLIAFAGIPSYSSTSILAASEDSRFIFSPGLFPNLNQSVCDNNALPLIWRGLIDLTGYYETVHPCNVFCVLSGPGASCEAFSEGGIFNITSPMCLVSKQNRFRAAEQQISFICQRVDMDIIVYCNGQKKTILTKTLVIGQCIYTITSLFSLLPGVAHSIAIELCVPGFHGWATAALLITFCFGWVLIPACTLAILLVLKFFANILHTSNQENRFKAILRKIKEEFEKTKGSMVCEICKYECETLKELKAHNLSCVQGECPYCFTHCEPTETAIQAHYKVCQATHRFREDLKKTVTPQNIGPGCYRTLNLFRYKSRCYILTMWTLLLIIESILWAASAAEIPLVPLWTDNAHGVGSIPMHTDLELDFSLPSSSKYTYKRHLTNPVNDQQSVSLHIEIESQGIGADVHHLGHWYDARLNLKTSFHCYGACTKYQYPWHTAKCHFEKDYEYENSWACNPPDCPGVGTGCTACGLYLDQLKPVGTAFKIISVRYSRKVCVQFGEEYLCKTIDMNDCFVTRHAKICIIGTVSKFSQGDTLLFLGPMEGGGIIFKHWCTSTCHFGDPGDVMGPKDKPFICPEFPGQFRKKCNFATTPICEYDGNIISGYKKVLATIDSFQSFNTSNIHFTDERIEWRDPDGMLRDHINVVISKDIDFENLAENPCKVGLQAANIEGAWGSGVGFTLTCQVSLTECPTFLTSIKACDMAICYGAESVTLSRGQNTVRITGKGGHSGSSFKCCHGKECSSTGLQASAPHLDKVNGISELENEKVYDDGAPECGVTCWFKKSGEWVMGIINGNWVVLIVLCVLLLFSLILLSILCPVRKHKKS

SEQ ID NO: 1129 - protein, 1133 aa, Artificial Sequence
  derived and/or modified protein sequence (wt) from SEOV(Humber)__JX879768.1__GP
MWSLLLLAALVGQGFALKNVFDMRIQCPHSVNFGETSVSGYTELPPLSLQEAEQLVPESSCNMDNHQSLSTINKLTKVIWRKKANQESANQNSFEVVESEVSFKGLCMLKHRMVEESYRNRRSVICYDLACNSTFCKPTVYMIVPIHACNMMKSCLIGLGPYRIQVVYERTYCTTGILTEGKCFVPDKAVVSALKRGMYAIASIETICFFVHQKGNTYKIVTAITSAMGSKCNNTDTKVQGYYICIIGGNSAPVYSPAGEDFRAMEVFSGIITSPHGEDHDLPGEEIATYQISGQIEAKIPHTVSSKNLKLTAFAGIPSYSSTSILAASEDGRFIFSPGLFPNLNQSVCDNNALPLIWRGLIDLTGYYEAVHPCNVFCVLSGPGASCEAFSEGGIFNITSPMCLVSKQNRFRAAEQQISFICQRVDMDIIVYCNGQKKTILTKTLVIGQCIYTITSLFSLLPGVAHSIAIELCVPGFHGWATAALLITFCFGWVLIPACTLAVLLVLKFFANILHTSNQENRFKAILRKIKEEFEKTKGSMVCEICKYECETLKELKAHNLSCIQGECPYCFTHCEPTETAIQAHYKVCQATHRFREDLKKTVTPPNIGPGCYRTLNLFRYKSRCYILTMWTLLLIIESILWAASAAEIPLVPLWTDNAHGVGSVPMHTDLELDFSLPSSSKYTYKRHLTNPVNDQQSVSLHIEIESQGIGADVHHLGHWYDARLNLKTSFHCYGACTKYQYPWHTAKCHFEKDYEYENSWACNPPDCPGVGTGCTACGLYLDQLKPVGTAFKIISVRYSRKVCVQFGEEYLCKTIDMNDCFVTRHAKICIIGTVSKFSQGDTLLFLGPMEGGGIIFKHWCTSTCHFGDPGDVMGPKDKPFICPEFPGQFRKKCNFATTPVCEYDGNIISGYKKVLATIDSFQSFNTSNIHFTDERIEWRDPDGMLRDHINIIISKDIDFENLAENPCKVGLQAANIEGAWGSGVGFTLTCQVSLTECPTFLTSIKACDMAICYGAESVTLSRGQNTVKITGKGGHSGSSFKCCHGKECSSNGLQASAPHLDKVNGISELENEKVYDDGAPECGVTCWFKKSGEWVMGIINGNWVVLIVLCVLLLFSLILLSILCPVRKHKKS

SEQ ID NO: 1130 - protein, 1133 aa, Artificial Sequence
  derived and/or modified protein sequence (wt) from SEOV(Humber)__KM948597.1__GP
MWSLLLLAALVGQGFALKNVFDMRIQCPHSVNFGETSVSGYTELPPLSLQEAEQLVPESSCNMDNHQSLSTINKLTKVIWRKKANQESANQNSFEVVESEVSFKGLCMLKHRMVEESYRNRRSVICYDLACNSTFCKPTVYMIVPIHACNMMKSCLIGLGPYRIQVVYERTYCTTGILTEGKCFVPDKAVVSALKRGMYAIASIETICFFVHQKGNTYKIVTAITSAMGSKCNNTDTKVQGYYICIIGGNSAPVYSPAGEDFRAMEVFSGIITSPHGEDHDLPGEEIATYQISGQIEAKIPHTVSSKNLKLTAFAGIPSYSSTSILAASEDGRFIFSPGLFPNLNQSVCDNNALPLIWRGLIDLTGYYEAVHPCNVFCVLSGPGASCEAFSEGGIFNITSPMCLVSKQNRFRAAEQQISFICQRVDMDIIVYCNGQKKTILTKTLVIGQCIYTITSLFSLLPGVAHSIAIELCVPGFHGWATAALLITFCFGWVLIPACTLAVLLVLKFFANILHTSNQENRFKAILRKIKEEFEKTKGSMVCEICKYECETLKELKAHNLSCIQGECPYCFTHCEPTETAIQAHYKVCQATHRFREDLKKTVTPPNIGPGCYRTLNLFRYKSRCYILTMWTLLLIIESILWAASAAEIPLVPLWTDNAHGVGSVPMHTDLELDFSLPSSSKYTYKRHLTNPVNDQQSVSLHIEIESQGIGADVHHLGHWYDARLNLKTSFHCYGACTKYQYPWHTAKCHFEKDYEYENSWACNPPDCPGVGTGCTACGLYLDQLKPVGTAFKIISVRYSRKVCVQFGEEYLCKTIDMNDCFVTRHAKICIIGTVSKFSQGDTLLFLGPMEGGGIIFKHWCTSTCHFGDPGDVMGPKDKPFICPEFPGQFRKKCNFATTPVCEYDGNIISGYKKVLATIDSFQSFNTSNIHFTDERIEWRDPDGMLRDHINIIISKDIDFENLAENPCKVGLQAANIEGAWGSGVGFTLTCQVSLTECPTFLTSIKACDMAICYGAESVTLLRGQNTVKITGKGGHSGSSFKCCHGKECSSNGLQASAPHLDKVNGISELENEKVYDDGAPECGVTCWFKKSGEWVMGIINGNWVVLIVLCVLLLFSLILLSILCPVRKHKKS

SEQ ID NO: 1131 - protein, 1133 aa, Artificial Sequence
  derived and/or modified protein sequence (wt) from SEOV(K24-e7)__AF288652.1__GP
MWSLLLLAALVGQGFALKNVFDMRIQCPHSVNFGETSVSGYTELPPLSLQEAEQLVPESSCNMDNHQSLSTINKLTKVVWRKKANQESANQNSFEVVESEVSFKGLCMLKHRMVEESYRNRRSVICYDLACNSTFCKPTVYMIVPIHACNMMKSCLIGLGPYRIQVVYERTYCTTGILTEGKCFVPGKAVVSALKRGMYAIASIETICFFIHQKGNTYKIVTAITSAMGSKCNNTDTKVQGYYICIIGGNSAPVYAPAGEDFRAMEVFSGIITSPHGEDHDLPGEEIATYQISGQIEAKIPHTVSSKNLKLIAFAGIPSYSSTSILAASEDGRFIFSPGLFPNLNQSVCDNNALPLIWRGLIDLTGYYEAVHPCNVFRVLSGPGASCEAFSEGGIFNITSPMCLVSKQNRFRAAEQQISFICQRVDMDIIVYCNGQKKTILTKTLVIGQCIYTITSLFSLLPGVAHSIAIELCVPGFHGWATAALLITFCFGWVLIPACTLAILLVLKFFANILHTSNQENRFKAILRKIKEEFEKTKGSMVCEICKYECETLKELKAHNLSCVQGECPYCFTHCEPTETAIQAHYKVCQATHRFREDLKKTVTPQNIGPGCYRTLNLFRYKSRCYILTMWTLLLIIESILWAASAAEIPLVPLWTDNAHGVGSVPMHTDLELDFSLPSSSKYTYKRHLTNPVNDQQSVSLHIEIESQGIGADVHHLGHWYDARLNLKTSFHCYGACTKYQYPWHTAKCHFEKDYEYENSWACNPPDCPGVGTGCTACGLYLDQLKPVGTAFKIISVRYSRKVCMQFGEEYLCKTIDMNDCFVTRHAKICIIGTVSKFSQGDTLLFLGPMEGGGIIFKHWCTSTCHFGDPGDVMGPKDKPFICPEFPGQFRKKCNFATTPICEYDGNIISGYKKVLATIDSFQSFNTSNIHFTDERIEWRDPDGMLRDHINIVISKDIDFENLAENPCKVGLQAANIEGAWGSGVGFTLTCQVSLTECPTFLTSIKACDMAICYGAESVTLSRGQNTVRITGRGGHSGSSFKCCHGKECSSTGLQASAPHLDKVNGISELENEKVYDDGAPECGVTCWFKKSGEWVMGIINGNWVVLIVLCVLLLFSLILLSILCPVRKHKKS

SEQ ID NO: 1132 - protein, 1133 aa, Artificial Sequence
  derived and/or modified protein sequence (wt) from SEOV(K24-v2)__AF288654.1__GP
MWSLLLLAALVGQGFALKNVFDMRIQCPHSVNFGETSVSGYTELPPLSLQEAEQLVPESSCNMDNHQSLSTINKLTKVVWRKKANQESANQNSFEVVESEVSFKGLCMLKHRMVEESYRNRRSVICYDLACNSTFCKPTVYMIVPIHACNMMKSCLIGLGPYRIQVVYERTYCTTGILTEGKCFVPDTAVVSALKRGMYAIASIETICFFIHQKGNTYKIVTAITSAMGSKCNNTDTKVQGYYICIIGGNSAPVYAPAGEDFRAMEVFSGIITSPHGDDHDLPGEEIAPYQISGQIEAKIPHTVSSKNLKLIAFAGIPSYSSTSILAASEDGRFIFSPGLFPNLNQSVCDNNALPLIWRGLIDLTGYYEAVHPCNVFCVLSGPGASCEAFSEGGIFNITSPMCLVSKQNRFRAAEQQISFICQRVDMDIIVYCNDQKKTILTKTLVIGQCIYTITSLFSLLPGVAHSIAIELCVPGFHGWATAALLITFCFGWVLIPACTLAILLVLKFFANILHTSNQENRFKAILRKIKEEFEKTKGSMVCEICKYECETLKELKAHNLSCVQGECPYCFTHCEPTETAIQAHYKVCQATHRFREDLKKTVTPQNIGPGCYRTLNLFRYKSRCYILTMWTLLLIIESILWAASAAEIPLVPLWTDNAHGVGSVPMHTDLELDFSLPSSSKYTYKRHLTNPVNDQQSVSLHIEIESQGIGADVHHLGHWYGARLNLKTSFHCYGACTKYQYPWHTAKCHFEKDYEYENSWACNPPDCPGVGTGCTACGLYLDQLKPVGTAFKIISVRYSRKVCMQFGEEYLCKTIDMNDCFVTRHAKICIIGTVSKFSQGDTLLFLGPMEGGGIIFKHWCTSTCHFGDPGDVMGPKDKPFICPEFPGQFRKKCNFATTPICEYDGNIISGYKKVLATIDSFQSFNTSNIHFTDERIEWRDPDGMLRDHINIVISKDIDFENLAENPCKVGLQAANIEGAWGSGVGFTLTCQVSLTECPTFLTSIKACDMAICYGAESVTLSRGQNTVRITGKGGHSGSSFKCCHGKECSSTGLQASAPHLDKVNGISELENEKVYDDGAPECGVTCWFKKSGEWVMGIINGNWVVLIVLCVLLLFSLILLSILCPVRKHKKS

SEQ ID NO: 1133 - protein, 1133 aa, Artificial Sequence
  derived and/or modified protein sequence (wt) from SEOV(KI-83-262)__D17592.1__GP
MWSLLLLAALVGQGFALKNVFDMRIQCPHSVNFGETSVSGYTELPPLSLQEAEQLVPESSCNMDNHQSLSTINKLTKVIWRKKANQESANQNSFEVVESEVSFKGLCMLKHRMVEESYRNRRSVICYDLACNSTFCKPTVYMIVPIHACNMMKSCLIGLGPYRIQVVYERTYCTTGILTEGKCFVPDKAVVSALKRGMYAIASIETICFFIHQKGNTYKIVTAITSAMGSKCNNTDTKVQGYYICIIGGNSAPVYAPAGEDFRAMEVFSGIITSPHGEDHDLPGEEIATYQISGQIEAKIPHTVSSKNLKLTAFAGIPSYSSTSILAASEDGRFIFSPGLFPNLNQSVCDNNALPLIWRGLIDLTGYYEAVHPCNVFCVLSGPGASCEAFSEGGIFNITSPMCLVSKQNRFRAAEQQISFVCQRVDMDIIVYCNGQKKTILTKTLVIGQCIYTITSLFSLLPGVAHSIAIELCVPGFHGWATAALLITFCFGWVLIPACTLAILLVLKFFANILHTSNQENRFKAILRKIKEEFEKTKGSMVCEICKYECETLKELKAHNLSCVQGECPYCFTHCEPTETAIQAHYKVCQATHRFREDLKKTVTPQNIGPGCYRTLSLFRYKSRCYILTMWTLLLIIESILWAASAAEIPLVPLWTDNAHGVGSVPMHTDLELDFSLPSSSKYTYKRHLTNPVNDQQSVSLHIEIESQGIGADVHHLGHWYDARLNLKTSFHCYGACTKYQYPWHTAKCHFEKDYEYENSWACNPPDCPGVGTGCTACGLYLDQLKPVGTAFKIISVRYSRKVCVQFGEEYLCKTIDMNDCFVTRHAKICIIGTVSKFSQGDTLLFLGPMEGGGIIFKHWCTSTCHFGDPGDVMGPKDKPFICPEFPGQFRKKCNFATTPVCEYDGNIISGYKKVLATIDSFQSFNTSNIHFTDERIEWRDPDGMLRDHINIVISKDIDFENLAENPCKVGLQAANIEGAWGSGVGFTLTCQVSLTECPTFLTSIKACDMAICYGAESVTLSRGQNTVKITGKGGHSGSSFKCCHGKECSSTGLQASAPHLDKVNGISELENEKVYDDGAPECGITCWFKKSGEWVMGIINGNWVVLIVLCVLLLFSLILLSILCPVRKHKKS

SEQ ID NO: 1134 - protein, 1133 aa, Artificial Sequence
  derived and/or modified protein sequence (wt) from SEOV(KI-85-1)__D17593.1__GP
MWSLLLLAALVGQGFALKNVFDMRIQCPHSVNFGETSVSGYTELPPLSLQEAEQLVPESSCNMDNHQSLSTINKLTKVIWRKKANQESANQNSFEVVESEVSFKGLCMLKHRMVEESYRNRRSVICYDLACNSTFCKPTVYMIVPIHACNMMKSCLIGLGPYRIQVVYERTYCTTGILTEGKCFVPDKAVVSALKRGMYAIASIETICFFIHQKGNTYKIVTAITSAMGSKCNNTDTKVQGYYICIIGGNSAPVYAPAGEDFRAMEVFSGIITSPHGEDHDLPGEEIATYQISGQIEAKIPHTVSSKNLKLTAFAGIPSYSSTSILAASEDGRFIFSPGLFPNLNQSVCDNNALPLIWRGLIDLTGYYEAVHPCNVFCVLSGPGASCEAFSEGGIFNITSPMCLVSKQNRFRAAEQQISFVCQRVDMDIIVYCNGQKKTILTKTLVIGQCIYTITSLFSLLPGVAHSIAIELCVPGFHGWATAALLITFCFGWVLIPACTLAILLVLKFFANILHTSNQENRFKAILRKIKEEFEKTKGSMVCEICKYECETLKELKAHNLSCVQGECPYCFTHCEPTETAIQAHYKVCQATHRFREDLKKTVTPQNIGPGCYRTLNLFRYKSRCYILTMWTLLLIIESILWAASAAEIPLVPLWTDNAHGVGSVPMHTDLELDFSLPSSSKYTYKRHLTNPVNDQQSVSLHIEIESQGIGADVHHLGHWYDARLNLKTSFHCYGACAKYQYPWHTAKCHFEKDYEYENSWACNPPDCPGVGTGCTACGLYLDQLKPVGTAFKIISVRYSRKVCVQFGEEYLCKTIDMNDCFVTRHAKICIIGTVSKFSQGDTLLFLGPMEGGGIIFKHWCTSTCHFGDPGDVMGPKDKPFICPEFPGQFRKKCNFATTPVCEYDGNIISGYKKVLATIDSFQSFNTSNIHFTDERIEWRDPDGMLRDHINIVISKDIDFENLAENPCKVGLQAANIEGAWGSGVGFTLTCQVSLTECPTFLTSIKACDMAICYGAESVTLSRGQNTVKITGKGGHSGSSFKCCHGKECSSTGLQASAPHLDKVNGISELENEKVYDDGAPECGITCWFKKSGEWVMGIINGNWVVLIVLCVLLLFSFILLSILCPVRKHKKS

SEQ ID NO: 1135 - protein, 1133 aa, Artificial Sequence
  derived and/or modified protein sequence (wt) from SEOV(KI-88-15)__D17594.1__GP
MWSLLLLAALVGQGFALKNVFDMRIQCPHSVNFGETSVSGYTELPPLSLQEAEQLVPESSCNMDNHQSLSTINKLTKVIWRKKANQESANQNSFEIVESEVSFKGLCMLKHRMVEESYRNRRSVICYDLACNSTFCKPTVYMIVPIHACNMMKSCLIGLGPYRIQVVYERTYCTTGILTEGKCFVPDKAVVSALKRGMYAIASIETICFFIHQKGNTYKIVTAITSAMGSKCNNTDTKVQGYYICIIGGNSAPVYAPAGEDFRAMEVFSGIITSPHGEDHDLPGEEIATYQISGQIEAKIPHTVSSKNLKLTAFAGIPSYSSTSILAASEDGRFIFSPGLFPNLNQSVCDNNALPLIWRGLIDLTGYYEAVHPCNVFCVLSGPGASCEAFSEGGIFNITSPMCLVSKQNRFRAAEQQISFVCQRVDMDIIVYCNGQKKTILTKTLVIGQCIYTITSLFSLLPGVAHSIAIELCVPGFHGWATAALLITFCFGWVLIPACTLAILLVLKFFANILHTSNQENRFKAILRKIKEEFEKTKGSMVCEICKYECETLKELKAHNLSCVQGECPYCFTHCEPTETAIQAHYKVCQATHRFREDLKKTVTPQNIGPGCYRTLNLFRYKSRCYILTMWTLLLIIESILWAASAAEIPLVPLWTDNAHGVGSVPMHTDLELDFSLPSSSKYTYKRHLTNPVNDQQSVSLHIEIESQGIGADVHHLGHWYDARLNLKTSFHCYGACTKYQYPWHTAKCHFEKDYEYENSWACNPPDCPGVGTGCTACGLYLDQLKPVGTAFKIISVRYSRKVCVQFGEEYLCKTIDMNDCFVTRHAKICIIGTVSKFSQGDTLLFLGPMEGGGIIFKHWCTSTCHFGDPGDVMGPKDKPFICPEFPGQFRKKCNFATTPVCEYDGNIISGYKKVLATIDSFQSFNTSNIHFTDERIEWRDPDGMLRDHINIVISKDIDFENLAENPCKVGLQAANIEGAWGSGVGFTLTCQVSLTECPTFLTSIKACDMAICYGAESVTLSRGQNTVKITGKGGHSGSSFKCCHGKECSSTGLQASAPHLDKVNGISELKNEKVYDDGAPECGITCWFKKSGEWVMGIINGNWVVLIVLCVLLLFSFILLSILCPVRKHKKS

SEQ ID NO: 1136 - protein, 1133 aa, Artificial Sequence
  derived and/or modified protein sequence (wt) from SEOV(LongwanRn581)__GU592930.1__GP
MWSLLLLAALVGQGFALKNVFDMRIQCPHSVNFGETSVSGYTELPPLSLQEAEQLVPESSCNMDNHQSLSTINKLTKVIWRKKANQESANQNSFEVVESEVSFKGLCMLKHRMVEESYRNRRSVICYDLACNSTFCKPTVYMIVPIHACNMMKSCLIGLGPYRIQVVYERTYCTTGILTEGKCFVPDKAVVSALKRGMYAIASIETICFFIHQKGNTYKIVTAITSAMGSKCNNTDTKVQGYYICIIGGNSAPVYAPAGEDFRAMEVFSGIITSPHGEDHDLPGEEIATYQISGQIEAKIPHTVSSKNLKLTAFAGIPSYSSTSILAASEDGRFIFSPGLFPNLNQSVCDNNALPLIWRGLIDLTGYYEAVHPCNVFCVLSGPGASCEAFSEGGIFNITSPMCLVSKQNRFRAAEQQISFVCQRVDMDIIVYCNGQKKTILTKTLVIGQCIYTITSLFSLLPGVAHSIAIELCVPGFHGWATAALLITFCFGWVLIPACTLAILLVLKFFANILHTSNQENRFKAILRKIKEEFEKTKGSMVCEICKYECETLKELKAHNLSCVQGECPYCFTHCEPTETAIQAHYKVCQATHRFREDLKKTVTPQNIGPGCYRTLNLFRYKSRCYILTMWTLLLIIESILWAASAAEIPLVPLWTDNAHGVGSVPMHTDLELDFSLPSSSKYTYKRHLTNPVNDQQSVSLHIEIESQGIGADVHHLGHWYDARLNLKTSFHCYGACTKYQYPWHTAKCHFEKDYEYENSWACNPPDCPGVGTGCTACGLYLDQLKPVGTAFKIISVRYSRKVCVQFGEEYLCKTIDMNDCFVTRHAKICIIGTVSKFSQGDTLLFLGPMEGGGIIFKHWCTSTCHFGDPGDVMGPKDKPFICPEFPGQFRKKCNFATTPVCEYDGNIISGYKKVLATIDSFQSFNTSNIHFTDERIEWRDPDGMLRDHINIVISKDIDFENLAENPCKVGLQAANIEGAWGSGVGFTLTCQVSLTECPTFLTSIKACDMAICYGAESVTLSRGQNTVKITGKGGHSGSSFKCCHGKECSSTGLQANAPHLDKVNGISELENEKVYDDGAPECGVTCWFKKSGEWVMGIINGNWVVLIVLCVLLLFSLILLSILCPVRKHKKS

SEQ ID NO: 1137 - protein, 1133 aa, Artificial Sequence
  derived and/or modified protein sequence (wt) from SEOV(RuianRn180)__GU592931.1__GP
MWSLLIVAALVGQGFALKNVFDMRIQCPHSVNFGETSVSGYTELPPLSLQEAEQLVPESSCNMDNHQSLSTINKLTKVIWRKKANQESANQNSFEVVESEVSFKGLCMLKHRMVEESYRNRRSVICYDLACNSTFCKPTVYMIVPIHACNMMKSCLIGLGPYRIQVVYERTYCTTGILTEGKCFVPDKAVVSALKRGMYAIASIETICFFIHQKGNTYKIVTAITSAMGSKCNNTDTKVQGYYICIIGGNSAPVYAPAGEDFRAMEVFSGIITSPHGEDHDLPGEEIATYQISGQIEAKIPHTVSSKNLKLTAFAGIPSYSSTSILAASEDGRFIFSPGLFPNLNQSVCDNNALPLIWRGLIDLTGYYEAVHPCNVFCVLSGPGASCEAFSEGGIFNITSPMCLVSKQNRFRAAEQQISFICQRVDMDIIVYCNGQKKTILTKTLVIGQCIYTITSLFSLLPGVAHSIAIELCVPGFHGWATAALLITFCFGWVLIPACTLAILLVLKFFANILHTSNQENRFKAILRKIKEEFEKTKGSMVCEICKYECETLKELKAHNLSCVQGECPYCFTHCEPTETAIQAHYKVCQATHRFREDLKKTVTPQNIGPGCYRTLNLFRYKSRCYILTMWTLLLIIESILWAASAAEIPLVPLWTDNAHGVGSVPMHTDLELDFSLPSSSKYTYKRHLTNPVNDQQSVSLHIEIESQGIGADVHHLGHWYDARLNLKTSFHCYGACTKYQYPWHTAKCHFEKDYEYENSWACNPPDCPGVGTGCTACGLYLDQLKPVGTAFKIISVRYSRKVCVQFGEEYLCKTIDMNDCFVTRHAKICIIGTVSKFSQGDTLLFLGPMEGGGIIFKHWCTSTCHFGDPGDVMGPKDKPFICPEFPGQFRKKCNFATTPVCEYDGNIISGYKKVLATIDSFQSFNTSNIHFTDERIEWRDPDGMLRDHINIVISKDIDFENLAENPCKVGLQAANIEGAWGSGVGFTLTCQVSLTECPTFLTSIKACDMAICYGAESVTLSRGQNTVKITGKGGHSGSSFKCCHGKECSSTGLQASAPHLDKVNGISELENEKVYDDGAPECGVTCWFKKSGEWVMGIINGNWVVLIVLCVLLLFSLILLSILCPVRKHKKS

SEQ ID NO: 1138 - protein, 1133 aa, Artificial Sequence
  derived and/or modified protein sequence (wt) from SEOV(ShuangyangRn470)__GU592925.1__GP
MWSLLFLAALVGQGFALKNVFDMRIQCPHSVNFGETSVSGYTELPPLSLQESEQLVPESSCNMDNHQSLSTINKLTKVIWRKKANQESANQNSFEVVESEVSFKGLCMLKHRMVEESYRNRRSVICYDLACNSTFCKPTVYMIVPIHACNMMKSCLIGLGPYRIQVVYERTYCTTGILTEGKCFVPDKAVVSALKRGMYAIASIETICFFIHQKGNTYKIVTAITSAMGSKCNNTDTKVQGYYICIIGGNSAPVYAPAGEDFRAMEVFSGIITSPHGEDHDLPGEEIATYQISGQIEAKIPHTVSSKNLKLTAFAGIPSYSSTSILAASEDGRFIFSPGLFPNLNQSVCNNNALPLIWRGLIDLTGYYEAVHPCNVFCVLSGPGASCEAFSEGGIFNITSPMCLVSKQNRFRAAEQQISFVCQRVDMDIIVYCNGQKKTILTKTLVIGQCIYTITSLFSLLPGVAHSIAIELCVPGFHGWATAALLITFCFGWVLIPACTLAILLVLKFFANILHTSNQENRFKAILRKIKEEFEKTKGSMVCEICKYECETLKELKAHNLSCVQGECPYCFTHCEPTETAIQAHYKVCQATHRFREDLKKTVTPQNIGPGCYRTLNLFRYKSRCYILTMWTLLLIVESILWAASAAEIPLVPLWTDNAHGVGSVPMHTDLELDFSLPSSSKYTYKRHLTNPVNDQQSVSLHIEIESQGIGADVHHLGHWYDARLNLKTSFHCYGACTKYQYPWHTAKCHFEKDYEYENSWACNPPDCPGVGTGCTACGLYLDQLKPVGTAFKIISVRYSRKVCVQFGEEYLCKTIDMNDCFVTRHAKICIIGTVSKFSQGDTLLFLGPMEGGGIIFKHWCTSTCHFGDPGDVMGPKDKPFICPEFPGQFRKTCNFATTPVCEYDGNIISGYKKVLATIDSFQSFNTSNIHFTDERIEWRDPDGMLRDHINIVISKDIDFENLAENPCKVGLQAANIEGAWGSGVGFTLTCQVSLTECPTFLTSIKACDMAICYGAESVTLSRGQNTVKITGKGGHSGSSFKCCHGKECSSTGLQASAPHLDKVNGISELENEKVYDDGAPECGVTCWFKKSGEWVMGIINGNWVVLIVLCVLLLFSLILLSILCPVRKHKKS

SEQ ID NO: 1139 - protein, 1133 aa, Artificial Sequence
  derived and/or modified protein sequence (wt) from SEOV(WuhanMm13)__JQ665886.1__GP
MWSLLLLAALVGQGFALKNVFDMRIQCPHSVNFGETSVSGYTELPPLSLQEAEQLVPESSCNMDNHQSLSTINKLTKVIWRKKANQESANQNSFEVIESEVSFKGLCMLKHRMVEESYRNRRSVICYDLACNSTFCKPTVYMIVPIHACNMMKSCLIGLGPYRIQVVYERTYCTTGILTEGKCFVPDKAVVSALKRGMYAVASIETICFFIHQKGNTYKIVTAITSAMGSKCNNTDTKVQGYYICIIGGNSAPVYAPAGEDFRAMEVFSGIITSPHGEDHDLPGEEIATYQISGQIEAKIPHTVSSKNLKLTAFAGIPSYSSTSILAASEDGRFIFSPGLFPNLNQSVCDNNALPLIWRGLIDLTGYYEAVHPCNVFCVLSGPGASCEAFSEGGIFNITSPMCLVSKQNRFRAAEQQISFVCQRVDMDIIVYCNGQKKTILTKTLVIGQCIYTITSLFSLLPGVAHSIAIELCVPGFHGWATAALLTTFCFGWVLIPACTLAILLVLKFFANILHTSNQENRFKAILRKIKEEFEKTKGSMVCEICKYECETLKELKAHNLSCVQGECPYCFTHCEPTETAIQAHYKVCQATHRFREDLKKTVTPQNIGPGCYRTLNLFRYKSRCYILTMWTILLIIESILWAASAAEIPLVPLWTDNAHGVGSVPMHTDLELDFSLPSSSKYTYKRHLTNPVNDQQSVSLHIEIESQGIGADVHHLGHWYDARLNLKTSFHCYGACTKYQYPWHTAKCHFEKDYEYENSWACNPPDCPGVGTGCTACGLYLDQLKPVGTAFKIISVRYSRKVCVQFGEEYLCKTIDMNDCFVTRHAKICIIGTVSKFSQGDTLLFLGPMEGGGIIFKHWCTSTCHFGDPGDVMGPKDKPFICPEFPGQFRKKCNFATTPVCEYDGNIISGYKKVLATIDSFQSFNTSNIHFTDERIEWRDPDGMLRDHINIVISKDIDFENLAENPCKVGLQAANIEGAWGSGVGFTLTCQVSLTECPTFLTSIKACDMAICYGAESVTLSRGQNTVKITGKGGHSGSSFKCCHGKECSSTGLQASAPHLDKVNGISELENEKVYDDGAPECGITCWFKKSGEWVMGIINGNWVVLIALCVLLLFSLILLSILCPVRKHKKS

SEQ ID NO: 1140 - protein, 1133 aa, Artificial Sequence
  derived and/or modified protein sequence (wt) from SEOV(WuhanMm24)__JQ665887.1__GP
MWSLLLLAALVGQGFALKNVFDMRIQCPHSVNFGETSVSGYTELPPLSLQEAEQLVPESSCNMDNHQSLSTINKLTKVIWRKKANQESANQNSFEVMESEVSFKGLCMLKHRMVEESYRNRRSVICYDLACNSTFCKPTVYMIVPIHACNMMKSCLIGLGPYRIQVVYERTYCTTGILTEGKCFVPDKAVVSALKRGMYAIASIETICFFIHQKGNTYKIVTAITSAMGSKCNNTDTKVQGYYICIIGGNSAPVYAPAGEDFRAMEVFSGIITSPHGEDHDLPGEEIATYQISGQIEAKIPHTVSSKNLKLTAFAGIPSYSSTSILAASEDGRFIFSPGLFPNLNQSVCDNNALPLIWRGLIDLTGYYEAVHPCNVFCVLSGPGASCEAFSEGGIFNITSPMCLVSKQNRFRAAEQQISFVCQRVDMDIIVYCNGQKKTILTKTLVIGQCIYTITSLFSLLPGVAHSIAIELCVPGFHGWATAALLITFCFGWVLIPACTLAILLVLKFFANILHTSNQENRFKAILRKIKEEFEKTKGSMVCEICKYECETLKELKAHNLSCVQGECPYCFTHCEPTETAIQAHYKVCQATHRFREDLKKTVTPQNIGPGCYRTLNLFRYKSRCYILTMWTLLLIIESILWAASAAEIPLVPLWTDNAHGVGSVPMHTDLELDFSLPSSSRYTYKRHLTNPVNDQQSVSLHIEIESQGIGADVHHLGHWYDARLNLKTSFHCYGACTKYQYPWHTAKCHFEKDYEYENSWACNPPDCPGVGTGCTACGLYLDQLKPVGTAFKIISVRYSRKVCVQFGEEYLCKTIDMNDCFVTRHAKICIIGTVSKFSQGDTLLFLGPMEGGGIIFKHWCTSTCHFGDPGDVMGPKDKPFICPEFPGQFRKKCNFATSPVCEYDGNIISGYKKVLATIDSFQSFNTSNIHFTDERIEWRDPDGMLRDHINIVISKDIDFENLAENPCKVGLQAANIEGAWGSGVGFTLTCQVSLTECPTFLTSIKACDMAICYGAESVTLSRGQNTVKITGKGGHSGSSFKCCHGKECSLTGLQASAPHLDKVNGISELENEKVYDDGAPECGITCWFKKSGEWVMGIINGNWVVLIALCVLLLFSLILLSILCPVRKHKKS

SEQ ID NO: 1141 - protein, 1133 aa, Artificial Sequence
  derived and/or modified protein sequence (wt) from SEOV(WuhanRf02)__JQ665888.1__GP
MWSLLLLAALVGQGFALKNVFDMRIQCPHSVNFGETSVSGYTELPPLSLQEAEQLVPESSCNMDNHQSLSTINKLTKVIWRKKANQESANQNSFEVIESEVSFKGLCMLKHRMVEESYRNRRSVICYDLACNSTFCKPTVYMIVPIHACNMMKSCLIGLGPYRIQVVYERTYCTTGILTEGKCFVPDKAVVSALKRGMYAVASIETICFFIHQKGNTYKIVTAITSAMGSKCNNTDTKVQGYYICIIGGNSAPVYAPAGEDFRAMEVFSGIITSPHGEDHDLPGEEIATYQISGQIEAKIPHTVSSKNLKLTAFAGIPSYSSTSILAASEDGRFIFSPGLFPNLNQSVCDNNALPLIWRGLIDLTGYYEAVHPCNVFCVLSGPGASCEAFSEGGIFNITSPMCLVSKQNRFRAAEQRISFVCQRVDMDIIVYCNGQKKTILTKTLVIGQCIYTITSLFSLLPGVAHSIAIELCVPGFHGWATAALLTTFCFGWVLIPACTLAILLVLKFFANILHTSNQENRFKAILRKIKEEFEKTKGSVVCEICKYECETLKELKAHNLSCVQGECPYCFTHCEPTETAIQAHYKVCQATHRFREDLKKTVTPQNIGPGCYRTLNLFRYNSRPDGLTMWTLLLIIESILWAASAAEIPLVPLWADNAHGVGSVPMHTDLELDFSLPSSSKYTYKRHLTNPVNDQQSVSLHIEIESQGIGADVHHLGHWYDARLNLKTSFHCYGACTKYQYPWHTAKCHFEKDYEYENSWACNPPDCPGVGTGCTACGLYLDQLKPVGTAFKIISVRYSRKVCVQFGEEYLCKTIDMNDCFVTRHAKICIIGTVPKFSQGDTLLFLGPMEGGGIIFKHWCTSTCHFGDPGDVMGPKDKPFIRPEFPGQFRKKCNFATTPVCGYDGNIISGYKKVLATIDSFQSFNTSNIHFTDERIEWRDPDGMLRDHINIVISKDIDFENLAENPCKVGLQAANIEGAWGSGVGFTLTCQVSLTECPTFLTSIKACDMAICYGAESVTLSRGQNTVKITGKGGHSGSSFKCCHGKECSSTGLQASAPHLDKVNGISELENEKVYDDGAPECGITCWFKKSGEWVMGIINGNWVVLIALCVLLLFSLILLSILCPVRKHKKS

SEQ ID NO: 1142 - protein, 1133 aa, Artificial Sequence
  derived and/or modified protein sequence (wt) from SEOV(WuhanRf07)__JQ665889.1__GP
MWSLLLLAALVGQGFALKNVFDMRIQCPHSVNFGETSVSGYTELPPLSLQEAEQLVPESSCNMDNHQSLSTINKLTKVIWRKKANQESANQNSFEVIESEVSFKGLCMLKHRMVEESYRNRRSVICYDLACNSTFCKPTVYMIVPIHACNMMKSCLIGLGPYRIQVVYERTYCTTGILTEGKCFVPDKAVVSALKRGMYAVASIETICFFIHQKGNTYKIVTAITSAMGSKCNNTDTKVQGYYICIIGGNSAPVYAPAGEDFRAMEVFSGIITSPHGEDHDLPGEEIATYQISGQIEAKIPHTVSSKNLKLTAFAGIPSYSSTSILAASEDGRFIFSPGLFPNLNQSVCDNNALPLIWRGLIDLTGYYEAVHPCNVFCVLSGPGASCEAFSEGGIFNITSPMCLVSKQNRFRAAEQQISFVCQRVDMDIIVYCNGQKKTILTKTLVIGQCIYTITSLFSLLPGVAHSIAIELCVPGFHGWATAALLTTFCFGWVLIPACTLAILLVLKFFANILHTSNQENRFKAILRKIKEEFEKTKGSMVCEICKYECETLKELKAHNLSCVQGECPYCFTHCEPTETAIQAHYKVCQATHRFREDLKKTVTPQNIGPGCYRTLNLFRYKSRPYILTMWTILLIIESILWAASAAEIPLVPLWTDNAHGVGSVPMHTDLELDFSLPSSSKYTYKRHLTNPVNDQQSVSLHIEIESQGIGADVHHLGHWYDARLNLKTSFHCYGACTKYQYPWHTAKCHFEKDYEYENSWACNPPDCPGVGTGCTACGLYLDQLKPVGTAFKIISVRYSRKVCVQFGEEYLCKTIDMNDCFVTRHAKICIIGTVSKFSQGDTLLFLGPMEGGGIIFKHWCTSTCHFGDPGDVMGPKDKPFICPEFPGQFRKKCNFATTPVCEYDGNIISGYKKVLATIDSFQSFNTSNIHFTDERIEWRDPDGMLRDHINIVISKDIDFENLAENPCKVGLQAANIEGAWGSGVGFTLTCQVSLTECPTFLTSIKACDMAICYGAESVTLSRGQNTVKITGKGGHSGSSFKCCHGKECSSTGLQASAPHLDKVNGISELENEKVYDDGAPECGITCWFKKSGEWVMGIINGNWVVLIALCVLLLFSLILLSILCPVRKHKKS

SEQ ID NO: 1143 - protein, 1133 aa, Artificial Sequence
  derived and/or modified protein sequence (wt) from SEOV(WuhanRf18)__JQ665893.1__GP
MWSLLLLAALVGQGFALKNVFDMRIQCPHSVNFGETSVSGYTELPPLSLQEAEQLVPESSCNMDNHQSLSTINKLTKVIWRKKANQESANQNSFEVIESEVSFKGLCMLKHRMVEESYRNRRSVICYDLACNSTFCKPTVYMIVPIHACNMMKSCLIGLGPYRIQVVYERTYCTTGILTEGKCFVPDKAVVSALKRGMYAVASIETICFFIHQKGNTYKIVTAITSAMGSKCNNTDTKVQGYYICIIGGNSAPVYAPAGEDFRAMEVFSGIITSPHGEDHDLPGEEIATYQISGQIEAKIPHTVSSKNLKLTAFAGIPSYSSTSILAASEDGRFIFSPGLFPNLNQSVCDNNALPLIWRGLIDLTGYYEAVHPCNVFCVLSGPGASCEAFSEGGIFNITSPMCLVSKQNRFRAAEQRISFVCQRVDMDIIVYCNGQKKTILTKTLVIGQCIYTITSLFSLLPGVAHSIAIELCVPGFHGWATAALLTTFCFGWVLIPACTLAILLVLKFFANILHTSNQENRFKAILRKIKEEFEKTKGSMVCEICKYECETLKELKAHNLSCVQGECPYCFTHCEPTETAIQAHYKVCQATHRFREDLKKTVTPQNIGPGCYRTLNLFRYKSRCYILTMWTILLIIESILWAASAAEIPLVPLWTDNAHGVGSVPMHTDLELDFSLPSSSKYTYKRHLTNPVNDQQSVSLHIEIESQGIGADVHHLGHWYDARLNLKTSFHCYGACTKYQYPWHTAKCHFEKDYEYENSWACNPPDCPGVGTGCTACGLYLDQLKPVGTAFKIISVRYSRKVCVQFGEEYLCKTIDMNDCFVTRHAKICIIGTVSKFSQGDTLLFLGPMEGGGIIFKHWCTSTCHFGDPGDVMGPKDKPFICPEFPGQFRKKCNFATTPVCEYDGNIISGYKKVLATIDSFQSFNTSNIHFTDERIEWRDPDGMLRDHINIVISKDIDFENLAENPCKVGLQAANIEGAWGSGVGFTLTCQVSLTECPTFLTSIKACDMAICYGAESVTLSRGQNTVKITGKGGHSGSSFKCCHGKECSSTGLQASAPHLDKVNGISELENEKVYDDGAPECGITCWFKKSGEWVMGIINGNWVVLIALCVLLLFSLILLSILCPVRKHKKS

SEQ ID NO: 1144 - protein, 1133 aa, Artificial Sequence
  derived and/or modified protein sequence (wt) from SEOV(WuhanRn10)__JQ665896.1__GP
MWSLLLLAALVGQGFALKNVFDMRIQCPHSVNFGETSVSGYTELPPLSLQEAEQLVPESSCNMDNHQSLSTINKLTKVIWRKKANQESANQNSFEVIESEVSFKGLCMLKHRMVEESYRNRRSVICYDLACNSTFCKPTVYMIVPIHACNMMKSCLIGLGPYRIQVVYERTYCTTGILTEGKCFVPDKAVVSALKRGMYAVASIETICFFIHQKGNTYKIVTAITSAMGSKCNNTDTKVQGYYICIIGGNSAPVYAPAGEDFRAMEVFSGIITSPHGEDHDLPGEEIATYQISGQIEAKIPHTVSSKNLKLTAFAGIPSYSSTSILAASEDGRFIFSPGLFPNLNQSVCDNNALPLIWRGLIDLTGYYEAVHPCNVFCVLSGPGASCEAFSEGGIFNITSPMCLVSKQNRFRAAEQQISFVCQRVDMDIIVYCNGQKKTILTKTLVIGQCIYTITSLFSLLPGVAHSIAIELCVPGFHGWATAALLTTFCFGWVLIPACTLAILLVLKFFANILHTSNQENRFKAILRKIKEEFEKNKGSVVCEICKYECETLKELKAHNLSCVQGECPYCFTHCEPTETAIQAHYKVCQATHRFREDLKKTVTPQNIGPGCYRTLNLFRYKSRCYILTMWTILLIIESILWAASAAEIPLVPLWTDNAHGVGSVPMHTDLELDFSLPSSSKYTYKRHLTNPVNDQQSVSLHIEIESQGIGADVHHLGHWYDARLNLKTSFHCYGACTKYQYPWHTAKCHFEKDYEYENSWACNPPDCPGVGTGCTACGLYLDQLKPVGTAFKIISVRYSRKVCVQFGEEYLCKTIDMNDCFVTRHAKICIIGTVSKFSQGDTLLFLGPMEGGGIIFKHWCTSTCHFGDPGDVMGPKDKPFICPEFPGQFRKKCNFATTPVCEYDGNIISGYKKVLATIDSFQSFNTSNIHFTDERIEWRDPDGMLRDHINIVISKDIDFENLAENPCKVGLQAANIEGAWGSGVGFTLTCQVSLTECPTFLTSIKACDMAICYGAESVTLSRGQNTVKITGKGGHSGSSFKCCHGKECSSTGLQASAPHLDKVNGISELENEKVYDDGAPECGITCWFKKSGEWVMGIINGNWVVLIALCVLLLFSLILLSILCPVRKHKKS

SEQ ID NO: 1145 - protein, 1133 aa, Artificial Sequence
  derived and/or modified protein sequence (wt) from SEOV(WuhanRn25)__JQ665897.1__GP
MWSLLLLAALVGQGFALKNVFDMRIQCPHSVNFGETSVSGYTELPPLSLQEAEQLVPESSCNMDNHQSLSTINKLTKVIWRKKANQESANQNSFEVIESEVSFKGLCMLKHRMVEESYRNRRSVICYDLACNSTFCKPTVYMIVPIHACNMMKSCLIGLGPYRIQVVYERTYCTTGILTEGKCFVPDKAVVSALKRGMYAVASIETICFFIHQKGNTYKIVTAITSAMGSKCNNTDTKVQGYYICIIGGNSAPVYAPAGEDFRAMEVFSGIITSPHGEDHDLPGEEIATYQISGQIEAKIPHTVSSKNLKLTAFAGIPSYSSTSILAASEDGRFIFSPGLFPNLNQSVCDNNALPLIWRGLIDLTGYYEAVHPCNVFCVLSGPGASCEAFSEGGIFNITSPMCLVSKQNRFRAAEQQISFVCQRVDMDIIVYCNGQKKTILTKTLVIGQCIYTITSLFSLLPGVAHSIAIELCVPGFHGWATAALLTTFCFGWVLIPACTLAILLVLKFFANILHTSNQENRFKAILRKIKEEFEKNKGSMVCEICKYECETLKELKAHNLSCVQGECPYCFTHCEPTETAIQAHYKVCQATHRFREDLKKTVTPQNIGPGCYRTLNLFRYKSRCYILTMWTILLIIESILWAASAAEIPLVPLWTDNAHGVGSVPMHTDLELDFSLPSSSKYTYKRHLTNPVNDQQSVSLHIEIESQGIGADVHHLGHWYDARLNLKTSFHCYGACTKYQYPWHTAKCHFEKDYEYENSWACNPPDCPGVGTGCTACGLYLDQLKPVGTAFKIISVRYSRKVCVQFGEEYLCKTIDMNDCFVTRHAKICIIGTVSKFSQGDTLLFLGPMEGGGIIFKHWCTSTCHFGDPGDVMGPKDKPFICPEFPGQFRKKCNFATTPVCEYDGNIISGYKKVLATIDSFQSFNTSNIHFTDERIEWRDPDGMLRDHINIVISKDIDFENLAENPCKVGLQAANIEGAWGSGVGFTLTCQVSLTECPTFLTSIKACDMAICYGAESVTLSRGQNTVKITGKGGHSGSSFKCCHGKECSSTGLQASAPHLDKVNGISELENEKVYDDGAPECGITCWFKKSGEWVMGIINGNWVVLIALCVLLLFSLILLSILCPVRKHKKS

SEQ ID NO: 1146 - protein, 1133 aa, Artificial Sequence
  derived and/or modified protein sequence (wt) from SEOV(XiaotangshanRn7)__GU592929.1__GP
MWSLLFLAALVGQGFALKNVFDMRIQCPHSVNFGETSVSGYTELPPLSLQEAEQLVPESSCNMDNHQSLSTINKLTKVIWRRKANQESANQNSFEVVESEVSFKGLCMLKHRMVEESYRNRRSVICYDLACNSTFCKPTVYMIVPIHACNMMKSCLIGLGPYRIQVVYERTYCTTGILTEGKCFVPDKAVVSALKRGMYAIASIETICFFIHQKGNTYKIVTAITSAMGSKCNNTDTKVQGYYICIIGGNSAPVYAPAGEDFRAMEVFSGIITSPHGEDHDLPGEEIATYQISGQIEAKIPHTVSSKNLKLTAFAGIPSYSSTSILAASEDGRFIFSPGLFPNLNQSVCDNNALPLIWRGLIDLTGYYEAVHPCNVFCVLSGPGASCEAFSEGGIFNITSPMCLVSKQNRFRAAEQQISFVCQRVDMDIIVYCNGQKKTILTKTLVIGQCIYTITSLFSLLPGVAHSIAIELCVPGFHGWATAALLITFCFGWVLIPACTLAILLVLKFFANILHTSNQENRFKAILRKIKEEFEKTKGSMVCEICKYECETLKELKAHNLSCVQGECPYCFTHCEPTETAIQAHYKVCQATHRFREDLKKTVTPQNIGPGCYRTLNLFRYKSRCYILTMWTLLLIIESILWAASAAEIPLVPLWTDNAHGVGSVPMHTDLELDFSLPSSSKYTYKRHLTNPVNDQQSVSLHIEIESQGIGADVHHLGHWYDARLNLKTSFHCYGACTKYQYPWHTAKCHFEKDYEYENSWACNPPDCPGVGTGCTACGLYLDQLKPVGTAFKIISVRYSRKVCVQFGEEYLCKTIDMNDCFVTRHAKICIIGTVSKFSQGDTLLFLGPMEGGGIIFKHWCTSTCHFGDPGDVMGPKDKPFICPEFPGQFRKKCNFATTPVCEYDGNIISGYKKVLATIDSFQSFNTSNIHFTDERIEWRDPDGMLRDHINIVISKDIDFENLAENPCKVGLQAANIEGAWGSGVGFTLTCQVSLTECPTFLTSIKACDMAICYGAESVTLSRGQNTVKITGKGGHSGSSFKCCHGKECSSTGLQASAPHLDKVNGISELENEKVYDDGAPECGVTCWFKKSGEWVMGIINGNWVVLIVLCVLLLFSLILLSILCPVRKHKKS

SEQ ID NO: 1147 - protein, 1133 aa, Artificial Sequence
  derived and/or modified protein sequence (wt) from SEOV(YongjiaRf45)__GU592926.1__GP
MWGLLLLAAMVGQGSALKNVFDMKIQCPHSVNFGETSVSGYTELPPLPLQEAEQLVPESSCNMDNHQSLSTINKLTKVIWRKKANQESASQNSFEVVESEVSFKGLCMLKHRMVEESYRNRRSVICYDLACNTTFCKPTVYMIVPIHACNMMKSCLIGLGPYRIQVIYERTYCSTGILTEGKCFVHDKTVVSALKRGMYAIASIETVCFFVHQKGNTYKIVTAITSAMGSKCNNTDSKVQGYYICIIGGNSAPVYAPAGEDFRAMEVFSGIITSPHGEDHDLPGEEVATYQISGQIEAKIPHTVSSKNLKLTAFAGIPSYSSTSLLAASEDGRFIFSPGLFPNLNQSVCDNNALPLIWRGLIDLTGYYEAVHPCNVFCVLSGPGASCEAFSEGGIFNITSPMCLVSKQNRFRAAEQQISFICQRVDMDIIVYCNGQKKTILTKTLVIGQCIYTITSLFSLLPGVAHSIAIELCVPGFHGWATAALLITFCFGWVLIPACTLAVLLFLKFFANILHTSNQENRFKAILRKIKEEFEKTKGSMVCEICKYECETLKELKAHNLSCVQGECPYCFTHCEPTETAIQAHYKVCQATHRFREDLKKTVTPQNIGPGCYRTLNLFRYKSRCYILTMWILLLVIESILWAASAAEIPLVPLWTDNAHGVGSVPMHTDLELDFSLPSSSKYTYKRHLTNPVNDQQSVSLHIEIESQGIGADVHHLGHWYDARLNLKTSFHCYGACTKYQYPWHTAKCYFEKDYEYENSWACNPPDCPGVGIGCTACGLYLDQLKPVGTAFKIISVRYSRKVCVQFGEEYLCKTIDMNDCFVTRHAKICIIGTVSKFSQGDTLLFLGPMEGGGIIFKHWCTSTCHFGDPGDVMGPKDKPFICPEFPGQFRKKCNFATTPVCEYDGNVFSGYRKFLATIDSFQSFNTSNVHFTDERIEWRDPDGMLRDHINIVISKDIDFENLADNPCKVGLQAANIEGAWGSGVGFTLTCQVSLTECPTFLTSIKACDMAICYGAESVTLSRGQNTVKITGKGGHSGSSFKCCHGKECSSNGLQASAPHLDKVNGISELENEKVYDDGAPECGITCWFKKSGEWVMGIINGNWIVLIVLCVLLLFSLILLSILCPVRKHKKS

SEQ ID NO: 1148 - protein, 1133 aa, Artificial Sequence
  derived and/or modified protein sequence (wt) from SEOV(YongjiaRn14)__GU592927.1__GP
MWGLLLLAAMVGQGSALKNVFDMKIQCPHSVNFGETSVSGYTELPPLPLQEAEQLVPESSCNMDNHQSLSTINKLTKVIWRKKANQESASQNSFEVVESEVSFKGLCMLKHRMVEESYRNRRSVICYDLACNTTFCKPTVYMIVPIHACNMMKSCLIGLGPYRIQVIYERTYCTTGILTEGKCFVPDKAVVSALKRGMYAIASIETVCFFVHQKGNTYKIVTAITSAMGSKCNNTDSKVQGYYICIIGGNSAPVYAPAGEDFRAMEVFSGIITSPHGEDHDLPGEEVATYQISGQIEAKIPHTVSSKNLKLTAFAGIPSYSSTSLLAASEDGRFIFSPGLFPNLNQSVCDNNALPLIWRGLIDLTGYYEAVHPCNVFCVLSGPGASCEAFSEGGIFNITSPMCLVSKQNRFRAAEQQISFICQRVDMDIIVYCNGQKKTILTKTLVIGQCIYTITSLFSLLPGVAHSIAIELCVPGFHGWATAALLITFCFGWVLIPACTLAVLLFLKFFANILHTSNQENRFKAILRKIKEEFEKTKGSMVCEICKYECETLKELKAHNLSCVQGECPYCFTHCEPTETAIQAHYKVCQATHRFREDLKKTVTPQNIGPGCYRTLNLFRYKSRCYILTMWILLLVIESILWAASAAEIPLVPLWTDNAHGVGSVPMHTDLELDFSLPSSSKYTYKRHLTNPVNDQQSVSLHIEIESQGIGADVHHLGHWYDARLNLKTSFHCYGACTKYQYPWHTAKCHFEKDYEYENSWACNPPDCPGVGTGCTACGLYLDQLKPVGTAFKIISVRYSRKVCVQFGEEYLCKTIDMNDCFVTRHAKICIIGTVSKFSQGDTLLFLGPMEGGGIIFKHWCTSTCHFGDPGDVMGPKDKPFICPEFPGQFRKKCNFATTPVCEYDGNVISGYRKVLATIDSFQSFNTSNVHFTDERIEWRDPDGMLRDHINIVISKDIDFENLAENPCKVGLQAANIEGAWGSGVGFTLTCQVSLTECPTFLTSIKACDMAICYGAESVTLSRGQNTVKITGKGGHSGSSFKCCHGKECSSNGLQASAPHLDKVNGISELENEKVYDDGAPECGITCWFKKSGEWVMGIINGNWIVLIVLCVLLLFSLILLSILCPVRKHKKS

SEQ ID NO: 1149 - protein, 1133 aa, Artificial Sequence
  derived and/or modified protein sequence (wt) from SEOV(ZT10)__DQ159911.1__GP
MWSLLLLAALVGQGFALKNVFDMRIQCPHSVNFGETSVSGYTELPPLSLQEAEQLVPESSCNMDNHQSLSTINKLTKVIWRKKANQESANQNSFEVVESEVSFKGLCMLKHRMVEESYRNRRSVICYDLACNSTFCKPTVYMIVPIHACNMMKSCLIGLGPYRIQVVYERTYCTTGILTEGKCFVPDKAVVSALKRGMYAIASIETICFFIHQKGNKYKIVTAITSAMGSKCNNTDTKVQGYYICIIGGNSAPVYAPAGEDFRAMEVFSGIITSPHGEDHDLPGEEIATYQISGQIEAKIPHTVSSKNLKLTAFAGIPSYSSTSILAASEDGRFIFSPGLFPNLNQSVCDNNALPLIWRGLIDLTGYYEAVHPCNVFCVLSGPGASCEAFSEGGIFNITSPMCLVSKQIRFRAAEQQISFICQRVDMDIIVYCNGQKKTILTKTLVIGQCIYTITSLFSLLPGVAHSIAIELCVPGFHGWATAALLITFCFGWVLIPACTLAILLVLKFFANILHTSNQENRFKAILRKIKEEFEKTKGSMVCEICKYECETLKELKAHNLSCVQGECPYCFTHCEPTETAIQAHYKVCQATHRFREDLKKTVTPQNIGPGCYRTLNLFRYKSRCYILTMWTLLLIIESILWAASAAEIPLVPLWTDNAHGVGSVPMHTDLELDFSLPSSSKYTYKRHLTNPVNDQQSVSLHIEIESQGIGADVHHLGHCYDARLNLKTSFHCYGACTKYQYPWHTAKCHFEKDYEYENSWACNPPDCPGVGTGCTACGLYLDQLKPVGTAFKIISVRYSRKVCVQFGEEYLCKTIDMNDCFVTRHAKICIIGTVSKFSQGDTLLFLGPMEGGGIIFKHWCTSTCHFGDPGDVMGPKDKPFICPEFPGQFRKKCNFATTPVCEYDGNIISGYKKVLATIDSFQSFNTSNIHFTDERIEWRDPDGMLRDHINIVISKDIDFENLAENPCKVGLQAANIEGAWGLGVGFTLTCQVSLTECPTFLTSIKACDMAICYGAESVTLSRGQNTVKITGKGGHSGSSFKCCHGKECSSTGLQASAPHLDKVNGISELENEKVYDDGAPECGITCWFKKSGEWVMGIINGNWVVLIVLCVLLLFSLILLSILCPVRKHKKS

SEQ ID NO: 1150 - protein, 1133 aa, Artificial Sequence
  derived and/or modified protein sequence (wt) from SEOV(ZT71)__EF117248.1__GP
MWSLLLLAALVGQGFALKNVFDMRIQCPHSVNFGETSVSGYTELPPLSLQEAEQLVPESSCNMDNHQSLSTINKLTKVIWRKKANQESANQNSFEVVESEVSFKGLCMLKHRMVEESYRNRRSVICYDLACNSTFCKPTVYMIVPIHACNMMKSCLIGLGPYRIQVVYERTYCTTGILAEGKCFVPDKAVVSALKRGMYAIASIETICFFIHQKGNKYKIVTAITSAMGSKCNNTDTKVQGYYICIIGGNSAPVYAPAGEDFRAMEVFSGIITSPHGEDHDLPGEEIATYQISGQIEAKIPHTVSSKNLKLTAFAGIPSYSSTSILAASEDGRFIFSPGLFPNLNQSVCDNNALPLIWRGLIDLTGYYEAVHPCNVFCVLSGPGASCEAFSEGGIFNITSPMCLVSKQNRFRAAEQQISFICQRVDMDIIVYCNGQKKTILTKTLVIGQCIYTITSLFSLLPGVAHSIAIELCVPGFHGWATAALLITFCFGWVLIPACTLAILLVLKFFANILHTSNQENRFKAILRKIKEEFEKTKGSMVCEICKYECETLKELKAHNLSCVQGECPYCFTHCEPTETAIQAHYKVCQATHRFREDLKKTVTPQNIGPGCYRTLNLFRYKSRCYILTMWTLLLIIESILWAASAAEIPLVPLWTDNAHGVGSVPMHTDLELDFSLPSSSKYTYKRHLTNPVNDQQSVSLHIEIESQGIGADVHHLGHWYDAGLNLKTSFHCYGACTKYQYPWHTAKCHFEKDYEYENSWACNPPDCPGVGTGCTACGLYLDQLKPVGTAFKIISVRYSRKVCVQFGEEYLCKTIDMNDCFVTRHAKICIIGTVSKFSQGDTLLFLGPMEGGGIIFKHWCTSTCHFGDPGDVMGPKDKPFICPEFPGQFRKKCNFATTPVCEYDGNIISGYKKVLATIDSFQSFNTSNIHFTDERIEWRDPDGMLRDHINIVISKDIDFETLAENPCKVGLQAANIEGAWGSGVGFTLTCQVSLTECPTFLTSIKACDMAICYGAESVTLSRGQNTVKITGKGGHSGSSFKCCHGKECSSTGLQASAPHLDKVNGISELENEKVYDDGAPECGITCWFKKSGEWVMGIINGNWVVLIVLCVLLLFSLILLSILCPVRKHKKS

SEQ ID NO: 1151 - protein, 1133 aa, Artificial Sequence
  derived and/or modified protein sequence (wt) from SEOV(DN2)__KX289953.1__GP
MWSLLLLAALAGQGFALKNVFDMRIQCPHSVNFGETSVSGYTELPPLSLQEAEQLVPESSCNMDNHQSLSTINKLTKVIWRKKANQESASQNSFEVVESEVSFKGLCMLKHRMVEESYRNRRSVICYDLACNSTFCKPTVYMIVPIHACNMMKSCLIGLGPYRIQVVYERTYCTTGILTEGKCFVPDKAVVSALKRGMYAIASIETICFFIHQKGNTYKIVTAITSAMGSKCNNTDTKVQGYYICIIGGNSAPVYAPAGEDFRAMEVFSGIITSPHGEDHDLPGEEIATYQISGQIEAKIPHTVSSKNLKLTAFAGIPSYSSTSILAASEDGRFIFSPGLFPNLNQSVCDNNALPLIWRGLIDLTGYYEAVHPCNVFCVLSGPGASCEAFSEGGIFNITSPMCLVSKQNRFRAAEQQISFVCQRIDMDIIVYCNGQKKTILTKTLVIGQCIYTITSLFSLLPGVAHSIAIELCVPGFHGWATAALLITFCFGWVLIPACTLAILLVLKFFANILHTSNQENRFKAILRKIKEEFEKTKGSMVCEICKYECETLKELKAHNLSCVQGECPYCFTHCEPTETAIQAHYKVCQATHRFREDLKKTVTPQNIGPGCYRTLNLFRYKSRCYILTMWTLLLIIESILWAASAAEIPLIPLWTDNAHGVGSVPMHTDLELDFSLPSSSKYTYKRHLTNPVNDQQSVSLHIEIESQGIGADVHHLGHWYDARLNLKTSFHCYGACTKYQYPWHTAKCHFEKDYEYENSWACNPPDCPGVGTGCTACGLYLDQLRPVGTAFKIISVRYSRKVCVQFGEEYLCKTIDMNDCFVTRHAKICIIGTVSKFSQGDTLLFLGPMEGGGIIFKHWCTSTCHFGDPGDVMGPKDKPFICPEFPGQFRKKCNFATTPVCEYDGNTISGYKKVLATIDSFQSFNTSNIHFTDERIEWRDPDGMLRDHINIVISKDIDFENLAENPCKVGLQAANIEGAWGSGVGFTLTCQVSLTECPTFLTSIKACDMAICYGAESVTLSRGQNTVKITGKGGHSGSSFKCCHGKECSSTGLQASAPHLDKVNGISELENEKVYDDGAPECGITCWFKKSGEWVMGIINGNWVVLIVLCVLLLFSLILLSILCPVRKHKKS

SEQ ID NO: 1152 - protein, 1133 aa, Artificial Sequence
  derived and/or modified protein sequence (wt) from SEOV(IR162)__KX079475.1__GP
MWSLLLLAALVGRGFTLKNVFDMRIQCPHSVNFGETSVSGYTELPPLSLQEAEQLVPESSCNMDNHQSLSTINKLTKVIWRKKANQESANQNSFEVVESEVSFKGLCMLKHRMVEESYRNRRSVICYDLACNSTFCKPTVYMIVPIHACNMMKSCLIGLGPYRIQVVYERTYCTTGILTEGKCFVPDKAVVSALKRGMYAIASIETICFFIHQKGNTYKIVTAITSAMGSKCNNTDTKVQGYYICIIGGNSAPVYAPAGEDFRAMEVFSGIITSPHGEDHDLPGEEIATYQISGQIEAKIPHTVSSKNLKLTAFAGIPSYSSTSVLIASEDGRFIFSPGLFPNLNQSVCDNNALPLIWRGLIDLTGYYEAVHPCNVFCVLSGPGASCEAFSEGGIFNITSPMCLVSKQNRFRAAEQQISFVCQRVDMDIIVYCNGQKKTILTKTLVIGQCIYTITSLFSLLPGVAHSIAIELCVPGFHGWATAALLITFCFGWVLIPACTLAILLVLKFFANILHTSNQENRFKAILRKIKEEFEKTKGSMVCEICKYECETLKELKAHNLSCVQGECPYCFTHCEPTETAIQAHYKVCQATHRFREDLKKTVTPQNIGPGCYRTLNLFRYKSRCYILTMWTLLLIIESILWAASATEIPLVPLWTDNAHGVGSVPMHTDLELDFSLPSSSKYTYKRHLTNPVNDQQSVSLHIEIESQGIGADVHHLGHWYDARLNLKTSFHCYGACTKYQYPWHTAKCHFEKDYEYENSWACNPPDCPGIGTGCTACGLYLDQLKPVGTAFKIISVRYSRKVCVQFGEEYLCKTIDMNDCFVTRHAKICIIGTVSKFSQGDTLLFLGPMEGGGIIFKHWCTSTCHFGDPGDVMGPKDKPFICPEFPGQFRKKCNFATTPVCEYDGNIISGYKKVLATIDSFQSFNTSNIHFTDERIEWRDPDGMLRDHINIVISKDIDFENLAENPCKVGLQAANIEGAWGSGVGFTLTCQVSLTECPTFLTSIKACDMAICYGAESVTLSRGQNTVKITGKGGHSGSSFKCCHGKECSSTGLQASAPHLDKVNGISDLENEKVYDDGAPECGITCWFKKSGEWVMGIINGNWVVLIVLCVLLLFSLILLSILCPVRKHKKS

SEQ ID NO: 1153 - protein, 1133 aa, Artificial Sequence
  derived and/or modified protein sequence (wt) from SEOV(Gou3)__AF145977.2__GP
MWGLLLLAALVGQGLALKNVFDMKIQCPHSVNFGETSVSGYTELPPLPLQEAEQLVPESSCNMDNHQSLSTINKLTKVIWRKKANQESASQNSFEVVENEVSFKGLCMLKHRMVEESYRNRRSVICYDLACNTTFCKPTVYMIVPIHACNMMKSCLIGLGPYRIQVIYERTYCTTGILTEGKCFVPDKAVVSALKRGMYAIASIETICFFVHKKGNTYKIVSAITLAMGSKCNNTDSKVQGYYICIIGGNSAPVYAPAGEDFRAMEVFSGIITSPHGEDHDLPGEEIATYQISGQIEAKIPHTVSSKNLKLTAFAGIPSYSSTSILAASEDGRFIFSPGLFPNLNQSVCDNNALPLIWRGLIDLTGYYEAIHPCNVFCVLSGPGASCEAFSEGGIFNITSPMCLVSKQNRFRAAEQQISFICQRVDMDIVVYCNGQKKTILTKTLVIGQCIYTITSLFSLLPGVAHSIAIELCVPGFHGWATAALLVTFCFGWVLIPACTLAVLLFLKFFANILHTSNQENRFKAILRKIKEEFEKTKGSMVCEICKYECETLKELKAHNLSCVQGECPYCFTHCEPTETAIQAHYKVCQATHRFREDLKKTVTPQNIGPGCYRTLNLFRYKSRCYILTMWILLLVIESILWAASAAEIPLVPLWTDNAHGVGSVPMHTDLELDFSLPSSSKYTYKRHLTNPVNDQQSVSLHIEIESQGIGADVHHLGHWYDARLNLKTSFHCYGACTKYQYPWHTAKCHFEKDYEYENSWACNPPDCPGVGAGCTACGLYLDQLKPVGTAFKIISVRYSRKVCVQFGEEYLCKTIDMNDCFVTRHAKICIIGTVSKFSQGDTLLFLGPMEGGGIIFKHWCTSTCHFGDPGDVMGPKDKPFICPEFPGQFRKKCNFATTPVCEYDGNVISGYRKVLATIDSFQSFNTSNVHFTDERIEWKDPDGMLRDHINIVISKDIDFENLAENPCKVGLQAANIEGAWGSGVGFTLTCQVSLTECPTFLTSIEACDMAICYGAESVTLSRGQNTIKITGKGGHSGSSFKCCHGKECSANGLQASAPHLDKVNGISELENEKVYDDGAPECGITCWFKKSGEWVMGIINGNWVVLIVLCVLLLFSLILLSILCPVRKHKKS

SEQ ID NO: 1154 - protein, 1133 aa, Artificial Sequence
  derived and/or modified protein sequence (wt) from SEOV(HB55)__AF035832.1__GP
MWSLLLLAALVGQGFALKNVFDMRIQCPHSVNFGETSVSGYTELPPLSLQEAEQLVPESSCNMDNHQSLSTINKLTKVVWRKKANQESANQNSFEVVESEVSFKGLCMLKHRMVEESYRNRRSVICYDLACNSTFCKPTVYMIVPIHACNMMKSCLIGLGPYRIQVVYERTYCTTGILTEGKCFVPDKAVVGALKRGMYAIASIETICFFIHQKGNKYKIVTAITSAMGSKCNNTDTKVQGYYICIIGGNSAPVYAPAGEDFRAMEVFSGIITSPHGEDHDLPGEEIATYQISGQIEAKIPHTVSSKNLKLIAFAGIPSYSSTSILAASEDGRFIFSPGLFPNLNQSVCDNNALPLIWRGLIDLTGYYEAVHPCNVFCVLSGPGASCEAFSEGGIFNITSPMCLVSKQNRFRAAEQQISFICQRVDMDIIVYCNGQKKTILTKTLVIGQCIYTITSLFSLLPGVAHSIAIELCVPGFHGWATAALLITFCFGWVLIPACTLAILLVLKFFANILHTSNQENRFKAILRKIKEEFEKTKGSMVCEICKYECETLKELKAHNLSCVQGECPYCFTHCEPTETAIQAHYKVCQATHRFREDLKKTVTPQNIGPGCYRTLNLFRYKSRCYILTMWTLLLIIESILWAASAAEIPLVPLWTDNAHGVGSVPMHTDLELDFSLPSSSKYTYKRHLTNPVNDQQSVSLHIEIESQGIGADVHHLGHWYDARLNLKTSFHCYGACTKYQYPWHTAKCHFEKDYEYENSWACNPPDCPGVGTGCTACGLYLDQLKPVGTAFKIISVRYSRKACVQFGEEYLCKTIDMNDCFVTGHAKICIIGTVSKFSQGDTLLFLGPMEGGGIIFKHWCTSTCHFGDPGDVMGPKDKPFICPEFPGQFRKKCNFATTPICEYDGNIISGYKKVLATIDSFQSFNTSNIHFTDERIEWRDPDGMLRDHINIVISKDIDFENLAENPCKVGLQAANIEGAWGSGVGFTLTCQVSLTECPTFLTSIKACDMAICYGAESVTLSRGQNTVRITGKGGHSGSSFKCCHGKECSSTGLQASAPHLDKVNGISELENEKVYDDGAPECGVTCWFKKSGEWVMGIINGNWVVLIVLCVLLLFSLILLSILCPVRKHKKS

SEQ ID NO: 1155 - protein, 1133 aa, Artificial Sequence
  derived and/or modified protein sequence (wt) from SEOV(L99)__AF035833.1__GP
MWSLLLLAALVGQGFALKNVFDMRIQCPHSVNFGETSVSGYTELPPLSLQEAEQLVPESSCNMDNHQSLSTINKLTKVVWRKKANQELANQNSFEVVESEVSFKGLCMLKHRMVEESYRNRRSVICYDLACNSTFCKPTVYMIVPIHACNMMKSCLIGLGPYRIQVVYERTYCTTGILTEGKCFVPDKAVVSALKRGMYAIASIETICFFIHQKGNTYKIVTAITSAMGSKCNNTDTKVQGYYICIIGGNSAPVYAPAGEDFRAMEVFSGIITSPHGEDHDLPGEEIATYQISGQIEAKIPHTVSSKNLKLIAFAGIPSYSSTSILAASEDGRFIFSPGLFPNLNQSVCDNNALPLIWRGLIDLTGYYEAVHPCNVFCVLSGPGASCEAFSEGGIFNITSPMCLVSKQNRFRAAEQQISFICQRVDMDIIVYCNGQKKTILTKTLVIGQCIYTITSLFSLLPGVAHSIAIELCVPGFHGWATAALLITFCFGWVLIPACTLAILLVLKFFANILHTSNQENRFKAILRKIKEEFEKTKGSMVCEICKYECETLKELKAHNLSCVQGECPYCFTHCEPTETAIQAHYKVCQATHRFREDLKKTVTPKNIGPGCYRTLNLFRYKSRCYILTMWTLLLIIESILWAASAAEIPLVPLWTDNAHGVGSVPMHTDLELDFSLPSSSKYTYKRHLTNPVNDQQSVSLHIEIESQGIGADVHHLGHWYDARLNLKTSFHCYGACTKYQYPWHTAKCHFEKDYEYENSWACNPPDCPGVGTGCTACGLYLDQLKPVGTAFKIISVRYSRKVCVQFGEEYLCKTIDMNDCFVTRHAKICIIGTVSKFSQGDTLLFLGPMEGGGIIFKHWCTSTCHFGDPGDVMGPKDKPFSCPEFPGQFRKKCNFATTPICEYDGNIISGYKKVLATIDSFQSFNTSNIHFTDERIEWRDPDGMLRDHINIVISKDIDFENLAENPCKVGLQAANIEGAWGSGVGFTLTCQVSLTECPTFLTSIKACDMAICYGAESVTLSRGQNTVRITGKGGHSGSSFKCCHGKECSSTGLQASAPHLDKVNGISELENEKVYDDGAPECGVTCWFKKSGEWVMGIINGNWVVLIVLCVLLLFSLILLSILCPVRKHKKS

SEQ ID NO: 1156 - protein, 1133 aa, Artificial Sequence
  derived and/or modified protein sequence (wt) from SEOV(Z37)__AF187081.1__GP
MWSLLLLAALVGQGFALKNVFDMRIQCPHSVNFGETSVSGYTELPPLSLQEAEQLVPESSCNMDNHQSLSTINKLTKVIWRKKANQESANQNSFEVVESEVSFKGLCMLKHRMVEESYRNRRSVICYDLACNSTFCKPTVYMIVPIHACNMMKSCLIGLGPYRIQVVYERTYCTTGILTEGKCFVPDKAVVSALKRGMYAIASIETICFFIHQKGNKYKIVTAITSAMGSKCNNTDTKVQGYYICIIGGNSAPVYAPAGEDFRAMEVFSGIITSPHGEDHDLPGEEIATYQISGQIEAKIPHTVSSKNLKLTAFAGIPSYSSTSILAASEDGRFIFSPGLFPNLNQSVCDNNALPLIWRGLIDLTGYYEAVHPCNVFCVLSGPGASCEAFSEGGIFNITSPMCLVSKQIRFRAAEQQISFICQRVDMDIIVYCNGQKKTILTKTLVIGQCIYTITSLFSLLPGVAHSIAIELCVPGFHGWATAALLITFCFGWVLIPACTLAILLVLKFFANILHTSNQENRFKAILRKIKEEFEKTKGSMVCEICKYECETLKELKAHNLSCVQGECPYCFTHCEPTETAIQAHYKVCQATHRFREDLKKTVTPQNIGPGCYRTLNLFRYKSRCYILTMWTLLLIIESILWAASAAEIPLVPLWTDNAHGVGSVPMHTDLELDFSLPSSSKYTYKRHLTNPVNDQQSVSLHIEIESQGIGADVHHLGHWYDARLNLKTSFHCYGACTKYQYPWHTAKCHFEKDYEYENSWACNPPDCPGVGTGCTACGLYLDQLKPVGTAFKIISVRYSRKVCVQFGEEYLCKTIDMNDCFVTRHAKICIIGTVSKFSQGDTLLFLGPMEGGGIIFKHWCTSTCHFGDPGDVMGPKDKPFICPEFPGQFRKKCNFATTPVCEYDGNIISGYKKVLATIDSFQSFNTSNIHFTDERIEWRDPDGMLRDHINIVISKDIDFENLAENPCKVGLQAANIEGAWGSGVGFTLTCQVSLTECPTFLTSIKACDMAICYGAESVTLSRGQNTVKITGKGGHSGSSFKCCHGKECSSTGLQASTPHLDKVNGISELENEKVYDDGAPECGITCWFKKSGEWVMGIINGNWVVLIVLCVLLLFSLILLSILCPVRKHKKS

SEQ ID NO: 1157 - protein, 1133 aa, Artificial Sequence
  derived and/or modified protein sequence (wt) from SEOV(Z37)__AF190119.1__GP
MWSLLLLAALVGQGFALKNVFDMRIQCPHSVNFGETSVSGYTELPPLSLQEAEQLVPESSCNMDNHQSLSTINKLTKVIWRKKANQESANQNSFEVVESEVSFKGLCMLKHRMVEESYRNRRSVICYDLACNSTFCKPTVYMIVPIHACNMMKSCLIGLGPYRIQVVYERTYCTTGILTEGKCFVPDKAVVSALKRGMYAIASIETICFFIHQKGNTYKIVTAITSAMGSKCNNTDTKVQGYYICIIGGNSAPVYAPAGEDFRAMEVFSGIITSPHGEDHDLPGEEIATYQISGQIEAKIPHTVSSKNLKLTAFAGIPSYSSTSILAASEDGRFIFSPGLFPNLNQSVCDNNALPLIWRGLIDLTGYYEAVHPCNVFCVLSGPGASCEAFSEGGIFNITSPMCLVSKQNRFRAAEQQISFICQRVDMDIIVYCNGQKKTILTKTLVIGQCIYTITSLFSLLPGVAHSIAIELCVPGFHGWATAALLITFCFGWVLIPACTLAILLVLKFFANILHTSNQENRFKAILRKIKEEFEKTKGSMVCEICKYECETLKELKAHNLSCVQGECPYCFTHCEPTETAIQAHYKVCQATHRFREDLKKTVTPQNIGPGCYRTLNLFRYKSRCYILTMWTLLLIIESILWAASAAEIPLVPLWTDNAHGVGSVPMHTDLELDFSLPSSSKYTYKRHLTNPVNDQQSVSLHIEIESQGIGADVHHLGHWYDARLNLKTSFHCYGACTKYQYPWHTAKCHFEKDYEYENSWACNPPDCPGVGTGCTACGLYLDQLKPVGTAFKIISVRYSRKVCVQFGEEYLCKTIDMNDCFVTRHAKICIIGTVSKFSQGDTLLFLGPMEGGGIIFKHWCTSTCHFGDPGDVMGPKDKPFICPEFAGQFRKKCNFATTPVCEYDGNIISGYKKVLETIDSFQSFNTSNIHFTDERIEWRDPDGMLRDHINIVISKDIDFENMAENPCKVGLQAANIEGAWGSGVGFTLTCQVSLTECPTSLTSIKACDMAICYGAESVTLSRGQNTVKITGKGGHSGSSFKRCHGKECSSTGLQASAPHLDKVNGISELENEKVYDDGAPECGITCWFKKSGEWVMGIINGNWVVLIVLCVLLLFSLILLSILCPVRKHKKS

SEQ ID NO: 1158 - protein, 1133 aa, Artificial Sequence
  derived and/or modified protein sequence (wt) from SEOV__M34882.1__GP
MWSLLLLAALVGQGFALKNVFDMRIQLPHSVNFGETSVSGYTEFPPLSLQEAEQLVPESSCNMDNHQSLSTINKLTKVIWRKKANQESANQNSFEVVESEVSFKGLCMLKHRMVEESYRNRRSVICYDLACNSTFCKPTVYMIVPIHACNMMKSCLIGLGPYRIQVVYERTYCTTGILTEGKCFVPDKAVVSALKRGMYAIASIETICFFIHQKGNTYKIVTAITSAMGSKCNNTDTKVQGYYICIIGGNSAPVYAPAGEDFRAMEVFSGIITSPHGEDHDLPGEEIATYQISGQIEAKIPHTVSSKNLKLTAFAGIPSYSSTSILAASEDGRFIFSPGLFPNLNQSVCDNNALPLIWRGLIDLTGYYEAVHPCNVFCVLSGPGASCEAFSEGGIFNITSPMCLVSKQNRFRAAEQQISFVCQRVDMDIIVYCNGQKKTILTKTLVIGQCIYTITSLFSLLPGVAHSIAIELCVPGFHGWATAALLITFCFGWVLIPACTLAILLVLKFFANILHTSNQENRFKAILRKIKEEFEKTKGSMVCEICKYECETLKELKAHNLSCVQGECPYCFTHCEPTETAIQAHYKVCQATHRFREDLKKTVTPQNIGPGCYRTLNLFRYKSRCYILTMWTLLLIIESILWAASAAEIPLVPLWTDNAHGVGSVPMHTDLELDFSLPSSSKYTYKRHLTNPVNDQQSVSLHIEIESQGIGAAVHHLGHWYDARLNLKTSFHCYGACTKYQYPWHTAKCHFEKDYEYENSWACNPPDCPGVGTGCTACGLYLDQLKPVGTAFKIISVRYSRKVCVQFGEEHLCKTIDMNDCFVTRHAKICIIGTVSKFSQGDTLLFLGPMEGGGIIFKHWCTSTCHFGDPGDVMGPKDKPFICPEFPGQFRKKCNFATTPVCEYDGNIISGYKKVLATIDSFQSFNTSNIHFTDERIEWRDPDGMLRDHINIVISKDIDFENLAENPCKVGLQAANIEGAWGSGVGFTLTCKVSLTECPTFLTSIKACDMAICYGAESVTLSRGQNTVKITGKGGHSGSSFKCCHGKECSSTGLQASAPHLDKVNGISELENEKVYDDGAPECGITCWFKKSGEWVMGIINGNWVVLIVLCVLLLFSLILLSILCPVRKHKKS

SEQ ID NO: 1159 - protein, 1140 aa, Artificial Sequence
  derived and/or modified protein sequence (wt) from SNV(NM H10)__NC_005215.1__GP
MVGWVCIFLVVLTTATAGLTRNLYELKIECPHTVGLGQGYVTGSVEITPILLTQVADLKIESSCNFDLHVPATTTQKYNQVDWTKKSSTTESTNAGATTFEAKTKEINLKGTCNIPPTTFEAAYKSRKTVICYDLACNQTHCLPTVHLIAPVQTCMSVRSCMIGLLSSRIQVIYEKTYCVTGQLIEGLCFIPTHTIALTQPGHTYDTMTLPVTCFLVAKKLGTQLKLAVELEKLITGVSCTENSFQGYYICFIGKHSEPLFVPTMEDYRSAELFTRMVLNPRGEDHDPDQNGQGLMRIAGPVTAKVPSTETTETMQGIAFAGAPMYSSFSTLVRKADPEYVFSPGIIAESNHSVCDKKTVPLTWTGFLAVSGEIEKITGCTVFCTLAGPGASCEAYSETGIFNISSPTCLVNKVQKFRGSEQRINFMCQRVDQDVVVYCNGQKKVILTKTLVIGQCIYTFTSLFSLIPGVAHSLAVELCVPGLHGWATTALLITFCFGWLLIPAVTLIILKILRLLTFSCSHYSTESKFKVILERVKVEYQKTMGSMVCDICHHECETAKELETHKKSCPEGQCPYCMTITESTESALQAHFAICKLTNRFQENLKKSLKRPEVRKGCYRTLGVFRYKSRCYVGLVWGILLTTELIIWAASADTPLMESGWSDTAHGVGIIPMKTDLELDFALASSSSYSYRRKLVNPANQEETLPFHFQLDKQVVHAEIQNLGHWMDGTFNIKTAFHCYGECKKYAYPWQTAKCFFEKDYQYETSWGCNPPDCPGVGTGCTACGVYLDKLRSVGKAYKIVSLKYTRKVCIQLGTEQTCKHIDVNDCLVTPSVKVCMIGTISKLQPGDTLLFLGPLEQGGIILKQWCTTSCVFGDPGDIMSTTSGMRCPEHTGSFRKICGFATTPTCEYQGNTVSGFQRMMATRDSFQSFNVTEPHITSNRLEWIDPDSSIKDHINMVLNRDVSFQDLSDNPCKVDLHTQSIDGAWGSGVGFTLVCTVGLTECANFITSIKACDSAMCYGATVTNLLRGSNTVKVVGKGGHSGSLFKCCHDTDCTEEGLAASPPHLDRVTGYNQIDSDKVYDDGAPPCTIKCWFTKSGEWLLGILNGNWVVVAVLIVILILSILLFSFFCPVRSRKNKAN

SEQ ID NO: 1160 - protein, 1140 aa, Artificial Sequence
  derived and/or modified protein sequence (wt) from SNV(1)__JQ690283.1__GP
MVGWVCIFLVVLTTATAGLTRNLYELKIECPHTVGLGQGYVTGSVETTPILLTQVADLKIESSCNFDLHVPATTTQKYNQVDWTKKSSTTESTNAGAATFEAKTKEVNLKGTCNIPPTTFEAAYKSRKTVICYDLACNQTHCLPTVHLIAPVQTCMSVRSCMIGLLSSRIQVIYEKTYCVTGQLIEGLCFIPTHTIALTQPGHTYDTMTLPVTCFLVAKKLGTQLKLAVELEKLITGVSCTENSFQGYYICFIGKHSEPLFVPTMEDYRSAELFTRMVLNPRGEDHDPDQNGQGLMRIAGPVTAKVPSTETTETMQGIAFAGAPMYSSFSTLVRKADPEYVFSPGIIAESNHSVCDKKTVPLTWTGFLAVSGEIERITGCTVFCTLAGPGASCEAYSETGIFNISSPTCLVNKVQKFRGSEQRINFMCQRVDQDVVVYCNGQKKVILTKTLVIGQCIYTFTSLFSLIPGVAHSLAVELCVPGLHGWATTALLITFCFGWLLIPTVTLIILKVLRLLTFSCSHYSTESKFKVILERVKVEYQKTMGSMVCDICHHECETAKELETHKKSCPEGQCPYCMTITESTESALQAHFSICKLTNRFQENLKKSLKRPEVRKGCYRTLGVFRYKSRCYVGLVWGILLTTELIIWAASADTPLMESGWSDTAHGVGIIPMKTDLELDFALASSSSYSYRRKLVNPANQEETLPFHFQLDKQVVHAEIQNLGHWMDGTFNIKTAFHCYGECKKYAYPWQTAKCFFEKDYQYETSWGCNPPDCPGVGTGCTACGVYLDKLRSVGKAYKIVSLKYTRKVCIQLGTEQTCKHIDVNDCLVTPSVKVCMIGTISKLQPGDTLLFLGPLEQGGIILKQWCTTSCVFGDPGDIMSTTSGMRCPEHTGSFRKICGFATTPTCEYQGNTVSGFQRMMATRDSFQSFNVTEPHITSNRLEWIDPDSSIKDHINMVLNRDVSFQDLSDNPCKVDLHTQSIDGAWGSGVGFTLVCTVGLTECANFITSIKACDSAMCYGATVTNLLRGSNTVKVVGKGGHSGSLFKCCHDTDCTEEGLAASPPHLDRVTGYNQIDSDKVYDDGAPPCTIKCWFTKSGEWLLGILNGNWVVVAVLIVILILSILLFSFFCPVRNRKNKAN

SEQ ID NO: 1161 - protein, 1140 aa, Artificial Sequence
  derived and/or modified protein sequence (wt) from SNV(1)__JQ690279.1__GP
MVGWVCIFLVVLTTATAGLTRNLYELKIECPHTVGLGQGYVTGSVETTPILLTQVADLKIESSCNFDLHVPATTTQKYNQVDWTKKSSTTESTNAGANTFEAKTKEINLKGTCNIPPTTFEAAYKSRKTVICYDLACNQTHCLPTVHLIAPVQTCMSVRSCMIGLLSSRIQVIYEKTYCVTGQLIEGLCFIPTHTIALTQPGHTYDTMTLPVTCFLVAKKLGTQLKLAVELEKLITGVSCTENSFQGYYICFIGKHSEPLFVPTMEDYRSAELFTRMVLNPRGEDHDPDQNGQGLMRIAGPVTAKVPSTETTETMQGIAFAGAPMYSSFSTLVRKADPEYVFSPGIIAESNHSVCDKKTVPLTWTGFLAVSGEIERITGCTVFCTLAGPGASCEAYSETGIFNISSPTCLVNKVQKFRGSEQRINFMCQRVDQDVVVYCNGQKKVILTKTLVIGQCIYTFTSLFSLIPGVAHSLAVELCVPGLHGWATTALLITFCFGWLLIPTVTLLILKILRLLTFSCSHYSTESKFKVILERVKVEYQKTMGSMVCDICHHECETAKELETHKKSCPEGQCPYCMTITESTESALQAHFSICKLTNRFQENLKKSLKRPEVKKGCYRTLGVFRYKSRCYVGLVWGILLTTELIIWAASADTPLMESGWSDTAHGVGIIPMKSDLELDFALASSSSYSYRRKLVNPANQEETLPFHFQLDKQVVHAEIQNLGHWMDGTFNIKTAFHCYGECKKYAYPWQTAKCFFEKDYQYETSWGCNPPDCPGVGTGCTACGVYLDKLRSVGKAYKIVSLKYTRKVCIQLGTEQTCKHIDVNDCLVTPSVKVCMIGTISKLQPGDTLLFLGPLEQGGIILKQWCTTSCVFGDPGDIMSTTSGMRCPEHTGSFRKICGFATTPTCEYQGNTVSGFQRMMATRDSFQSFNVTEPHITSNRLEWIDPDSSIKDHINMILNRDVSFQDLSDNPCKVDLHTQSIDGAWGSGVGFTLVCTVGLTECANFITSIKACDSAMCYGATVTNLLRGSNTVKVVGKGGHSGSLFKCCHDTDCTEEGLAASPPHLDRVTGYNQIDSDKVYDDGAPPCTIKCWFTKSGEWLLGILNGNWVVVAVLIVILILSILLFSFFCPVRSRKNKAN

SEQ ID NO: 1162 - protein, 1140 aa, Artificial Sequence
  derived and/or modified protein sequence (wt) from SNV(2)__JQ690284.1__GP
MVGWVCIFLVVLTTATAGLTRNLYELKIECPHTVGLGQGYVTGSVETTPILLTQVADLKIESSCNFDLHVPATTTQKYNQVDWTKKGSTTESTNAGANTFEAKTKEVNLKGTCNIPPTTFEAAYKSRKTVICYDLACNQTHCLPTVHLIAPVQTCMSVRSCMIGLLSSRIQVIYEKTYCVTGQLIEGLCFIPTHTIALTQPGHTYDTMTLPVTCFLVAKKLGTQLKLAVELEKLITGVSCTENSFQGYYICFIGKHSEPLFVPTMEDYRSAEVFTRMVLNPRGEDHDPDQNGQGLMRIAGPVTAKVPSTETTETMQGIAFAGAPMYSSFSTLVRKADPEYVFSPGIIAESNHSVCDKKTVPLTWTGFLAVSGEIERITGCTVFCTLAGPGASCEAYSETGIFNISSPTCLVNKVQKFRGSEQRINFMCQRVDQDVVVYCNGQKKVILTKTLVIGQCIYTFTSLFSLIPGVAHSLAVELCVPGLHGWATTALLITFCFGWLLIPTVTLIILKILRLLTFSCSHYSTESKFKVILERVKVEYQKTMGSMVCDICHHECETAKELETHKKSCPEGQCPYCMTITESTESALQAHFSICKLTNRFQENLKKSLKRPEVKKGCYRTLGVFRYKSRCYVGLVWGILLTTELIIWAASADTPLMESGWSDTAHGVGIIPMKTDLELDFALASSSSYSYRRKLVNPANQEETLPFHFQLDKQVVHAEIQNLGHWMDGTFNIKTAFHCYGECKKYAYPWQTAKCFFEKDYQYETSWGCNPPDCPGVGTGCTACGVYLDKLRSVGKAYKIVSLKYTRKVCIQLGTEQTCKHIDVNDCLVTPSVKVCMIGTISKLQPGDTLLFLGPLEQGGIILKQWCTTSCVFGDPGDIMSTTSGMRCPEHTGSFRKICGFATTPTCEYQGNTVSGFQRMMATRDSFQSFNVTEPHITSNRLEWIDPDSSIKDHINMVLNRDVSFQDLSDNPCKVDLHTQSIDGAWGSGVGFTLVCTVGLTECANFITSIKACDSAMCYGATVTNLLRGSNTVKVVGKGGHSGSLFKCCHDTDCTEEGLAASPPHLDRVTGYNQIDSDKVYDDGAPPCTIKCWFTKSGEWLLGILNGNWVVVAVLIVILILSILLFSFFCPVRSRKNKAN

SEQ ID NO: 1163 - protein, 1140 aa, Artificial Sequence
  derived and/or modified protein sequence (wt) from SNV(2)__JQ690280.1__GP
MVGWVCIFLVVLTTATAGLTRNLYELKIECPHTVGLGQGYVTGSVETTPILLTQVADLKIESSCNFDLHVPATTTQKYNQVDWTKKSSTTESTNAGANTFEAKTKEVNLKGTCNIPPTTFEAAYKSRKTVICYDLACNQTHCLPTVHLIAPVQTCMSVRSCMIGLLSSRIQVIYEKTYCVTGQLIEGLCFIPTHTIALTQPGHTYDTMTLPVTCFLVAKKLGTQLKLAVELEKLITGVSCTENSFQGYYICFIGKHSEPLFVPTMEDYRSAELFTRMVLNPRGEDHDPDQNGQGLMRIAGPVTAKVPSTETTETMQGIAFAGAPMYSSFSTLVRKADPEYVFSPGIIAESNHSVCDKKTVPLTWTGFLAVSGEIERITGCTVFCTLAGPGASCEAYSETGIFNISSPTCLVNKVQKFRGSEQRINFMCQRVDQDVVVYCNGQKKVILTKTLVIGQCIYTFTSLFSLIPGVAHSLAVELCVPGLHGWATTALLITFCFGWLLIPTVTLIILKILRLLTFSCSHYSTESKFKVILERVKVEYQKTMGSMVCDICHHECETAKELETHKKSCPEGQCPYCMTITESTESALQAHFSICKLTNRFQENLKKSLKRPEVKKGCYRTLGVFRYKSRCYVGLVWGILLTTELIIWAASADTPLMESGWSDTAHGVGIIPMKTDLELDFALASSSSYSYRRKLVNPANQEETLPFHFQLDKQVVHAEIQNLGHWMDGTFNIKTAFHCYGECKKYAYPWQTAKCFFEKDYQYETSWGCNPPDCPGVGTGCTACGVYLDKLRSVGKAYKIVSLKYTRKVCIQLGTEQTCKHIDVNDCLVTPSVKVCMIGTISKLQPGDTLLFLGPLEQGGIILKQWCTTSCVFGDPGDIMSTTSGMRCPEHTGSFRKICGFATTPTCEYQGNTVSGFQRMMATRDSFQSFNVTEPHITSNRLEWIDPDSSIKDHINMVLNRDVSFQDLSDNPCKVDLHTQSIDGAWGSGVGFTLVCTVGLTECANFITSIKACDSAMCYGATVTNLLRGSNTVKVVGKGGHSGSLFKCCHDTDCTEEGLAASPPHLDRVTGYNQIDSDKVYDDGAPPCTIKCWFTKSGEWLLGILNGNWVVVAVLIVILILSILLFSFFCPVRSRKNKAN

SEQ ID NO: 1164 - protein, 1140 aa, Artificial Sequence
  derived and/or modified protein sequence (wt) from SNV(CC107/POR)__KT885045.1__GP
MVGWVCIFLVVLTTATAGLTRNLYELKIECPHTVGLGQGYVTGSVETTPILLTQVADLKIESSCNFDLHVPATTTQKYNQVDWTKKSSTTESTNAGATTFEAKTKEVNLKGTCNIPPTTFEAAYKSRKTVICYDLACNQTHCLPTVHLIAPVQTCMSVRSCMIGLLSSRIQVIYEKTYCVTGQLIEGLCFIPTHTIALTQPGHTYDTMTLPVTCFLVAKKLGTQLKLAVELEKLITGVSCTENSFQGYYICFIGKHSEPLFVPTMEDYRSAELFTRMVLNPRGEDHDPDQNGQGLMRIAGPVTAKVPSTETTETMQGIAFAGAPMYSSFSTLVRKADPEYVFSPGIIAESNHSVCDKKTVPLTWTGFLAVSGEIERITGCTVFCTLAGPGASCEAYSETGIFNISSPTCLVNKVQKFRGSEQRINFMCQRVDQDVVVYCNGQKKVILTKTLVIGQCIYTFTSLFSLIPGVAHSLAVELCVPGLHGWATTALLITFCFGWLLIPTVTLIILKILRLLTFSCSHYSTESKFKVILERVKVEYQKTMGSMVCDICHHECETAKELETHKKSCPEGQCPYCMTITESTESALQAHFSICKLTNRFQENLKKSLKRPEVRKGCYRTLGVFRYKSRCYVGLVWGILLTTELIIWAASADTPLMESGWSDTAHGVGIVPMKTDLELDFALASSSSYSYRRKLVNPANQEETLPFHFQLDKQVVHAEIQNLGHWMDGTFNIKTAFHCYGECKKYAYPWQTAKCFFEKDYQYETSWGCNPPDCPGVGTGCTACGVYLDKLRSVGKAYKIVSLKYTRKVCIQLGTEQTCKHIDVNDCLVTPSVKVCMIGTISKLQPGDTLLFLGPLEQGGIILKQWCTTSCVFGDPGDIMSTTSGMRCPEHTGSFRKICGFATTPTCEYQGNTVSGFQRMMATRDSFQSFNVTEPHITSNRLEWIDPDSSIKDHINMVLNRDVSFQDLSDNPCKVDLHTQSIDGAWGSGVGFTLVCTVGLTECANFITSIKACDSAMCYGATVTNLLRGSNTVKVVGKGGHSGSLFKCCHDTDCTEEGLAASPPHLDRVTGYNQIDSDKVYDDGAPPCTIKCWFTKSGEWLLGILNGNWVVVAVLIVILILSILLFSFFCPVRNRKNKAN

SEQ ID NO: 1165 - protein, 1140 aa, Artificial Sequence
  derived and/or modified protein sequence (wt) from HPS(Convict Creek 107)__L33474.1__GP
MVGWVCIFLVVLTTATAGLTRNLYELKIECPHTVGLGQGYVTGSVETTPILLTQVADLKIESSCNFDLHVPATTTQKYNQVDWTKKSSTTESTNAGATTFEAKTKEVNLKGTCNIPPTTFEAAYKSRKTVICYDLACNQTHCLPTVHLIAPVQTCMSVRSCMIGLLSSRIQVIYEKTYCVTGQLIEGLCFIPTHTIALTQPGHTYDTMTLPVTCFLVAKKLGTQLKLAVELEKLITGVSCTENSFQGYYICFIGKHSEPLFVPTMEDYRSAELFTRMVLNPRGEDHDPDQNGQGLMRIAGPVTAKVPSTETTETMQGIAFAGAPMYSSFSTLVRKADPEYVFSPGIIAESNHSVCDKKTVPLTWTGFLAVSGEIERITGCTVFCTLAGPGASCEAYSETGIFNISSPTCLVNKVQKFRGSEQRINFMCQRVDQDVVVYCNGQKKVILTKTLVIGQCIYTFTSLFSLIPGVAHSLAVELCVPGLHGWATTALLITFCFGWLLIPTVTLIILKILRLLTFSCSHYSTESKFKVILERVKVEYQKTMGSMVCDICHHECETAKELETHKKSCPEGQCPYCMTITESTESALQAHFSICKLTNRFQEILKKSLKRPEVRKGCYRTLGVFRYKSRCYVGLVWGILLTTELIIWAASADTPLMESGWSDTAHGVGIVPMKTDLELDFALASSSSYSYRRKLVNPANQEETLPFHFQLDKQVVHAEIQNLGHWMDGTFNIKTAFHCYGECKKYAYPWQTAKCFFEKDYQYETSWGCNPPDCPGVGTGCTACGVYLDKLRSVGKAYKIVSLKYTRKVCIQLGTEQTCKHIDVNDCLVTPSVKVCMIGTISKLQPGDTLLFLGPLEQGGIILKQWCTTSCVFGDPGDIMSTTSGMRCPEHTGSFRKICGFATTPTCEYQGNTVSGFQRMMATRDSFQSFNVTEPHITSNRLEWIDPDSSIKDHINMVLNRDVSFQDLSDNPCKVDLHTQSIDGAWGSGVGFTLVCTVGLTECANFITSIKACDSAMCYGATVTNLLRGSNTVKVVGKGGHSGSLFKCCHDTDCTEEGLAASPPHLDRVTGYNQIDSDKVYDDGAPPCTIKCWFTRSGEWLLGILNGNWVVVAVLIVILILSILLFSFFCPVRNRKNKAN

SEQ ID NO: 1166 - protein, 1140 aa, Artificial Sequence
  derived and/or modified protein sequence (wt) from HPS(Convict Creek 74)__L33684.1__GP
MVGWVCIFLVVLTTATAGLTRNLYELKIECPHTVGLGQGYVTGSVETTPILLTQVADLKIESSCNFDLHVPATTTQKYNQVDWTKKSSTTESTNAGATTFEAKTKEVNLKGTCNIPPTTFEAAFKSRKTVICYDLACNQTHCLPTVHLIAPVQTCMSVRSCMIGLLSSRIQVIYEKTYCVTGQLIEGLCFIPTHTIALTQPGHTYDTMTLPVTCFLVAKKLGTQLKLAVELEKLITGVSCTENSFQGYYICFIGKHSEPLFVPTMEDYRSAELFTRMVLNPRGEDHDPDQNGQGLMRIAGPVTAKVPSTETTETMQGIAFAGAPMYSSFSTLVRKADPEYVFSPGIIAESNHSVCDKKTVPLTWTGFLAVSGEIERITGCTVFCTLAGPGASCEAYSETGIFNISSPTCLVNKVQKFRGSEQRINFMCQRVDQDVVVYCNGQKKVILTKTLVIGQCIYTFTSLFSLIPGVAHSLAVELCVPGLHGWATTALLITFCFGWLLIPTVTLIILKILRLLTFSCSHYSTESKFKVILERVKVEYQKTMGSMVCDICHHECETAKELETHKKSCPEGQCPYCMTITESTESALQAHFSICKLTNRFQEILKKSLKRPEVRKGCYRTLGVFRYKSRCYVGLVWGILLTTELIIWAASADTPLMESGWSDTAHGVGIVPMKTDLELDFALASSSSYSYRRKLVNPANQEETLPFHFQLDKQVVHAEIQNLGHWMDGTFNIKTAFHCYGECKKYAYPWQTAKCFFEKDYQYETSWGCNPPDCPGVGTGCTACGVYLDKLRSVGKAYKIVSLKYTRKVCIQLGTEQTCKHIDVNDCLVTPSVKVCMIGTISKLQPGDTLLFLGPLEQGGIILKQWCTTSCVFGDPGDIMSTTSGMRCPEHTGSFRKICGFATTPTCEYQGNTVSGFQRMMATRDSFQSFNVTEPHITSNRLEWIDPDSSIKDHINMVLNRDVSFQDLSDNPCKVDLHTQSIDGAWGSGVGFTLVCTVGLTECANFITSIKACDSAMCYGATVTNLLRGSNTVKVVGKGGHSGSLFKCCHDTDCTEEGLAASPPHLDRVTGYNQIDSDKVYDDGAPPCTIKCWFTKSGEWLLGILNGNWVVVAVLIVILILSILLFSFFCPVRNRKNKAN

SEQ ID NO: 1167 - protein, 1140 aa, Artificial Sequence
  derived and/or modified protein sequence (wt) from BRV(Indiana)__AF030551.1__GP
MVGWVCIFLVVLTTATAGLTRNLYELKIECPHTVGLGQGYVTGSVETTPVPLGQVTDLKIESSCNFDLHVPSTTIQKYNQVEWAKKTSTTESTNAGASTFEAKTKEVNLKGTCNIPVTTFEAAYKSRKTVICYDLACNQTHCLPTVHLIAPVQTCMSVRSCMIGLLSSRIHVIYEKTYCVTGQVVEGLCFIPTHTIALTQPGHTYDTMTLPITCFLVAKKLGTQLKIAVELEKLITASGCTENSFQGYYICFLGKHSEPLYVPTMDDYRSAELFTRMVLNPKGEDHDPDQDGQGLMRITGPITAKVPSTETTETMQGVAFAGTPMYSSFSTLLRKADPEYVFSPGIIPESNHSVCDKKTMPITWTGFLAVSGEIEKITGCTVFCTLAGPGASCEAYSETGIFNISSPTCLVNKVQKFRGSEQRVNFMCQRVDQDVVVYCNGQKKVILTKTLVIGQCIYTFTSLFSLLPGVAHSLAVELCVPGLHGWATTALLITFCFGWLLIPSVTLIILRILRLLTFSCSHYSTESKFKILLEKVKVEYQKTMGSMVCDICHHECETAKELDTHRKSCPEGQCPYCMTMTESTESALQAHFSVCKLTNRFQENLKKSLKHPEVKQGCYRTLGVFRYKSRCYVGLVWGILLTAELIIWAASAETPLMESGWSDTAHGVGIVPMKTDLELDFALASSSSYSYRRKLVNPANSEETLPFHLQLEKQVVHAEIHNLGHWMDGTFNIKTAFHCYGECKKYAYPWQTAKCFFEKDYQYETSWGCNPPDCPGVGTGWTACGVYLDKLRSVGKAYKIVSLKYTRKVCIQLGTEQTCKHIDVNDCLVTPSVKVCMIGTVSKLQPGDTLLFLGPLEQGGIILKQWCTTSCVFGDPGDIMSTTSGMKCPEHTGSFRKICGFATTPTCEYQGNTVSGFKRMMATRDSFQSFNVTEPHITSNRLEWIDPDSSIKDHINVVLNRDVSFQDLSDNPCKVDLHTQSIDGAWGSGVGFTLVCTVGLTECANFITSIKACDLAMCYGATVTNLLRGSNTVKVVGKGGHSGSLFKCCHDTDCTDEGLAASPPHLDRVTGFNQIDSDKVYDDGAPPCSVKCWFTKSGEWLLRILNGNWMVVAVLIVILILSILLFSFFCPIRSRKSKPN

SEQ ID NO: 1168 - protein, 1140 aa, Artificial Sequence
  derived and/or modified protein sequence (wt) from BRV(Oklahoma)__AF030552.1__GP
MVGWVCIFLVVLTTSTAGLTRNLYELKIECPHTVGLGQGYVTGSVEITPVPLGQVTDLKIESSCNFDLHVPSTTIQKYTQVEWAKKSSTTESTNAAATTFEAKTKEVSLKGTCNIPVTTFEAAYKSRKTVICYDLACNQTHCLPTVHLIAPVQTCMSVRSCMVGLLSSRIQVIYEKTYCVTGQLVEGLCFIPTHTIALTQPGHTYDTMTLPITCFLVAKKLGTQLKIAVELEKLITASGCTENSFQGYYICFLGKHSEPMYVPTMDDYRSAELFTRMVLNPKGEDHDPDQNGQGLMRIAGPITAKVPSTETTETMQGIAFAGAPMYSTFATLVRKADPEYVFSPGIIPESNHSVCDKKTMPITWTGFLALSGEIERITGCTVFCTLAGPGASCEAYSETGIFNISSPTCLVNKVQKFRGSEQRINFMCQRVDQDVVVYCNGQKKVILTKTLVIGQCIYTFTSLFSLLPGVAHSLAVELCVPGLHGWATTALLITFCFGWLLIPAITLIVLKILRLLTFSCSHYSKESRFKILLEKVKVEYQKTMGSMVCDICHHDCETAKELDTHKKSCPEGQCPYCMTMTESTESALQAHFSVCKLTNRFQENLKKSLKHPEVKQGCYRTLGVFRYKSRCYVGLVWGLLLTTELIIWAASAETPLMESGWSDTAHGVGIVPMRTDLELDFALASSSSYSYRRKLVNPANTEETLPFHLQLEKQVVHAEIQNLGHWMDGTFNIKTAFHCYGECKKYAYPWQTAKCFFEKDYQYETSWGCNPPDCPGVGTGCTACGVYLDKLRSVGKAYKIVSLKYTRKVCIQLGTEQTCKHIDVNDCLVSPSVKVCMIGTVSKLQPGDTLLFLGPLEQGGIILKQWCTTSCVFGDPGDIMSTTSGMRCPEHTGSFRKICGFATTPTCEYQGNTISGFKRMMATRDSFQSFNVTEPHITSNRLEWIDPDSSIKDHINVVLNRDVSFQDLSDNPYKVDLHTQSIDGAWGSGVGFTLVCIVGLTECANFITSIKACDMAMCYGATVTNLLRGSNTVKVVGKGGHSGSLFKCCHDTDCTEEGLAASPPHLDRVTGYNQIDSDKVCDDGAPLCSVKCWFTKSGEWLLGILNGNWMVVAVLVVILILSILLFSFFCPIRSKKSKPN

SEQ ID NO: 1169 - protein, 1132 aa, Artificial Sequence
  derived and/or modified protein sequence (wt) from THAIV(Thai749)__L08756.1__GP
MWGLLVIAVLVGPGFAIKNVYDMKIECPHSVNFGETSVTGQVELPALPITEAEQLVPESSCNMDNHQSLATINTLTKVSWRKKADQVSASQNSFEVIEAETSFKGLCMLKHRMIEESFKNRRSVICYDLSCNTTFCKPTVYMVVPVHACNMMKSCLVGLGPYRVQVVYERTYCTVGILTEGKCFIPDKTILSSIKRGMFVVTSVQVLCFFIVQKGHSYKIMDEVKKSMMNKCNDTENKVQGYYICILGGNSAPVYVPSLDDFRSMEIFSNMLRSPFGEDHDLPGEEFSTYQIAGPTEAKVPHTASSKNLALIAYSGNPSYSSLSLITSSQDGRYVFSPGLFPNLNQTQCEKNALPMVWRGMIDLSGYYEAIHPCNIFCVLSGPGASCEAFSEGGIFNITSPTCLVSKQNRFRAAEQQINFVCQRVDMDIVVYCNGQKKTILTKTLIIGQCIYTITSLFSLLPGVAHSIAIELCVPGFHGWATAALLITFCFGWILIPTITLAVLVVLKFIANILHTNSQENRFKLILKKVKEEFEKTKGSMVCEVCKYECETSKELKAHNLSCPQSKCPYCFTHCEPTEATFKAHYKVCQATHRFREDLKKTVTPQTVGPGCYRTLNLFRYKSRCYILTMWLFLLSIESIMWAASAAEIPLVPLWTDNAHGIGSVPMHTDLELDFSLPSSSKYTYKRKLTNPVNTEQGVQLHIEIEEQGIGADVHHLGHWFDARLNLKTSFHCYGACSKYQYPWHTAKCHFEKDYEYENSWACNPADCPGVGTGCTACGLYLDQMKPIGTAYKLVAIRYSRKACVQFGEEHLCKTIDMNDCFVTRHVKICIIGTVSKFIQGDTLLFLGPLEGGGLIFKHWCTSTCQFGDPGDIMSPKDKPFLCPEFPGQFRKKCNFATTPVCEYDGNQISGYKKMKATIDSFQSFNTSSIHFTDERLMEDPDGMLRDHINIVVTKDIDFENLAENLCGIGLQVSAIKGAWGSGVGFTLTCQVSLTECPTFLTSIKACDMAICYGAESVTLVRGQNTVKISGKGGHSGSSFKCCHGVDCSSNGLQANPPHLDRVAGVSELTNEKVYDDGAPQCGIACWFIKSGEWVKGIFSGNWIVLIVLCVLLLISLILLGIFCPVRKHKKS

SEQ ID NO: 1170 - protein, 1141 aa, Artificial Sequence
  derived and/or modified protein sequence (wt) from TULV(Moravia/5302v/95)__NC_005228.1__GP
MFCLCLSLLGLLLCWPAATRNLLELKVECPHTIGLGQGIVIGSAELPPVPLAKVESLKLESSCNFDLHTSTAAQQAFTKWSWEKKADTAENAKAASTTFQSSSKEVQLRGLCVIPTLVLETASRTRKTVTCFDLSCNQTVCQPTVYLMAPIQTCVTTKSCLLGLGDQRIQVVYEKTYCVSGQLIEGNCFNPLHTIAISQPTHTYDIMTLAVHCFFISKKGGTDDTLKIEKQFETLVEKTGCTENALKGYYACILGTSSEVVYVPAMDDYRSSEILSRMTTAPHGEDHDIDPNAISSLRIVGQLTGKAPSTESSDTVQGIAFAGTPLYTSTSILVRKEDPIYLWSPGIIPEGNHSQCDKKTLPLTWTGFITLPGEIEKTTQCTVFCTLSGPGADCEAYSDTGIFNISSPTCLVNRVQRFRGAEQQVKFVCQRVDLDITVYCNGVKKVILTKTLVIGQCIYTFTSIFSLMPGVAHSLAVELCVPGLHGWATISLLITFCFGWLAIPLLSMIIIRFLLIFTYLCSKYSTDSKFKLIIEKVKQEYQKTMGSMVCEVCQQGCETAKELESHKKSCPHGQCPYCLNPTEATESALQAHFKVCKLTTRFQENLKKSLSTYEPKRGLYRTLSMFRYKSKCYVGLVWCILLTMELIVWAASAETINLEPGWTDTAHGSGIIPLKTDLELDFSLPSSATYTYRRELQNPANEQEKIPFHFQMERQVIHAEIQHLGHWMDGTFNLKTAFHCYGSCIKYAYPWQTAKCFLEKDFEFETGWGCNPPDCPGVGTGCTACGVYLDKLRSVGKVYKILSLKYTRKVCIQLGTEQTCKTIDSNDCLVTTSVKVCMIGTISKFQPGDTLLFLGPLEEGGMIFKQWCTTTCQFGDPGDIMSTPLGMKCPEHAGSFRKKCSFATLPSCQYDGNTVSGYQRMIATKDSFQSFNITEPHITTNSLEWVDPDSSLKDHVNLIVNRDLSFQDLAENPCQVDLSVSSIDGAWGSGVGFNLVCSVSLTECASFLTSIKACDSAMCYGSSTANLVRGQNTVHVVGKGGHSGSKFMCCHDKKCSATGLVAAAPHLDRVTGYNQIDTNKVFDDGAPQCGVHCWFKKSGEWLLGILSGNWMVVAVLIALFIFSLLLFSLCCPRRQNYKKNK

SEQ ID NO: 1171 - protein, 1684 aa, Artificial Sequence
  derived and/or modified protein sequence (wt) from CCHFV(10200)__U39455.2__GP
MHISLMYAILCLQLCGLGETHGSHNETRHNKTDTMTTHGDNPSSEPPVSTALSITLDPSTVTPTTPASGLEGSGEVYTSPPITTGSLPLSETTPELPVTTGTDTLSAGDVDPSTQTAGGTSAPTVRTSLPNSPSTPSTPQDTHHPVRNLLSVTSPGPDETSTPSGTGKESSATSSPHPVSNRPPTPPATAQGPTENDSHNATEHPESLTQSATPGLMTSPTQIVHPQSATPITVQDTHPSPTNRSKRNLKMEIILTLSQGLKKYYGKILRLLQLTLEEDTEGLLEWCKRNLGLDCDDTFFQKRIEEFFITGEGHFNEVLQFRTPGTLSTTESTPAGLPTAEPFKSYFAKGFLSIDSGYYSAKCYSGTSNSGLQLINITRHSTRIVDTPGPKITNLKTINCINLKASIFKEHREVEINVLLPQVAVNLSNCHVVIKSHVCDYSLDIDGAVRLPHIYHEGVFIPGTYKIVIDKKNKLNDRCTLFTDCVIKGREVRKGQSVLRQYKTEIRIGKASTGFRRLLSEEPSDDCVSRTQLLRTETAEIHGDNYGGPGDKITICNGSTIVDQRLGSELGCYTINRVRSFKLCENSATGKNCEIDSVPVKCRQGYCLRITQEGRGHVKLSRGSEVVLDACDTSCEIMIPKGTGDILVDCSGGQQHFLKDNLIDLGCPKIPLLGKMAIYICRMSNHPKTTMAFLFWFSFGYVITCILCKAIFYLLIIVGTLGRRLKQYRELKPQTCTICETTPVNAIDAEMHDLNCSYNICPYCASRLTSDGLARHVIQCPKRKEKVEETELYLNLERIPWVVRKLLQVSESTGVALKRSSWLIVLLVLFTVSLSPVQSAPIGQGKTIEAYRAREGYTSICLFVLGSILFIVSCLMKGLVDSVGNSFFPGLSICKTCSISSINGFEIESHKCYCSLFCCPYCRHCSTDKEIHKLHLSICKKRKTGSNVMLAVCKLMCFRATMEVSNRALFIRSIINTTFVLCILILAVCVVSTSAVEMENLPAGTWEREEDLTNFCHQECQVTETECLCPYEALVLRKPLFLDSTAKGMKNLLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFVNLLNIETDYTKNFHFHSKRVTAHGDTPQLDLKARPTYGAGEITVLVEVADMELHTKKIEISGLKFASLACTGCYACSSSISCKVRIHVDEPDELTVHVKSDDPDVVAASSSLMARKLEFGTDSTFKAFSAMPKTSLCFYIVEREHCKSCSEEDTKKCVNTKLEQPQSILIEHKGTIIGKQNSTCTAKASCWLESVKSFFYGLKNMLSGIFGNVFMGIFLFLAPFILLILFFMFGWRILFCFKCCRRTRGLFKYRHLKDDEETGYRRIIEKLNNKKGKNKLLDGERLADGRIAELFSTKTHIG

SEQ ID NO: 1172 - protein, 1684 aa, Artificial Sequence
  derived and/or modified protein sequence (wt) from CCHFV(IbAr10200)__AF467768.2__GP
MHISLMYAILCLQLCGLGETHGSHNETRHNKTDTMTTPGDNPSSEPPVSTALSITLDPSTVTPTTPASGLEGSGEVYTSPPITTGSLPLSETTPELPVTTGTDTLSAGDVDPSTQTAGGTSAPTVRTSLPNSPSTPSTPQDTHHPVRNLLSVTSPGPDETSTPSGTGKESSATSSPHPVSNRPPTPPATAQGPTENDSHNATEHPESLTQSATPGLMTSPTQIVHPQSATPITVQDTHPSPTNRSKRNLKMEIILTLSQGLKKYYGKILRLLQLTLEEDTEGLLEWCKRNLGLDCDDTFFQKRIEEFFITGEGHFNEVLQFRTPGTLSTTESTPAGLPTAEPFKSYFAKGFLSIDSGYYSAKCYSGTSNSGLQLINITRHSTRIVDTPGPKITNLKTINCINLKASIFKEHREVEINVLLPQVAVNLSNCHVVIKSHVCDYSLDIDGAVRLPHIYHEGVFIPGTYKIVIDKKNKLNDRCTLFTDCVIKGREVRKGQSVLRQYKTEIRIGKASTGSRRLLSEEPSDDCISRTQLLRTETAEIHGDNYGGPGDKITICNGSTIVDQRLGSELGCYTINRVRSFKLCENSATGKNCEIDSVPVKCRQGYCLRITQEGRGHVKLSRGSEVVLDACDTSCEIMIPKGTGDILVDCSGGQQHFLKDNLIDLGCPKIPLLGKMAIYICRMSNHPKTTMAFLFWFSFGYVITCILCKAIFYLLIIVGTLGKRLKQYRELKPQTCTICETTPVNAIDAEMHDLNCSYNICPYCASRLTSDGLARHVIQCPKRKEKVEETELYLNLERIPWVVRKLLQVSESTGVALKRSSWLIVLLVLFTVSLSPVQSAPIGQGKTIEAYRAREGYTSICLFVLGSILFIVSCLMKGLVDSVGNSFFPGLSICKTCSISSINGFEIESHKCYCSLFCCPYCRHCSTDKEIHKLHLSICKKRKKGSNVMLAVCKLMCFRATMEVSNRALFIRSIINTTFVLCILILAVCVVSTSAVEMENLPAGTWEREEDLTNFCHQECQVTETECLCPYEALVLRKPLFLDSTAKGMKNLLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVGEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFVNLLNIETDYTKNFHFHSKRVTAHGDTPQLDLKARPTYGAGEITVLVEVADMELHTKKIEISGLKFASLACTGCYACSSGISCKVRIHVDEPDELTVHVKSDDPDVVAASSSLMARKLEFGTDSTFKAFSAMPKTSLCFYIVEREHCKSCSEEDTKKCVNTKLEQPQSILIEHKGTIIGKQNSTCTAKASCWLESVKSFFYGLKNMLSGIFGNVFMGIFLFLAPFILLILFFMFGWRILFCFKCCRRTRGLFKYRHLKDDEETGYRRIIEKLNNKKGKNKLLDGERLADRRIAELFSTKTHIG

SEQ ID NO: 1173 - protein, 1688 aa, Artificial Sequence
  derived and/or modified protein sequence (wt) from CCHFV(Turkey-Kelkit06)__GQ337054.1__GP
MPTNIMHTPLVCFILYLQLLCLGGAHGQLNATEHNGTNNTTAPGASQSPKPPMSTTPPHAPESSTIKPTTPISEAEGSGETTSPPNTTQGLSSPETTSERPATTSISTSSTDSTNPTTQMTDNTPTPTVSTSPSSSPSTPSTPQGIHHPARSLLSVSSPKTVTTPTPTSPGEMSSETSSQHSAMSRIPTPHTATRVSTEITNHRTPRQSESSAQQTTPSPMTSPAQSILLMSAAPTAVQDIHPSPTNRSKRNLETEIILTLSQGLKKYYGKILKLLHLTLEQDTEGLLEWCKGNLGSNCDDDFFQKRIEEFFMTGECYFNEVLQFKTLSTLSPTEPSHARLPTAEPFKSYFAKGFLSIDSGYFSAKCYPRSSASGLQLINVTQHPARIAETPGPKTTSLKTINCINLRASVFKEHREVEINVLLPQIAVNLSNCHVVINSHVCDYSLDTDGPVRLPRIYHEGTFIPGTYKIVIDKKNKLNDRCTLVTNCVIKGREVRKGQSVLRQYKTEIKIGKASTGFRKLLSEEPGDDCISRTQLLRTETAEIHDDNYGGPGDKITICNGSTIVDQRLGSELGCYTINRVKSFKLCKNSATGKTCEVDSTPVKCRQGFCLKITQEGRGHVKLSRGSEVVLDACDSSCEVMIPKGTGDILVDCSGGQQHFLKDNLIDLGCPHIPLLGRMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLTVSLSPVQSAPVGHGKTIEIYQTREGFASICLFMLGSILFIVSCLVKGLVDSVSESFFPGLSVCKTCSIGSVNGFEIESHKCYCSLFCCPYCRHCSADREIHQLHLSICKKRKTGSNVMLAVCKRMCFRATIEASRRALLIRSIINTTFVICILTLTICVVSTSAVEMENLPAGTWEREEDLTNFCHQECQVTETECLCPYEALVLRKPLFLDSIVKGMKNLLNSTSLETSLSIEAPWGAINVQSTFKPTVSTANIALSWSSVVHRGNKILVTGRSESIMKLEERTGVSWDLGVEDASESKLLTVSIMDLSQMYSPVFEYLSGDRQVEEWPKATCTGDCPERCGCTSSTCLHKEWSHSRNWRCNPTWCWGVGTGCTCCGVDVKDLFTDHMFVKWKVEYIKTEAIVCVALTSQERQCSLIEAGTRFNLGPVTITLSEPRNIQQKLPPEIITLHPKIEEGFFDLMHVQKVLSASTVCKLQSCTHGIPGDLQVYHIGNLLKGDRVNGHLIHKIESHFNTSWMSWDGCDLDYYCNMGDWPSCTYTGVTQHNHAAFVNLLNIETDYTKTFHFHSKRVTAHGDTPQLDLKARPTYGAGGITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEDDTQKCVDTRLEQPQSILIEHKGTIIGKQNDTCTAKASCWLESVKSFFYGLKNMLGSVFGNLFIGILLFLAPFVLLVLFFMFGWKILFCFKCCRRTRGLFKYRHLKDDEETGYRRIIERLNSKKGKNRLLDGDRLADRKIAELFSTKTHIG

SEQ ID NO: 1174 - protein, 1700 aa, Artificial Sequence
  derived and/or modified protein sequence (wt) from CCHFV(UCCR4416)__KY484026.1__GP
MFLHFKFMLLTNFFFCQLLWGGGGVASGGRTNTSSTQTTLISSNTLNSTMSVLESSIGTATETVPSTTTNTPDTQVTTDSGSGESSTDPQTTSKEVPSTSVATIKTQESETHRAQNPSTTAGSGASTPSNTTSNKPDVNSLTSPILEAKSSPSPSKTSMPQTAHHLSRSLLSAATTETNQAASVMTTTRETTTMSSPTTVKNSVTAIPTQGITTSNTSKQTDTITLEISPKIQTTQSQQTATPAIAPATTAIAFISPTNRSKRESKVQIILTFSQGLKKYYSKILKLLHLTQEEDSEGLLEWCTRVLEQACNDDYFNERIEEFFITGKGYFNDVLQFRLYDTLSTTESTQNTSPTAKPFRSYYAKGSLTFDSGYFSAKCYPRASNSGLQLINVTQHSVKIANTPGPKISNPKTINCINLKVSTDKDHSKLEINVLLPQVAVNLSNCHVLIESHVCDYSLDTDGTIKLPKITHNGAFIPGTYKIVIDKKNKLNDRCALFTNCVIKGREVRRGQSALRQYRTEIRIGQTFTGSRRLLAEGGSNDCVSRTQLVKTEVAEIHEDSYGGPGEKITICNGSTIVDQRLGSELGCYTINRVRTYKLCENSATEKSCEIDSVPVKCKQGFCLKITQEGRGHVKLSRGTEIVLDVCDTSCELMIPKGTGDILVDCSGGQQHFLQDNLIDLGCPNIPLLGRTAIYVCRMSNHPKTTMAFLFWFSFGYVITCVVCKVLFYLLIVIGTLGKRLKQYRELKPQTCIVCESIPVNAIDAEMHDLNCNYNICPYCASRLTSDGLVRHVTQCPKRKEKVEETELYLNLERIPWLVRKLLQVSESTGVALKRSCWMITLLILLTVSMSPVQSAPVGHKRAVEVYQMRESYTGICLFVLGSVLFAVSWLVKALIDSIGNSFFPGLSICKTCSIGSINGFEIESHKCYCSLFCCPYCRACSSDKITHRMHLNVCKKRKVGSNVMLAVCKRMCFKATIEASNRATFIRNIINSTFVICILILVICVVSTSAVDMENLPAGIWEKEEDLTNFCHQECQVTETECLCPYEALMLRKPLFLDRIAKGMKSLLNSTSLETSLSIEAPWGAINVQSTFKPTVSAANIALSWSSVEHKGNKILVSGRSESIMKLEERTGISWCLGVEDASESKTLTVSVMDLSQMYSPVFEYLSGDRQVEEWPKATCTGDCPERCGCTSSTCLHKEWPHSRNWRCNPTWCWGVGTGCTCCGLDVKDLFTDYMLVKWKVEYIKTEAIICVELTSQERQCSLIEAGTRFNLGPVTITLSEPRNVQQRLPPEIITLHPKIEEGFFDLMHVQKVMSASTVCKLQSCTHGVPGDLQVYHVGNLLKGDKVNGHSIHKIESHLNTSWMSWDGCDLDYFCNMGDWPSCTYTGVTQHNHAAFINMLNIETDYTKTFHFHSKRVTAHGDTPQLDLKARPAYGAGEITVLVEVADLELHTKKIEVSGLKFASLSCSGCYACSSGISCKVRIHVNEPDEFTVHVKSNDPDVVAAGSSLMARKIESGADSTFKAFSSMPKNSLCFYIVERDYCSSCTDDDTQKCVDIKLEHPQSILIEHKGTIIGKQNDTCPTKTSCWLESIKSFFYGLKNMLSGIFGNVFLGMLLFLAPFILLILFFFFGWRLLFCLKCCRRTRKLLKYKHLRDEEESGYKKIIERLNDKKGKSRLFDGERLADRKIAELFSTKTHIG

SEQ ID NO: 1175 - protein, 1700 aa, Artificial Sequence
  derived and/or modified protein sequence (wt) from CCHFV(ArD15786)__DQ211627.1__GP
MFLHFKFVLLTNFFFCQLLWGGGGVTSGGGTNTSSTQAILISSNTPNSTMSVLESSTGTAAETVPSTTINTPDTQVTTDSGSGESSTDPQTTNGEVPSTSIATIKTQESETRRTQNLSTTAGSGASTPGNTTSNKPDVNLLTSPISEAKSSPSPSKTSTPQTAHHLSRSLLSAATTETSQAASVMTTTRETTTMSSPTTVKNSATATPTQGITTSNTSKQTDTTTLEIPPKIQTTQSQQTATPAITPATTAIAFISPTNRSKRESKVQIILTFSQGLKKYYSKILKLLHLTQEEDSEGLLEWCTRVLEQACDDDYFNERIEEFFITGKGYFNDVLQFRLYDTFSTTESTQNTSPTAKPFRSYYAKGSLTFDSGYFSAKCYPRASNSGLQLINVTQHSVKIANTPGPKISNPKTINCINLKVSTDKDHSKLEINVLLPQVAVNLSNCHVLIESHVCDYSLNTDGTIKLPKIAHNGAFIPGTYKIVIDKKNKLNDRCALFTNCVIKGREVRRGQSALRQYRTEIRIGQTFTGSRRLLAEGGSNDCVSRTQLVKTEVTEIHEDSYGGPGEKITICNGSTIVDQRLGSELGCYTINRVRTYKLCENSATEKSCEIDSVPVKCKQGFCLKITQEGRGHVKLSRGTEIVLDVCDTSCELMIPKGTGDILVDCSGGQQHFLQDNLIDLGCPNIPLLGQTAIYVCRMSNHPKTTMAFLFWFSFGYVITCVVCKVLFYLLIVIGTLGKRLKQYRELKPQTCIVCESIPVNAIDAEMHDLNCNYNICPYCASRLTSDGLVRHVTQCPKRKEKVEETELYLNLERIPWLVRKLLQVSESTGVALKRSCWIITLLILLTVSMSPVQSAPVGHKRAVEVYQIRESYTGICLFVLGGVLFAVSWLVKALIDSIGNSFFPGLSICKTCSIGSINGFEIESHKCYCSLLCCPYCRACSSDKITHRMHLNVCKKRKVGSNVMLAVCKRMCFKATIEANNRATFIRNIINSTFVICILILVICVVSTSAVDMENLPAGIWEKEEDLTNFCHQECQVTETECLCPYEALMLRKPLSLDSIAKGMKSLLNSTSLETSLSIEAPWGAINVQSTFKPTISAANIALSWSSVEHKGNKILVSGRSESIMKLEERTGISWCLGVEDASESKTLTVSVMDLSQMYSPVFEYLSGDRQVEEWPKATCTGDCPERCGCTSSTCLHKEWPHSRNWRCNPTWCWGVGTGCTCCGLDVKDLFTDYMLVKWKVEYIKTEAIICVELTSQERQCSLIEAGTRFNLGPVTITLSEPRNVQQRLPPEIITLHPKIEEGFFDLMHVQKVMSASTVCKLQSCTHGVPGDLQVYHVGNLLKGDKVNGHSIHKIESHLNTSWMSWDGCDLDYFCNMGDWPSCTYTGVTQHNRAAFINMLNIETDYTKTFHFHSKRVTAHGDTPQLDLKARPTYGAGEITVLVEVADLELHTKKIEVSGLKFASLTCSGCYACSSGISCKVRIHVNEPDEFTVHVKSNDPDVVAAGSSLMARKIESGADSTFKAFSSMPKNSLCFYIVERDYCSSCTDDDTQKCVDIKLEHPQSILIEHKGTIIGKQNDTCPTKTSCWLESIKSFFYGLKNMLSGIFGNIFLGMLLFLAPFVLLILFFFFGWRLLFCLKCCRRTRKLLKYKHLRDEEESGYKKIIERLNDKKGKSRLFDGERLADRKIAELFSTKTHVG

SEQ ID NO: 1176 - protein, 1699 aa, Artificial Sequence
  derived and/or modified protein sequence (wt) from CCHFV(UCCR4432)__KY484047.1__GP
MFCLRLVLLINLALCQLLEGNDGVTSADEINSNTTQTSLGLPTILNSTTPAPGPSIDATMEAVPGTTNSVLETQVTMDSGSGELSTDPTTTREATTPITAATVSAQETKTHMTQNPGTTVDPDTTTSNTTTSIEPITTPPTSPTPQATPTPSYSETPTLPNTHHLSRSLLSAVGTEAGQTAPATPTAEVALAPGGSSTAESNTISIPAQDTTISGVSKQDNPTTTGISPEAQTMQSQQAVAPVTTPATAISAPTSPTNRSKRESKVQIILTFPQGLKKYYSKILKFLHLTQEEDSEGLLEWCTRVLQQVCDDTYFNERIKEFFITGKGYFNDVLQFKLHDTPATTVPALAASSTAMPFRSYYAKGSLTLDSGYFSAKCYPRASNSGMQLINVTQHPMKIANTPGPKISNLKTINCINLKVSTDKEHSELEINVLIPQVAVNLSNCFVSIKSHVCDYSLDTDGAIRLPKVAHNGVFMPGTYKIVIDKKNKLNDRCALITNCVIKGREVRKGQSTLRQYKTEIRIGQTIAGSRRLLAEGVSNDCVSRTQLIKTEVAEIHEDSYGGPGEKITICNGSTIVDQRLGSELGCYTINRVKTYKLCENSATEKGCEIDSVPVKCKQGFCLKVTQEGRGHVKLSRGTEIVLDVCDTSCELMIPKGTGDILVDCSGGQQHFLQDNLIDLGCPNVPLLGKMAIYICRMSNHPKTTMAFLFWFSFGYVITCIVCKVLFYLLIVIGTLSKKLKQYRELKPQTCIVCESTPVNAIDAEMHELNCNYNICPYCASRLTSDGLVRHVNQCPKRKEKVEETELYLNLERIPWLVRRLLQVSESTGMALKRSCWMTTLLILLVVSLSPVQSAPVGQGKAVEVYRVRESYTSICLFVLGSVLFAVSWLIKGLIDGIGNSFFPGLSVCKTCSIGSINGFEIESHKCYCSLFCCPYCRACSSDKITHRMHLNVCKKRKAGSNVMLAVCKRMCFKATVEASNTALLIRGIINSTFVICVLILVICVVSTSAVDMENLPAGIWEREEDLTNFCHQECQVTETECLCPYEALILRKPLYLDSIAKGMKSLLNSTNLETSLSIEAPWGAINVQSTFKPTVSAANIALSWSSVEHRGNKILVSGRSESIMKLEERTGISWSLGVEDASESKTLTVSVMDLSQMYSPVFEYLSGDRQVEEWPKATCTGDCQERCGCTSSTCLHKEWPHSRNWRCNPTWCWGVGTGCTCCGLDVRDLFTDYMMVKWKVEYVKTEAIMCVELTSQERQCSLIEAGTRFNLGPVTITLSEPRNIQQRLPSEIVTLHPKIEEGFFDLMHVQKVLSASTVCKLQSCTHGVPGDLQVYHVGNLLKGDKVNGHSIHKIESHFNTSWMSWDGCDLDYFCNMGDWPSCTYTGVTQHNRAAFINMLNIETDYTKTFHFHSKRVTAHGDTPQLDLKARPTYGAGEVTVLVEVADLELHTKKIEVSGLKFASLTCSGCYACSSGISCKVRIHVNEPDEFTVHVKSSDPDVVAAGSSLMARKIEFGADSTFKAFSSMPKNSLCFYIVERDYCSSCTNDDTQKCVDTKLEHPQSILIEHKGTIIGKQNDTCSTKTSCWLESVKSFFYGLKNMLGGIFGNVFLGIFLFLAPFALLIFFFFFGWRLLFCLKCCRRTRGLLKYKQLKDEEEAGYKKIIERLNDKKGKSRLFDGERLADRKIAELFSTKTHIG

SEQ ID NO: 1177 - protein, 1699 aa, Artificial Sequence
  derived and/or modified protein sequence (wt) from CCHFV(Nakiwogo)__KX013484.1__GP
MFCLKLVLLINLTLCQLLEGNDRVTSADGINSNTTQTNLGISTILNSTTPAPGPSTDTTMETVPSTADSMLETQVTTDSGSGEPSTEPTTTGEATSSTTAATVSMQETKKHMTQNTRSTADPDTTTPNSTTSVEPTTIPPTSPIPQATPTPGHGKAPTLPNTHHLSRSLLSAVSTEAGQTTPATSTTEAASAPSSSSTAENNTVSQPAQDTTTSGVSEQYNPTTTGISPKAQTMQGQQAIVPVTTPVTTTFTPTNPTNRSKRESKVQIILTFPQGLKKYYSKILKLLHLTQEEDSEGLLEWCTRVLQQVCDDTYFNERIEEFFITGKGYFNDVLQFKLHDTPTTTVSALAASSTAMPFRSYYAKGSLTLDSGYFSAKCYPRASNSGMQLINVTQHPMKIANTPGPKTSNLKTMNCINLKVSTDKEHSELEINVLIPQVAVNLSNCLVSIKSHVCDYSLDTDGAIRLPKVAYNGVFMPGTYKIVIDKKNRLNDRCALITNCVIKGREVRKGQSTLRQYKTEIRIGQTLMGSRRLLAEGVSNDCVSRTQLIKTEVAEIHEDSYGGPGEKITICNGSTIVDQRLGSELGCYTINRVKTYKLCENSATEKGCEIDSVPVKCKQGFCLKVTQEGRGHVKLSRGTEIVLDVCDTSCELMIPKGTGDILVDCSGGQQHFLQDNLIDLGCPNVPLLGKMAIYICRMSNHPKTTMAFLFWFSFGYVITCVVCKVLFYLLIVIGTLGKKLKQYRELKPQTCIVCESIPVNVIDAEMHELNCNYNICPYCASRLTSDGLVRHVTQCPKRKEKVEETELYLNLERIPWLVRRLLQVSESTGMALKRSCWMTTLLILLVVSLSPVQSAPVGQEKAIEVYQVRESYTSMCLFVLGSVLFAVSWLVKGLIDGIGNSFFPGLSVCKTCSIGSINGFEIESHKCYCSLFCCPYCRACSSDKITHRMHLNICKRRKVGSNVMLAVCKRMCFKATVEASNSALLIRSIINSTFVICVLILVICVVSTSAVDMENLPAGIWEREEDLTNFCHQECQVTETECLCPYEALILRKPLYLDSIAKGMKSLLNSTNLETSLSIEAPWGAINVQSTFKPTVSAANIALSWSSVEHRGNKILVSGRSESIMKLEERTGISWSLGVEDASESKTLTVSVMDLSQMYSPVFEYLSGDRQVEEWPKATCTGDCPERCGCTSSTCLHKEWPHSRNWRCNPTWCWGVGTGCTCCGLDVRDLFTDYMMVKWKVEYVKTEAIMCVELTSQERQCSLIEAGTRFNLGPVTITLSEPRNVQQRLPSEIVTLHPKIEEGFFDLMHVQKVLFCKHSLQATSCTHGVPGDLQVYHVGNLLKGDKVNGHSIHKIESHFNTSWMSWDGCDLDYFCNMGDWPSCTYTGVTQHNRAAFVNMLNIETDYTKTFHFHSKRVTAHGDTPQLDLKARPTYGAGEVTVLVEVADLELHTKKIEVSGLKFASLTCSGCYACSSGISCKVRIHVNEPDEFTVHVKSNDPDVVAAGSSLMARKIELGADSTFKAFSSMPKNSLCFYIVERDYCSSCTDDDTQKCVNTKLEHPQSILIEHKGTIIGKQNDTCPTKTSCWLESVKSFFYGLKNMLGGIFGNVFLGIFLFLAPFALLILFFFFGWRLLFCLKCCRRTRGLLKYKQLKDEEEAGYKKIIERLNDKKGKSRLFDGERLADRKIAELFSTKTHIG

SEQ ID NO: 1178 - protein, 1699 aa, Artificial Sequence
  derived and/or modified protein sequence (wt) from CCHFV(UG3010)__AY900143.1__GP
MFCLRLVLLINLALCQLLEGNDGVTSADEINSNTTQTSLGLPTILNSTTPAPGPSIDATMEAVPGTTNSVLETQVTMDSGSGELSTDPTTTREATTPITAATVSAQETKTHMTQNPGTTVDPDTTTSNTTTSIEPITTPPTSPTPQATPTPSYSETPTLPNTHHLSRSLLSAVGTEAGQTAPATPTAEVALAPGGSSTAESNTISIPAQDTTISGVSKQDNPTTTGISPEAQTMQSQQAVAPVTTPATAISAPTSPTNRSKRESKVQIILTFPQGLKKYYSKILKFLHLTQEEDSEGLLEWCTRVLQQVCDDTYFNERIKEFFITGKGYFNDVLQFKLHDTPATTVPALAASSTAIPFRSYYAKGSLTLDSGYFSAKCYPRASNSGMQLINVTQHPMKIANTPGPKISNLKTINCINLKVSTDKEHSELEINVLIPQVAVNLSNCFVSIKSHVCDYSLDTDGAIRLPKVAHNGVFMPGTYKIVIDKKNKLNDRCALITNCVIKGREVRKGQSTLRQYKTEIRIGQTIAGSRRLLAEGVSNDCVSRTQLIKTEVAEIHEDSYGGPGEKITICNGSTIVDQRLGSELGCYTINRVKTYKLCENSATEKGCEIDSVPVKCKQGFCLKVTQEGRGHVKLSRGTEIVLDVCDTSCELMIPKGTGDILVDCSGGQQHFLQDNLIDLGCPNVPLLGKMAIYICRMSNHPKTTMAFLFWFSFGYVITCIVCKVLFYLLIVIGTLSKKLKQYRELKPQTCIVCESTPVNAIDAEMHELNCNYNICPYCASRLTSDGLVRHVNQCPKRKEKVEETELYLNLERIPWLVRRLLQVSESTGMALKRSCWMTTLLILLVVSLSPVQSAPVGQGKAVEVYRVRESYTSICLFVLGSVLFAVSWLIKGLIDGIGNSFFPGLSVCKTCSIGSINGFEIESHKCYCSLFCCPYCRACSSDKITHRMHLNVCKKRKAGSNVMLAVCKRMCFKATVEASNTALLIRGIINSTFVICVLILVICVVSTSAVDMENLPAGIWEREEDLTNFCHQECQVTETECLCPYEALILRKPLYLDSIAKGMKSLLNSTNLETSLSIEAPWGAINVQSTFKPTVSAANIALSWSSVEHRGNKILVSGRSESIMKLEERTGISWSLGVEDASESKTLTVSVMDLSQMYSPVFEYLSGDRQVEEWPKATCTGDCQERCGCTSSTCLHKEWPHSRNWRCNPTWCWGVGTGCTCCGLDVRDLFTDYMMVKWKVEYVKTEAIMCVELTSQERQCSLIEAGTRFNLGPVTITLSEPRNIQQRLPSEIVTLHPKIEEGFFDLMHVQKVLSASTVCKLQSCTHGVPGDLQVYHVGNLLKGDKVNGHSIHKIESHFNTSWMSWDGCDLDYFCNMGDWPSCTYTGVTQHNRAAFINMLNIETDYTKTFHFHSKRVTAHGDTPQLDLKARPTYGAGEVTVLVEVADLELHTKKIEVSGLKFASLTCSGCYACSSGISCKVRIHVNEPDEFTVHVKSSDPDVVAAGSSLMARKIEFGADSTFKAFSSMPKNSLCFYIVERDYCSSCTNDDTQKCVDTKLEHPQSILIEHKGTIIGKQNDTCSTKTSCWLESVKSFFYGLKNMLGGIFGNVFLGIFLFLAPFALLIFFFFFGWRLLFCLKCCRRTRGLLKYKQLKDEEEAGYKKIIERLNDKKGKSRLFDGERLADRKIAELFSTKTHIG

SEQ ID NO: 1179 - protein, 1699 aa, Artificial Sequence
  derived and/or modified protein sequence (wt) from CCHFV(Semunya)__DQ094832.1__GP
MFCLKLVLLINLALCQLLEGNDRVTSADGINSNTTQTNLGISTILNSTTPAPGPSTDTTMETVPSTADSMLETQVTTDSGSGEPSTEPTTTGEATSSTTAATVSMQETKTHMTQNTRSTADPDTTTPNTTTSVEPTTIPPTSPILQATPTPGHGKAPTLPNTHHLSRSLLSAVSTEAGQTTPATSTTEAASAPSSSSTAENNTMFQPAQDTTTSGVSEQYNPTTTGISPKAQTMQAQQAIVPVTTPVTTTFTPINPTNRSKRESKVQIILTFPQGLKKYYSKILKLLHLTQEEDSEGLLEWCTRVLQQVCDDTYFNERIEEFFITGKGYFNDVLQFKLHDTPTTTVPALAASSTAMPFRSYYAKGSLTLDSGYFSAKCYPRASNSGMQLINVTQHPMKIANTPGPKTSNLKTMNCINLKVSTDKEHSELEINVLIPQVAVNLSNCLVSIKSHVCDYSLDTDGAIRLPKVAYNGVFMPGTYKIVIDKKNRLNDRCALITNCVIKGREVRKGQSTLRQYKTEIRIGQTLMGSRRLLAEGVSNDCVSRTQLIKTEVAEIHEDSYGGPGEKITICNGSTIVDQRLGSELGCYTINRVKTYKLCENSATEKGCEIDSVPVKCKQGFCLKVTQEGRGHVKLSRGTEIVLDVCDTSCELMIPKGTGDILVDCSGGQQHFLQDNLIDLGCPNVPLLGKMAIYICRMSNHPKTTMAFLFWFSFGYVITCVVCKVLFYLLIVIGTLGKKLKQYRELKPQTCIVCESIPVNAIDAEMHELNCNYNICPYCASRLTSDGLVRHVTQCPKRKEKVEETELYLNLERIPWLVRRLLQVSESTGMALKRSCWMTTLLILLVVSLSPVQSAPVGQEKAIEVYQVRESYTSICLFVLGSVLFAVSWLVKGLIDGIGNSFFPGLSVCKTCSIGSINGFEIESHKCYCSLFCCPYCRACSSDKITHRMHLNICKRRKVGSNVMLAVCKRMCFKATVEASNSALLIRSIINSTFVICVLILVICVVSTSAVDMENLPAGIWEREEDLTNFCHQECQVTETECLCPYEALILRKPLFLDSIAKGKKSLLNSTNLETSLSIEAPWGAINVQSTFKPTVSAANIALSWSSVEHRGNKILVSGRSESIMKLEERTGISWSLGVEDASESKTLTVSVMDLSQMYSPVFEYLSGDRQVEEWPKATCTGDCPERCGCTSSTCLHKEWPHSRNWRCNPTWCWGVGTGCTCCGLDVRDLFTDYMMVKWKVEYVKTEAIMCVELTSQERQCSLIEAGTRFNLGPVTITLSEPRNVQQRLPSEIVTLHPKIEEGFFDLMHVQKVLFCKYSLQATSCTHGVPGDLQVYHVGNLLKGDKVNGHSIHKIESHFNTSWMSWDGCDLDYFCNMGDWPSCTYTGVTQHNRAAFVNMLNIETDYTKTFHFHSKRVTAHGDTPQLDLKARPTYGAGEVTVLVEVADLELHTKKIEVSGLKFASLTCSGCYACSSGISCKVRIHVNEPDEFTVHVKSNDPDVVAAGSSLMARKIEFGADSTFKAFSSMPKNSLCFYIVERDYCSSCTDDDTQKCVNIKLEHPQSILIEHKGTIIGKQNDTCPTKTSCWLESVKSFFYGLKNMLGGIFGNVFLGIFLFLAPFALLILFFFFGWRLLFCLKCCRRTRGLLKYKQLKDEEEAGYKKIIERLNDKKGKSRLFDGERLADRKIAKLFSTKTHIG

SEQ ID NO: 1180 - protein, 1697 aa, Artificial Sequence
  derived and/or modified protein sequence (wt) from CCHFV(79121)__AB069673.1__GP
MLFHFKFMLLINFILCHLLWGGGGVTGGVETNSSSTQAIQTPPVTSNSTTPGPSTDTATETASSMTTSTPDTQVTTDNGSGEPSTDPLTTNEATPPLSVTTAQTTETKKHTTLDPSTSTNPDATTPSITILSASNTSLPISSVHASPSPSSSEEPTPQNAHHLSRSLLSAVSTETGQIASAATAAKEITTKNSPPTAGNDTMVTSAPNGNIRNTPEQANPTAPEASPKIQTTQNQQTVTPEATPITTITALTDLTNRSKRDSKVQKILTFSQGLKKYYSKILKLLQLTQEEDSEGLLEWCTRVLEQACDDDYFNKRIEEFFITGKGYFNDVLQFRLHDALSNTEPAQTTSPTAVPFKSYYAKGSLTFDSGYFSARCYPRASNSGLQLINVTQHPVKIANTPGPKLSNLKTINCINLKVSTDKEHSELEVNVLLPQVAVNLSNCHVSIKSHVCDYSLDTDGAIKLPRVAHNGVFIPGTYKIVIDKKNNLNDRCTLITNCVIKGREVRKGQSALRQYKTEIRIGQTFTGSRRLLAEGGSSDCISRTQLVKTEVAEIHEDSYGGPGEKITICNGSTIVDQGLGSELGCYTINRVRSYKLCENSASGKSCEIDSIPVKCKQGFCLKITQEGRGHVKLSRGTEIVLDVCDSSCELMIPKGTGDILVDCSGGQQHFLQNNLIDLGCPNVPLLGKMAIYVCRMSNHPKTTMAFLFWFSFGYVITCIACRVLFYLLIAIGTVGKKLKQYRELKPQTCIVCESVPVNAIDAEMHELNCSYNICPYCASRLSTDGLIRHVTQCPKRREKVEETELFLNLERIPWLVRKLLQVSESTGMALKRSCWMITLLILLLVSISPVQSAPVGKERAIETYQARETYTGICLFVLGSVLFAVSWLTKALIDGIGNSFSPGLSVCKTCSIGSINGFEIESHKCYCSLFCCPYCRACSSDKNTHRMHLNVCKKRKMGSNVMLAVCKRMCFRATIEASNKALLIRSIINSTFVICILILTICVVSTSAVDMENLPAGIWEKEEDLTNFCHQECQVTETECLCPYEAMVLRKPLFLDSTAKGMKSLLNSTSLETSLSIEAPWGAINVQSTFKPTVSAANIALSWSSVEHRGNKILVSGRSESIMKLEERTGVSWNLGVEDASESKTLTVSVMDLSQMYSPVFEYLSGDRQVEEWPKATCTGDCPERCGCTSSTCLHKEWPHSRNWRCNPTWCWGVGTGCTCCGLDVKDFFTDYMLVKWKVEYIKTEAIVCVELTSQERQCSLIEAGTRFNLGPVTITLSEPRNVQQRLPPEIVTLHPKIEEGFFDLMHVQKILSASTVCKLQSCTHGVPGDFQIYHVGNLLRGDKVNGHSIHKIEPHFNTSWMSWDGCDLDYFCNMGDWPSCTYTGVTQHNRAAFINMLNIETDYTKTFHFHSKRVTAHGDTPQLDLKARPAYGAGEVTVLVEVADLELHTKNLEVSGLKIASLTCSGCYACSSGISCKVRIHVNEPDEFTVHVRSSDPDVVAAGSSLMARKIEFGADSTFKAFSSMPKDSLCFYIVEKDYCSSCTDDDTQKCVNTKLDHPQSILIEHKGTIIGKQNDTCSTKTSCWLESVKGFFYGLKNMLSGIFGNVFLGIFLFLAPFVLLIFFFFFGWRLLFCLKCCRRTRGLLKYKHLKDEEEAGYKKIIERLNGKKGKSQLFDGERLADRKIAELFSTKIHIG

SEQ ID NO: 1181 - protein, 1697 aa, Artificial Sequence
  derived and/or modified protein sequence (wt) from CCHFV(7001)__AB069670.1__GP
MLFHFKFMLLINFILCHLLWGGGGVTGGVETNSSSTQAIQTPPVTSNSTTPGPSTDTATETASSMTTSTPDTQVTTDNGSGEPSTDPLTTNEATPPLSVTTAQTTETKKHTTLDPSTSTNPDATTPSITILSASNTSLPISSVHASPSPSSSEEPTPQNAHHLSRSLLSAVSTETGQIASAATAAKEITTKNSPPTAGNDTMVTSAPNGNIRNTPEQANPTAPEASPKIQTTQNQQTVTPEATPITTITALTDLTNRSKRDSKVQIILTFSQGLKKYYSKILKLLQLTQEEDSEGLLEWCTRVLEQACDDDYFNKRIEEFFITGKGYFNDVLQFRLHDALSNTEPAQTTSPTAVPFKSYYAKGSLTFDSGYFSARCYPRASNSGLQLINVTQHPVKIANTPGPKLSNLKTINCINLKVSTDKEHSELEVNVLLPQVAVNLSNCHVSIKSHVCDYSLDTDGAIKLPRVAHNGVFIPGTYKIVIDKKNNLNDRCTLITNCVIKGREVRKGQSALRQYKTEIRIGQTFTGSRRLLAEGGSSDCISRTQLVKTEVAEIHEDSYGGPGEKITICNGSTIVDQRLGSELGCYTINRVRSYKLCENSASGKSCEIDSIPVKCKQGFCLKITQEGRGHVKLSRGTEIVLDVCDSSCELMIPKGTGDILVDCSGGQQHFLQNNLIDLGCPNVPLLGKMAIYVCRMSNHPKTTMAFLFWFSFGYVITCIACRVLFYLLIAIGTVGKKLKQYRELKPQTCIVCESVPVNAIDAEMHELNCSYNICPYCASRLSTDGLIRHVTQCPKRREKVEETELFLNLERIPWLVRKLLQVSESTGMALKRSCWMITLLILLLVSISPVQSAPVGKERAIETYQARETYTGICLFVLGSVLFAVSWLTKALIDGIGNSFFPGLSVCKTCSIGSINGFEIESHKCYCSLFCCPYCRACSSDKNTHRMHLNVCKKRKMGSNVMLAVCKRMCFRATIEASNKALLIRSIINSTFVICILILTICVVSTSAVDMENLPAGIWEKEEDLTNFCHQECQVTETECLCPYEAMVLRKPLFLDNIAKGMKSLLNSTSLETSLSIEAPWGAINVQSTFKPTVSAANIALSWSSVEHRGNKILVSGRSESIMKLEERTGVSWNLGVEDASESKTLTVSVMDLSQMYSPVFEYLSGDRQVEEWPKATCTGDCPERCGCTSSTCLHKEWPHSRNWRCNPTWCWGVGTGCTCCGLDVKDFFTDYMLVKWKVEYIKTEAIVCVELTSQERQCSLIEAGTRFNLGPVTITLSEPRNVQQRLPPEIVTLHPKIEEGFFDLMHVQKILSASTVCKLQSCTHGVPGDFQVYHVGNLLRGDKVNGHSIHKIEPHFNTSWMSWDGCDLDYFCNMGDWPSCTYTGVTQHNRAAFINMLNIETDYTKTFHFHSKRVTAHGDTPQLDLKARPAYGAGEVTVLVEVADLELHTKKLEVSGLKIASLTCSGCYACSSGISCKVRIHVNEPDEFTVHVRSSDPDVVAAGSSLMARKIEFGADSTFKAFSSMPKDSLCFYIVEKDYCSSCTDDDTQKCVNTKLDHPQSILIEHKGTIIGKQNDTCSTKTSCWLESVKGFFYGLKNMLSGIFGNVFLGIFLFLAPFVLLIFFFFFGWRLLFCLKCCRRTRGLLKYKHLKDEEEAGYKKIIERLNGKKGKSQLFDGERLADRKIAELFSTKIHIG

SEQ ID NO: 1182 - protein, 1697 aa, Artificial Sequence
  derived and/or modified protein sequence (wt) from CCHFV(YL16070)__KY354081.1__GP
MLFHFKFMLLINFILCHLLWGGVGVTGGVETNSSSTQAIPTPPVTSNSTTPGPSTDTATETASSMTTSTPDTQVTTDNGSGEPSTDPLTTNEATPPLSVTTAQTKETKKHTTLDPNTSANPDATTPSITILSASNTSLPTSSVHASPSPSSSEEPTPQNAHHLSRSLLSAVSTETGQTASATTATKEITTKNSPPTAGNDTMVTSAPNGNTRNTPEQANPTAPEASLKIQTTQNQQTVTPEATPITTVTALTDLTNRSKRDSKVQIILTFSQGLKKYYSKILKLLQLTQEEDSEGLLEWCTRVLEQACDDDYFNKRIEEFFITGKGYFNDVLQFRLHDALSNTEPAQTTSPTAVPFKSYYAKGSLTFDSGYFSARCYPRASNSGLQLINVTQHPVKIANTPGPKLSNLKTINCINLKVSTDKEHSELEVNVLLPQVAVNLSNCHVSIKSHVCDYSLDTDGAIKLPRVAHNGVFIPGTYKIVIDKKNNLNDRCTLTTNCVIKGREVRKGQSALRQYKTEIRIGQTVTGSRRLLAEGGSSDCISRTQLVKTEVAEIHEDSYGGPGEKITICNGSTIVDQRLGSELGCYTINRVKSYKLCENSASGKSCEIDSIPVKCKQGFCLKITQEGRGHVKLSRGTEIVLDVCDSSCELMIPKGTGDILVDCSGGQQHFLQNNLIDLGCPNVPLLGKMAIYVCRMSNHPKTTMAFLFWFSFGYVITCIVCRVLFYLLIAIGTVGKKLKQYRELKPQTCIVCESVPVNAIDAEMHELNCSYNICPYCASRLSTDGLIRHVTQCPKRREKVEETELFLNLERIPWLVRKLLQVSESTGMALKRSCWMITLLILLLVSMSPVQSAPVGKERAIETYQAREAYTGICLFVLGSVLFAVSWLTKALIDGIGNSFFPGLSVCKTCSIGSINGFEIESHKCYCSLFCCPYCRACSSDKNTHRMHLNVCKKRKMGSNVMLAVCKRMCFRATIEASNKALLIRSIINSTFVICILILTICVVSTSAVDMENLPAGIWEKEEDLTNFCHQECQVTETECLCPYEAMVLRKPLFLDSIAKGMKSLLNSTSLETSLSIEAPWGAINVQSTFKPTVSAANIALSWSSVEHRGNKILVSGRSESIMKLEERTGVSWNLGVEDASESKTLTVSVMDLSQMYSPVFEYLSGDRQVEEWPKATCTGDCPERCGCTSSTCLHKEWPHSRNWRCNPTWCWGVGTGCTCCGLDVKDFFTDYMLVKWKVEYIKTEAIVCVELTSQERQCSLIEAGTRFNLGPVTITLSEPRNVQQRLPPEIVTLHPKIEEGFFDLMHVQKILSASTVCKLQSCTHGVPGDFQVYHVGNLLRGDKVNGHSIHKIEPHFNTSWMSWDGCDLDYFCNMGDWPSCTYTGVTQHNRAAFINMLNIETDYTKTFHFHSKRVTAHGDTPQLDLKARPAYGAGEVTVLVEVADLELHTKKLEVSGLKIASLTCSGCYACSSGISCKVRIHVNEPDEFTVHVRSSDPDVVAAGSSLMARKIEFGADSTFKAFSSMPKDSLCFYIVEKDYCSSCTDDDTQKCVNTKLDHPQSILIEHKGTIIGKQNDTCSTKTSCWLKSFKGFFYGLKNMLSGIFGNVFLGILLFLAPFVLLIFFFFFGWRLLFCLKCCKKTKGLLKYKHLKDKEEAGYKKIIERLNGKKGKSQLFDGERLANRKIAELFSTKIHIG

SEQ ID NO: 1183 - protein, 1697 aa, Artificial Sequence
  derived and/or modified protein sequence (wt) from CCHFV(YL04057)__FJ562094.1__GP
MLFHFKFMLLINFILCHLLWGGGGVTGGVETNSSSTQAIPTPPVTSNSTTPGPSTDTATETASSMTTSTPDTQVTTDNGSGEPSTDPPTTNETTPPPSATTAQTTETKKHTTLDPNTSTNPDAITPSITILSASNTSLPISSVHASPSPSSSEEPTPQNAHHLSRSLLSAVSTETGQIASATTAAKEITTKNSPPTAGNDTMITSAPNGNTRNTPEQANPTAPEASPKIQTTQNQQTVIPEATPITTITALTDLTNRSKRDSKVQIILTFSQGLKKYYSKILKLLQLTQEEDSEGLLEWCTRVLEQACDDDYFNKRIEEFFITGKGYFNDVLQFRLHDALSNTEPAQTTSPTAVPFKSYYAKGSLTFDSGYFSARCYPRASNSGLQLINVTQHPVKIANTPGPKLSNLKTINCINLKVSTDKEHSELEVNVLLPQVAVNLSNCHVSIKSHVCDYSLDTDGAIKLPRIAHNGVFIPGTYKIVIDKKNNLNDRCTLTTNCVIKGREVRKGQSALRQYKTEIRIGQTFTGSRRLLAEGGSSDCISRTQLVKTEVAEIHEDSYGGPGEKITICNGSTIVDQRLGRELGCYTINRVRSYKLCENSASGKSCEIDSIPVKCKQGFCLKITQEGRGHVKLSRGTEIVLDVCDSSCELMIPKGTGDILVDCSGGQQHFLQNNLIDLGCPNVPLLGKMAIYVCRMSNHPKTTMAFLFWFSFGYVITCIACRVLFYLLIAIGTVGKKLKQYRELKPQTCIVCESVPVNAIDAEMHELNCSYNICPYCASRLSTDGLIRHVTQCPKRREKVEETELFLNLERIPWLVRKLLQVSESTGMALKRSCWMITLLILLLVSISPVQSAPVGKERAIETYQARETYTGICLFVLGSVLFAVSWLTKALIDGIGNSFFPGLSVCKTCSIGSINGFEIESHKCYCSLFCCPYCRACSSDKNTHRMHLNVCKKRKMGSNVMLAVCKRMCFRATIEASNKALLIRSIINSTFVICILILTICVVSTSAVDMENLPAGIWEKEEDLTNFCHQECQVTETECLCPYEAMVLRKPLFLDSIAKGKKSLLNSTSLETSLSIEAPWGAINVQSTFKPTVSAANIALSWSSVEHRGNKILVSGRSESIMKLEERTGVSWNLGVEDASESKTLTVSVMDLSQMYSPVFEYLSGDRQVEEWPKATCTGDCPERCGCTSSTCLHKEWPHSRNWRCSPTWCWGVGTGCTCCGLDVKDFFTDYMLVKWKVEYIKTEAIVCVELTSQERQCSLIEAGTRFNLGPVTITLSEPRNVQQRLPPEIVTLHPKIEEGFFDLMHVQKILSASTVCKLQSCTHGVPGDFQVYHVGNLLRGDKVNGHSIHKIEPHFNTSWMSWDGCDLDYFCNMGDWPSCTYTGVTQHNRAAFINMLNIETDYTKTFHFHSKRVTAHGDTPQLDLKARPAYGAGEVTVLVEVADLELHTKKLEVSGLKIASLTCSGCYACSSGISCKVRIHVNEPDEFTVHVRSSDPDVVAAGSSLMARKIEFGADSTFKAFSSMPKDSLCFYIVEKDYCSSCTDDDTQKCVNTKLDHPQSILIEHKGTIIGKQNDTCSTKTSCWLESVKGFFYGLKNMLSGIFGNVFLGILLFLAPFVLLIFFFFFGWRLLFCLKCCRRTRGLLKYKHLKDEEEAGYKKIIERLNGKKGKSQLFDGERLADRKIAELFSTKIHIG

SEQ ID NO: 1184 - protein, 1697 aa, Artificial Sequence
  derived and/or modified protein sequence (wt) from CCHFV(79121M18)__GU477493.1__GP
MLFHFKFMLLINFILCHLLWGGGGVTGGVETNSSSTQAIQTPPVTSNSTTPGPSTDTATETASSMTTSTPDTQVTTDNGSGEPSTDPLTTNEATPPLSVTTAQTTETKKHTTLDPSTSTNPDATTPSITILSASNTSLPISSVHASPSPSSSEEPTPQNAHHLSRSLLSAVSTETGQIASAATAAKEITTKNSPPTAGNDTMVTSAPNGNIRNTPEQANPTAPEASPKIQTTQNQQTVTPEATPITTITALTDLTNRSKRDSKVQKILTFSQGLKKYYSKILKLLQLTQEEDSEGLLEWCTRVLEQACDDDYFNKRIEEFFITGKGYFNDVLQFRLHDALSNTEPAQTTSPTAVPFKSYYAKGSLTFDSGYFSARCYPRASNSGLQLINVTQHPVKIANTPGPKLSNLKTINCINLKVSTDKEHSELEVNVLLPQVAVNLSNCHVSIKSHVCDYSLDTDGAIKLPRVAHNGVFIPGTYKIVIDKKNNLNDRCTLITNCVIKGREVRKGQSALRQYKTEIRIGQTFTGSRRLLAEGGSSDCISRTQLVKTEVAEIHEDSYGGPGEKITICNGSTIVDQGLGSELGCYTINRVRSYKLCENSASGKSCEIDSIPVKCKQGFCLKITQEGRGHVKLSRGTEIVLDVCDSSCELMIPKGTGDILVDCSGGQQHFLQNNLIDLGCPNVPLLGKMAIYVCRMSNHPKTTMAFLFWFSFGYVITCIACRVLFYLLIAIGTVGKKLKQYRELKPQTCIVCESVPVNAIDAEMHELNCSYNICPYCASRLSTDGLIRHVTQCPKRREKVEETELFLNLERIPWLVRKLLQVSESTGMALKRSCWMITLLILLLVSISPVQSAPVGKERAIETYQARETYTGICLFVLGSVLFAVSWLTKALIDGIGNSFSPGLSVCKTCSIGSINGFEIESHKCYCSLFCCPYCRACSSDKNTHRMHLNVCKKRKMGSNVMLAVCKRMCFRATIEASNKALLIRSIINSTFVICILILTICVVSTSAVDMENLPAGIWEKEEDLTNFCHQECQVTETECLCPYEAMVLRKPLFLDSTAKGMKSLLNSTSLETSLSIEAPWGAINVQSTFKPTVSAANIALSWSSVEHRGNKILVSGRSESIMKLEERTGVSWNLGVEDASESKTLTVSVMDLSQMYSPVFEYLSGDRQVEEWPKATCTGDCPERCGCTSSTCLHKEWPHSRNWRCNPTWCWGVGTGCTCCGLDVKDFFTDYMLVKWKVEYIKTEAIVCVELTSQERQCSLIEAGTRFNLGPVTITLSEPRNVQQRLPPEIVTLHPKIEEGFFDLMHVQKILSASTVCKLQSCTHGVPGDFQIYHVGNLLRGDKVNGHSIHKIEPHFNTSWMSWDGCDLDYFCNMGDWPSCTYTGVTQHNRAAFINMLNIETDYTKTFHFHSKRVTAHGDTPQLDLKARPAYGAGEVTVLVEVADLELHTKKLEVSGLKIASLTCSGCYACSSGISCKVRIHVNEPDEFTVHVRSSDPDVVAAGSSLMARKIEFGADSTFKAFSSMPKDSLCFYIVEKDYCSSCTDDDTQKCVNTKLDHPQSILIEHKGTIIGKQNDTCSTKTSCWLESVKGFFYGLKNMLSGIFGNVFLGIFLFLAPFVLLIFFFFFGWRLLFCLKCCRRTRGLLKYKHLKDEEEAGYKKIIERLNGKKGKSQLFDGERLADRKIAELFSTKIHIG

SEQ ID NO: 1185 - protein, 1695 aa, Artificial Sequence
  derived and/or modified protein sequence (wt) from CCHFV(ArD39554)__DQ211628.1__GP
MLCHIKHILLFCIILYHQQWNTGASNTTISPTTNKSHTDISHQPTSITAASSPGSPATTAPPERSVTPSHTPTTSVSEAGSGEPPAATPASATAQSPEPASAAQPSPTIPKPTTPDPTSEALSTPATSRPQEPSTHPSPRSSPSKPVETQSTRHTARELLSVTGTEAEQLITQTIHTTKEATKATSPQPTASNPDPTLATTSRSINSINPKGPESTRATPQSTSPTPESSTIQTQILPIITTPGTLEAIIHPTNRSKRNLGTEIILTLPQGLKKYYSKVLKLMHLTREEDSEGLLEWCTRILGQTCDDDYFQKRITEFFITGVGYFNEVLLFKETTDAPTLAPTHKGAPPTEPFKSYYAKGFITMDSGYFSAKCYSRASNSGLQLINVTMHSSKMPITPGPKYSNLKNINCINLKVSTDKEHNEVEINVLLPQVAVNLSSCHVLVRSHVCDYSLDADGMIKLPQITHEGTFIPGTYKIIIDKKNKQNDRCTLITNCVIKGREVRKGQSALRQYKTEIRVGQASSGTRRLLSESNNNDCVSRTQLIKTENAEIHGDDYGGPGEKITICNGSTIVEQRLGSELGCYTINRIKSFKLCENSASGKGCEIDSTPVKCKQGFCLKITQEGRGHVKLSRGSEIILDVCDSSCEMMIPKGSGDILVDCSGGQQHFLQDNLVDLGCPNVPLLGKMAIYICRMSNHPKTTMAFLFWFSFGYVITCIFCKVIFYVLIIIGTLGKRIKQYRELKPQTCTICEATPVNAIDAEMHDLNCSYNICPYCASRLTSEGLVRHVTQCPKRKEKIEETELYLNLERIPWFVRKLLQVSESTGVALKRSSWLVTLLVLLTVSLSPVQSAPIGQERTVVTYQVRESYTGMCLFILGSVLFAISWLTKGLVDSVGNIFFPGLSVCKTCSIGSINGFEIESHKCYCSLFCCPYCRYCSADRGAHQSHLSVCKKRKTGSNVMLAVCKRMCFRATLKVSSEALIIRSIINTTFVVCILILVVCVVSTSAVEMENLPAGTWEKEEDLTNFCHQECQVTETECLCPYEAFVLRKPLFLDSTAKSMKSLLNSTSLETSLSIEAPWGAINVQSTFKPTASTANIALSWSSVEHRGNKILVTGRSESIMKLEERTGISWNLGVEDASESKTLTVSVMDLSQMYSTVFEYLSGDRQVEEWPKATCTGDCPERCGCTSSTCLHKAWPHSRNWRCNPTWCWGVGTGCTCCGLDVKNLFTDYMLIKWKVEFIKTEAIVCVELTSQERQCSLIEAGTRFNLGPVTITLSEPRNIQQKLPPELVTLHPRVEEGFFDLMHVQKVLSASTVCKLQSCTHGVPGDLQVYHVGNLLKGDKINGNSFHKIEPNLNTSWMSWDGCDLDYYCNMGDWPSCTYTGVTQHNHAAFVNLLNIETDYTKNFHFHSKRVTAHGETPQLDLKARPKYGAGEVTVLVEVADMELHTKKIEISGLKFASLTCTGCYACSSGISCKVRLHVDEPDELTVHVKSDDPDVVAASSSLMARKIEFGTDSTFKAFSSMPKDKLCFYIVERDYCSSCSKEDTQKCVNAKLEQPQSILIEHKGTIIGKQNDTCTVKASCWLESVKSFFYGLKNMLGGIFGNVILGIIMFLAPFALLLLFFLFGWRILFCLRCCRRTRGLFKYKHIKDDEESGYKRIIERLNNKKGKNKLFDGERLADKKIAELFSTKTHIG

SEQ ID NO: 1186 - protein, 1695 aa, Artificial Sequence
  derived and/or modified protein sequence (wt) from CCHFV(AP92)__DQ211625.1__GP
MPDHFILLLLMYTVFHQHPQDVSANVHLVNPSNSTTGASTAFNPVHNATTDGQKQSTSTTTMARPSTVTQITTAQAMEVDGSGESTTLPAVTPTPAETTTHANQKSASTMGTLTTSLEDTALMTLTGRSILTSQSQTGSFDRTSKPQTPRSTNQPLRKLLSAVSTEAAPQTSPTAVTADQTEASTSPQVTTDTSPSTPTQVTSSAGSSSSNTSNHSKTTPQLTSSGSEAQQTQPTTMPNTTALVTPTAHISPTNRSKRNSEVEIILTLPQGLKKYYSKILKLLHLTLEEDSEGLLEWCTRTLKQACDDGYFQERIKEFFLTGEGYFNEVLLFRSPSQLGTTGSPLASPPTAEPFKSFYAKGFLIMDSGYFSAKCYPKASNSGLQLINITQHSIKVVNTPGPKYSNLKTVNCINLKVSTDKDHSELEVNVLLPQVAVNISNCHVLIKSHVCDYSLDTDGMIRLPQVTHEGTFIPGTYKIVIDKKNKLNDRCTMTTNCVIKGKEVRKGQSTLRQYRTEIRVGQMSSGTRRLLSEGGDGGCISRTQLIKTETAEVHGDDYGGPGEKITICNGSTIVDQRLGSELGCYTINRIKSFKLCENSAQGKNCEIDSAPVQCRQGYCLKISQEGRGHVKLSRGSEIVLDVCDTSCEIMIPKGTGDILVDCSGGQQHFLQSNLVDLGCPNIPLLGKMAIYICRMSNHPKTTMAFLFWFSFGYVITCILCKTLFYILIIIGTLGKKLKQYRELKPQTCTICESVPVNAIDAEMHDLNCSYNICPYCASRLTSEGLTRHVNQCPKRKEKVEETELYLNLERIPWIVRKLLQVSESTGVALKRSSWMIVLLILLIVSMSPVQSAPISQERTVALYQSREDYMGICLVIMGSVLLAVSLLVRGLIDSISSTFFPGLSVCRTCHIGSINGFEIESHKCYCGLLCCPYCRACSTDQDAHQFHLSVCKKRKAGSNVMLAVCKRMCFKAIIEASNKVLFIRNVINTTFVVCILVMVACIASSAAVEMENLPAGTWEREEELTNFCHQECQVTETECLCPYESFILRKPLFLDSIAKGVKNLLNSTSLETSLSIEAPWGAINAQSTYKPTASSANIALTWSSVEHRGNKILVSGRSESIMKLEERTGISWNLGVEDASESRTLTISVMDLSQMYSPVFEYLSGDRQVEEWPKATCTGNCPERCGCTSSTCLYKEWPHSRNWRCNPTWCWGVGTGCTCCGLDVKELFTDHMLVKWKVEYIKTEAIVCVELTSQERQCSLIEAGTRFSLGPVTITLSEPRNIQQKLPPELITLHPKIEDGYFDLMHVQKVMSASTVCKLQSCTHGVPGDLQIYHVGNLLKGDRVNGHLIHKVEPHLNTSWMSWDGCDLDYFCNMGDWPSCTYTGVTQHNHAAFANLLNIETDYTKTFHFHSKRVTAHGDTPQLDLKARPRYGAGEITVLVEVADMELHTKKVEVTGLKFASLTCSGCYACSSGISCKVRIHVDEPDELTVHVKSSDPDIVAASSSLMARKIEFGVDSTFKAFSSMPKDSLCFYIVERDYCNSCKNEETQRCVNAKLEQPQSILIEHTGTIIGKQNDTCGSRTSCWLDSFKSFFYGLKSMLSGIFGNVFLGIFLFLAPFALLLFFFFFGWRILFCFKCCRRTRGLFKYRHIKDDEEVGYKKIIERLNNKKGKHRLLDGERLADRKIAELFSTKTHIG

SEQ ID NO: 1187 - protein, 1694 aa, Artificial Sequence
  derived and/or modified protein sequence (wt) from CCHFV(UCCR4413)__KY484038.1__GP
MLRYILYALLASAILHQHLYKVGADTQKPTVRTNTTHKISPTATANRTTYEQATPSTTPKSSTKPTTHIATAHLAESDGSGETTLLLPTTASQYTTEGQTSLEPTAEETGSNTIPSDTTSTSPITENSESTDTQMNVSDSSSSPLATQGARSPARNLLSVPSVEPGQQTTPKQPTTKGTVTPTTPQPTTSSPTPAPTSATLSTNSSSISTPVQTSSPLQPMAPSHETQHALYTTSTESTLRTLSAERIHPTNRSRRNSEVEIILTLPQGLKKYYSRLLKLLHLTMEEDTEGLQEWCVRVLGQTCDDSYFHKRLAEFFITGTGFFNEVLLFRSPSTPTTIKPSPTGSPTVEPFRSYYAKGSLTIDSGYFSAKCYPRTSNSGLQLINLTQHSVEIANTPGPKHSSLKTINCINIKASTDKEHNEVEINVLLPQVAINLSNCHVSIRSHVCDYSLDTDGKIRLPQISHEGTFIPGTYKIIIDKKNKLNDRCSLITSCVIKGRELRKGQSTLRQYKTEIKIGQTSSGSRRLLSESSASGCISRTQMIKSETAEIHDDIYGGPGEKLTICNGTTVVDQRLGSELGCYTINRIKTYKLCENSVKEKTCEIDSVPVKCRQGLCLKITQEGRGHVKLSRGSEIVLDICDSSCELMIPKGTGDILVDCSGGQQHFLQDNLVDLGCPNIPLLGKVAIYICRMSNHPKTTMAFLFWFSFGYVITCILCKILFYLLIITGTLGKKLKQYRELKPQTCTICESTPVNAIDAEMHDLNCSYNICPYCASRLTSDGLIRHVNLCPKRKEKVEETELYLNLERIPWFVRKLLQVSESTGVALKRSSWLLILVILLTVSMSPVQSAPINQQRAVEAYQAREGYTGICLFILGSVLFMTSWLTKGLIDSIGDSFFPGLFVCKTCSIGSINGFEIESHRCYCSLLCCPYCRTCSADKDSHQLHLSICKKKKAGSNVMLAVCKRMCFKATIEASNRVLLIRSIINTTFIICMLILVVCVISTSAVEMEDLPAGTWEREEDLTNFCHQECQVTETECLCPYEAFVLRKPLFLSSIVKGKKNLLNSASLETSLSIEAPWGAINAQSTFKPTISTANIALSWSSVEHRGNKVLVSGRSESIMKLEERTGISWNLGVEDASESRMLTVSVMDLSQMYLPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPSEIVTLHPKIEEGFFDLMHVQKVLSASTVCKLQSCTHGVAGDLQVYHVGNLLKGDKINGHSIHKIEPHLNTSWMSWDGCDLDYYCNMGDWPSCTYTGVTQHNHAAFVNLLNIETDYTKSFHFHSKRVTAHGDTPQLDLKARPMYGAGEITVLVEVADMELHSKNIEISGLKFASLTCSGCYACSSGISCKVRIHVDEPDELAVHVKSDDLDVVAASSSLMARKIEFGTDSTFKAFSSMPKESLCFYIVERDFCKSCAAEDTQKCVKAKLEQPQSILIEHKGTIIGKQNDTCSTKTSCWLESFKSFFYGLKNMLSGVFGSAIMGILLFLAPFILLILFFFFGWRILFCLRCCRRTRGLFKYKHIKDDEEAGYKKIIEKLNNKKGGTSKLLDGERLADRKIAELFSTKAHIG

SEQ ID NO: 1188 - protein, 1691 aa, Artificial Sequence
  derived and/or modified protein sequence (wt) from CCHFV(SCT ex Afghanistan)__KC344856.1__GP
MHHAYQIMYTLLVCAILCPQPWSLEGTHVPLNGTKHNGTGITAAPGGSQGPTSPASTAVSLTPDPFTTEPTASAVELESSGEGHTSLSVTTQGLTSPETTPGLPTVTDTGVSSTSIFGIGIRVAGDTPTSTTHTGLPSSPSMPSTAQGPHHAVRGLLSVSSTRPGEASTITVPGEAGTEANSSSSAISKKPAPSPTAEAITEANNSSNPRQPELSTQPAIPGLVTSSAQPILLQSATSTAAQDIYPSPTNRSKRNLEMEIILTLSQGLKKYYGKILRILDLTLEEDTEGLLEWCKRNLGLTCNDNFFQERIEEFFLTGEGHFNEVLQFKTPSTLSPTEPTHTRTPTVKPFKSYFARGFLSIDSGYFSAKCYSKTSNSGLQLINITQHPARIADTPGPKITNLKAINCINLKASVFKEHREIEINVLLPQVAVNLSNCHVLIKSHVCDYSLDIDGAVRLPHVHHKGTFIPGTYKIVIDKRNKQNDRCTLVTNCVIKGKEIRKGQSALRQYRTEIRIGKASAGSRRLLSEESGDDCISRTQLLRTETAEVHNDNYGGPGDKITICNGSTIVDQRLGSELGCYTINRVKSFKLCENSATGKSCKIDSTPVKCRQGFCLKITQEGRGHVKLSRGSEVVLDACDSSCEIMIPKGTGDILVDCSGGQQHFLKDNLIDLGCPNIPLLGKMAIYICRMSNHPKTTMAFLFWFSFGYVITCIFCKVIFYLLIVVGTLGKKFKQYRELKPQTCTICETTPTNAIDAEMHDLNCSYNICPYCASRLTSDGLARHVTQCPKRKEKVEETELYLNLERIPWIVRKLLQVSESTGVALKRSSWLIVLLVLLTVSLSPVQSAPIGHGKTIETYQTREGYISVCLFVLGGILFVVSCLIKGLVDSVGNSFFPGLSICKTCSIGSVNGFEIESHKCYCSLLCCPYCRHCSTDREIHQLHLSICKKRRTGGNVMLAVCKRMCFRATMEVSNKVLFIRNIINTTFVICILILAVCVVSTSAVEMESLPAGTWEREEDLTNFCHQECQVTETECLCPYEALVLRKPLFLNSIVKGMKNLLNSTNLETSLSIEAPWGAINVQSTFKPTVSTANIALSWSSVEHRGNKILVSGRSESIMKLEERTGISWDLGVEDASESKSLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKLNGHMIHKIEPHFNTSWMSWDGCDLDYYCNMGDWPSCTYTGVTQHNHAAFVNLLNIETDYTKNFHFHSKRVTAHGDTPQLDLKARPTYGAGEITVLVEVADMELHTKKIDISGLKFASLTCAGCYACSSGISCKVRIHVDEPDELTVHVKSEDPDIVAASTSLIARKLELGTDSTFKAFSAMPKTSLCFYIVEREYCKSCSKEDTQKCVNTKLEHPQGILIEHKGTIIGKQNDTCTAKAGCWLESVKSFFYGLKNMLSGIFGNVFIGIFLFLAPFVLLILFFMFGWRLLFCFKCCRRTRGLFKYRHLKEDEESGYRRIIERLNNKKGKNKLLDGERLADRRIAELFSTKTHIG

SEQ ID NO: 1189 - protein, 1689 aa, Artificial Sequence
  derived and/or modified protein sequence (wt) from CCHFV(SPU 431/85)__KJ682812.1__GP
MPVNIMYTPLVCAVICLQLWNLGGTLVSTNRTQHNETGTVATPEGTLRPRLPVSTALPTKSDRPSVGPAASSSGLEGSGEPNTSPSITTKGLTPPETTPALPTATDTDASSTGVVDVSTQMTKDIPMSTAYTNPPSTPSAPSTPQGTHHTARGLLSVASTKSEEVSMSTSPAKTSTETSSPPPATSETPTPSPTTQVPTGNNNPNTSRQPTPSAQPAMSNPATSPAQPNLSQSAPPTADQGVHPSPTNRSKRNLEIEIILTLSQGLRKYYGKILKLLDLTLEEDTEGLLEWCKRNLGLTCDDNFFQKRIEEFFLTGEGYFNEVLQFKVPSTLSSTEPTHTRPPTVEPFKSYFAKGFLSMNSGYFSAKCYPRTSNSGLQLINVTKHSAKIADTPGPKITNLKTINCINLRASVFKEHREVEINVLLPQVAVNLSNCHAQIKSHVCDYSLATDGMVRLPHIHHEGTFIPGTYKIVIDKKNKQNDRCTLVTNCVIKGREVRKGQSALRQYKTEIRIGKASSGSRRLLSEESDGDCISRTQLLRTETTEIHSDNYGGPGDKITICNGSTIVDQRLGSELGCYTINRVKSFKLCENSATGKSCEIDSTPVKCRQGFCLKITQEGRGHVKLSRGSEIVLDACDSNCEIMIPKGTGDILVDCSGGQQHFLKDNLIDLGCPNIPLLGKMAIYICRMSNHPKTTMAFLFWFSFGYVITCILCKVIFYLLIVAGTVGKKFKQYRELRPQTCTICETIPVNAIDAEMHDLNCSYNICPYCASRLTSDGLARHVMQCPKRKEKVEETELYLNLERIPWVVRKLLQVSESTGVALKRSSWLTVLLVLLIVSLSPVQSAPIGHGKTIETYQAREGYTSFCLFILGSILFVVSCLVKGLIDSVGNSFFPGLSICKTCSIGSINGFEIESHKCYCSLFCCPYCRHCPADREIHKLHLSICKKRKTGSNVMLAVCKRMCFRATIEVSNRALLIRNIINTTFVVCILTLAVCVVSTSAVEMESLPAGTWEKEEDLTNFCHQECQVTETECLCPYEALVLRKPLFLDSIVKGRKNLLNSTSLETSLSIEAPWGAINVQSTFKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQRVLSASTVCKLQSCTHGVPGDLQVYHIGNLLKGDKVNGHLIHKIEPHFNTSWMSWDGCDLDYYCNMGDWPSCTYTGVTQHNHAAFVNLLNIETDYTKNFHFHSKRVTAHGDTPQLDLKARPTYGAGEVTVLVEVADMELHTKKIEISGLKFASLTCTGCYACSSGISCKVKIHVDEPDELTVHVKSEDPDIVAAGSSLMARKLEFGADSTFKAFSAMPKTSLCFYIVEREYCKSCSREDTRKCVNTKLDRPQSILIEHKGTIIGKQNNTCTAKASCWLESVKSFFYGLKNMLSGIFGNVFIGIFLFIAPFVLLILFFMFGWRILFCFKCCRRTRGLFKYRHLKDDEETGYRKIIERLNNKKGKNKLLDGERLADRKIAELFSTKSHIG

SEQ ID NO: 1190 - protein, 1689 aa, Artificial Sequence
  derived and/or modified protein sequence (wt) from CCHFV(SPU 556/87)__KJ682811.1__GP
MTVNTVCTPLVCAVFCLQLWNLGGTLVPTNRTQHNKTGTMATPEGTLGPRLPVSTALPTKSDRPSVGPAAPSSGLEGSGEPNTSPSITTKGLALPETTPAPPTATDTDASSTGVVNVSTQMTKDIPMSTAYTNPPSTPSAPSTPQGTHHTARGLLSVASTKSEEVSMSTSPGKTSTETSSPPPATSETPAPSPTTQAPTGNNNPNTSRQPTPSAQPAMSNPTTSPAQPNLLQNAPPTADQGVHPGPTNRSKRNLEMEIILTLSQGLRKYYGKILKFLDLTLEEDTEGLLEWCKRNLGLTCDDNFFQKRIEEFFLTGEGYFNEVLQFKVPSTLSSTEPTHTGSPTVEPFKSYFAKGFLSMNSGYFSAKCYPRTSNSGLQLINVTKHSAKIADTPGPKITNLKTINCINLRASVFKEHREVEINVLLPQVAVNLSNCHAQIKSHVCDYSLATDGMVRLPRIHHEGTFIPGTYKIVIDKKNKQNDRCTLVTNCVIKGREVRKGQSALRQYKTEIRIGKASSGSRRLLSEESDGDCISRTQLLRTETAEIHSDNYGGPGDKITICNGSTIVDQRLGSELGCYTINRVKSFKLCENSATGKSCEIDSTPVKCRQGFCLKITQEGRGHVKLSRGSEIVLDACDSSCEIMIPKGTGDILVDCSGGQQHFLKDNLIDLGCPNIPLLGRMAIYICRMSNHPKTTMAFLFWFSFGYVITCILCKVIFYLLIVAGTVGKKFKQYRELRPQTCTICETTPVNAIDAEMHDLNCSYNICPYCASRLTSDGLARHVMQCPKRKEKIEETELYLNLERIPWVVRKLLQVSESTGVALKRSSWLTVLLVLLIVSLSPVQSAPIGHGKTIETYQAREGYTSFCLFILGSILFIVSCLVKGLIDSVGNSFFPGLSICKTCSIGSVNGFEIESHKCYCSLFCCPYCRHCSADREIHKLHLSICKKRKTGSNVMSAVCKRMCFRATIEVSNRALLIRSIINTTFAVCILTLAVCVVSTSAVEMESLPAGTWEREEDLTNFCHQECQVTETECLCPYEALVLRKPLFLDSIVKGKKNLLNSTSLETSLSIEAPWGAINVQSTFKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHAAFVNLLNIETDYTKNFHFHSKRVTAHGDTPQLDLKARPTYGAGEVTVLVEVADMELHTKKIEISGLKFASLSCTGCYACSSGISCKVRIHVDEPDELTVHVKSEDPDIVAAGSSLMARKLEFGADSTFKAFSAMPKTSLCFYIVEREYCKSCSREDTQKCVNTKLERPQSILIEHKGTIIGKQNDTCTAKASCWLESVKSFFYGLKSMLSGIFGNVFIGIFLFIAPFVLLILFFMFGWRILFCFKCCRRTRGLFKYRHLKDDEETGYRKIIERLNNKKGKNKLLDGERLADRKIAELFSTKSHIG

SEQ ID NO: 1191 - protein, 1689 aa, Artificial Sequence
  derived and/or modified protein sequence (wt) from CCHFV(SPU 18/88)__KJ682810.1__GP
MPFNIMYTPLLCAILCLQLWSLEGIYGLSNKTQHNDTSTIKVPEESQKTSLPANTASPITSDPSSATSTALASGPEGSGDTSTSPSVTTQGPTLLETTPEPHTTIDIDESSTAIADISTQTVKDIPTPTTHTSLPSTPSAPTIPQEAHHTARGLLSVTSTKPGETSTPTSPGEASTEASSPQPTISETPSPPPTTQAPTEINNPNTSRQPMPSTQPAAPNSVTPPVQPTFSQSDVSTVAQDIHPSPTNRSKRNLEMEIILTLSQGLKKYYGKVLKLLDLTLEEDTEGLLEWCKRNLGLTCDDNFFQKRIEEFFLTGEGHFNEVLQFKTPSTLSPTEPARVESPTVEPFKSYFAKGFLSMDSGYFSAKCYPKSSNSGLQLINVTQHSIRITDTPGPKITSLKTINCINLKALVFKEHREIEINVLLPQVAVNLSNCHVLIKSHACDYSLDIDGPVRLPRIHHEGTFIPGTYKIVIDKKNKQNDRCTLVTNCVIKGREIRKGQSVLRQYRTEIKIGKASSGSRRLLSEESNDDCLSRTQLLRTENAEIHSDNYGGPGDKITICNGSTIVDQRLGSELGCYTINRVKSFKLCENSATGKSCEIDSTPVRCRQGFCLKITQEGRGHVKLSRGSEVVLDACDSSCEIMIPKGTGDILVDCSGGQQHFLKDNLVDLGCPNIPLLGKMAIYICRMSNHPKTTMGFLFWFSFGYVITCILCKVIFYLLIVVGTLGKKFKQYRELKPQTCTICETNPVNAIDAEMHDLNCSYNICPYCASRLTSDGLARHVMQCPKRKEKIEETELYLNLERIPWVVRKLLQVSESTGVALKRSSWLVILLVLLTVSLSPVQSAPISHGETVEVYQTREGYTSICLFVLGSILFLVSCLMKGLVDSVGNSFSPGLSICKTCSIGSINGFEIESHKCYCSLFCCPYCRHCSADIEIHKLHLSICKKRKTGSNVMLAVCKRMCFRATVEVSNKALLIRNIINTTFVVCILILAVCVVSTSAVEMENLPAGTWEKEEDLTNFCHQECQVTETECLCPYEALVLRKPLFLDSIVKGKKNLLNSTSLETSLSIEAPWGAINVQSTFKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVDYIKTEAIVCVELTSQERQCSLIEAGTRFNLGPVTITLSEPRNIQQKLPPEIVTLHPRIEEGFFDLMHIQKVLSASTVCKLQSCTHGVPGDLQIYHIGNLLKGDKVNGHLIHKIEPHFNTSWMSWDGCDLDYYCNMGDWPSCSYTGVTQHNHAAFVNMLNIETDYTKNFHFHSKRVTAHGDTPQLDLKARPTYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSKEDTQKCVNTKLEQPQSILIEHKGTIIGKQNDTCTGKAGCWLESIKSFFYGLKNMLSGIFGNVFIGIFLFLAPFIMLILFFMFGWRILFCFKCCRRTRGLFKYRHLKDDEEIGYRKIIERLKNKKGKNKLLDGERLADRKIAELFSTKTHIG

SEQ ID NO: 1192 - protein, 1689 aa, Artificial Sequence
  derived and/or modified protein sequence (wt) from CCHFV(SPU 497/88)__KJ682808.1__GP
MPFNIMYTPLLCAILCLQLWSLEGIYGLSNKTQHNDTSTIKVPEESQKTSLPANIASPTTSDPPSATSTASASGPEGSGDTSTSPSVTTQGPTPLEITPEPHTTIDIDKSSTSIADISTRTVKDIPTPTTHTSLPSTPSAPTIPQEVHHTARGLLSVTSTKPEEASTLTSPGEASTEASSPQPTISETPSPPPTTQAPTEINNPNTSRQPMPSTQPAAPNSVTPPVQPTFSQSDVSTAAQDIHPSPTNRSKRNLEMEIILTLSQGLKKYYGKVLKLLDLTLEEDTEGLLEWCKRNLGLTCDDNFFQKRIEEFFLTGEGHFNEVLQFKTPSTLSPTEPARVESPTVEPFKSYFAKGFLSMDSGYFSAKCYPKSSNSGLQLINVTQHLIRITDTPGPKITNLKTINCINLKALVFKEHREIEINVLLPQVAVNLSNCHVLIKSHVCDYSLDIDGPVRLPRIHHEGTFIPGTYKIVIDKKTKQNDRCTLVTNCVIKGREIRKGQSVLRQYRTEIKIGKASSGSRRLLSEESNDDCLSRTQLLRTENAEIHSDNYGGPGDKITICNGSTIVDQRLGSELGCYTINRVKSFKLCENSATGKSCEIDSTPVRCRQGFCLKITQEGKGHVKLSRGSEVVLDACDSSCEIMIPKGTGDILVDCSGGQQHFLKDNLVDLGCPNIPLLGKMAIYICRMSNHPKTTMVFLFWFSFGYVITCILCKVIFYLLIVVGTLGKKFKQYRELKPQTCTICETNPVNAIDAEMHDLNCSYNICPYCASRLTSDGLARHVMQCPKRKEKIEETELYLNLERIPWVVRKLLQVSESTGVALKRSSWLVILLVLLTVSLSPVQSAPISHGETVEVYQTREGYTSICLFVLGGILFLVSCLMKGLVDSVGNSFFPGLSICKTCSIGSINGFEIESHKCYCSLFCCPYCRHCSADIEIHKLHLSICKKRKTWSNVMLAVCKRMCFRATVEVSNKALLIRNIINTTFVVCILILAICVVSTSAVEMENLPAGTWEKEEDLTNFCHQECQVTETECLCPYEALVLRKPLFLDSIVKGMRNLLNSTSLETSLSIEAPWGAINVQSTFKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVDYIKTEAIVCVELTSQERQCSLIEAGTRFNLGPVTITLSEPRNIQQKLPPEIVTLHPRIEEGFFDLMHIQKVLSASTVCKLQSCTHGVPGDLQIYHIGNLLKGDKVNGHLIHKIEPHFNTSWMSWDGCDLDYYCNMGDWPSCSYTGVTQHNHAAFVNMLNIETDYTKNFHFHSKRVTAHGDTPQLDLKARPTYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSKEDTQKCVNTKLEQPQSILIEHKGTIIGKQNDTCTARASCWLESIKSFFYGLKNMLSGIFGNVFIGIFLFFAPFIMLILFFMFGWRILFCFKCCRRTRGLFKYRHLKDDEEVGYRKIIERLNNKKGKNKLLDGERLADRKIAELFSTKTHIG

SEQ ID NO: 1193 - protein, 1689 aa, Artificial Sequence
  derived and/or modified protein sequence (wt) from CCHFV(SPU 130/89)__KJ682807.1__GP
MPFNIMYTPLLCAILCLQLWSLEGIYGLSNKTQHNDNSTTKAPEESHKTSLPANTASPITSDPPSTTSTTSASGPEGSGDTSTSPPVTTQGPASPETTPEPHTTIDIDKSSTAIADISTQTVKDIPTPTTHTSLPSTLSAPTIPQEAHHTARGLLSVTRHKPGEASKPTSPGEASTEASSSQPTISETPSPPPTTQAPTEINNPNTSRQPMPSTQPAAPSSVTHPAQPTPSQSDVPTAAQDIHPSPTNRSKRNLEMEIILTLSQGLKKYYGKVLKLLDLTLEEDTEGLLEWCKRNLGLTCDDNFFQKRIEEFFLTGEGHFNEVLQFKTPSTLSPTEPARVESPTVEPFKSYFAKGFLSMDSGYFSAKCYPKSSNSGLQLINVTQHLIRITDTPGPKITNLKTINCINLKALVFKEHREIEINVLLPQVAVNLSNCHVLIKSHVCDYSLDIDGPVRLPSIHHEGTFIPGTYKIVIDKKNKQNDRCTLVTNCVIKGREIRKGQSVLRQYRTEIKIGKASSGSRRLLSEEPNYDCLSRTQLLRTENAEIHSDNYGGPGDKITICNGSTIVDQRLGSELGCYTINRVKSFKLCENSATGKSCEIDSTPVRCRQGFCLKITQEGRGHVKLSRGSEVVLDACDSSCEIMIPKGTGDILVDCSGGQQHFLKDNLVDLGCPNIPLLGKMAIYICRMSNHPKTTMAFLFWFSFGYVITCILCKVIFYLLIVVGTLGKKFKQYRELKPQTCTICETNPVNAIDAEMHDLNCSYNICPYCASRLTSDGLARHVMQCPKRKEKIEETELYLNLERIPWVVRKLLQVSESTGVALKRSSWLVVLLVLLTVSLSPVQSAPISHGETVEVYQTREGYTSICLFVLGSILFLVSCLMKGLVDSVGNSFFPGLSICKTCSIGSINGFEIESHKCYCSLFCCPYCRHCSADIEIHKLHLSICKKRKTGSNVMLAVCKRMCFRATVEVSNKALLIRNIINTTFVVCILILAVCVVSTSAVEMENLPAGTWEKEEDLTNFCHQECQVTETECLCPYEALVLRKPLSLDSIVKGMKNLLNSTSLETSLSIEAPWGAINVQSTFKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVDYIKTEAIVCVELTSQERQCSLIEAGTRFNLGPVTITLSEPRNIQQKLPPEIVTLHPRIEEGFFDLMHIQKVLSASTVCKLQSCTHGVPGDLQIYHIGNLLKGDKVNGHLIHKIEPHFNTSWMSWDGCDLDYYCNMGDWPSCSYTGVTQHNHAAFVNMLNIETDYTKNFHFHSKRVTAHGDTPQLDLKARPTYGAGEITVLVEVADMELHTKKVEISGLKFASLTCTGCYACSSGISCKVRIHVDEPDELTVHVKSEDPDIVAASSSLMARKLEFGTDSTFKAFSAMPKTSLCFYIVEREHCKSCSKEDTQRCVNTKLEQPQSILIEHKGTIIGKQNDTCTAKASCWLESIKSFFYGLKNMLSGIFGNVFIGVFLFLAPFIILILFFMFGWRILFCFKCCRRTRGLLKYRHLKDDEEIGYRKIIERLNNKKGKNKLLDGERLADRKIAELFSTKTHIG

SEQ ID NO: 1194 - protein, 1689 aa, Artificial Sequence
  derived and/or modified protein sequence (wt) from CCHFV(SPU 383/87)__KJ682806.1__GP
MPFNIMYTPLLCAILCLQLWSLEGIYGLSNRTQHNDTSTIKVPEESQKTSLPANTASPITSDPPSTTSTASASGPEGSGDTSTSPPVTTQGPTPPETTPEPHTTIDIDKSSTAIADISTQTVKDIPTPTTHTSLPSTLSAPTIPQEAHHTARGLLSITSTKPGEASTPISPGEASTEASSPQPTISETPSPPPTAQAPTEINSPNTSRQPMPSTQPAAPNSVTHPAQPTPSQSDVPTAAQDIHPNPINRSKRNLEMEIILTLSQGLKKYYGKVLKLLDLTLEEDTEGLLESCKRNLGLTCDDNFFQKRIEEFFLTGEGHFNEVLQFKTPSTLSPTEPARVESPTVEPFKSYFAKGFLSMDSGYFSAKCYSKSSNSGLQLINVTQHLIRITDTPGPKITNLKTINCINLKALVFKEHREIEINVLLPQVAVNLSNCHVLIKSHVCDYSLDIDGPVRLPRIHHEGTFIPGTYKIVIDKNNKQNDRCTLVTNCVIKGREIRKGQSVLRQYRTEIKIGKASSGSRRLLSEESNDDCLSRTQLLRTENAEIHSDNYGGPGDKITICNGSTIVDQRLGSELGCYTINRVKSFKLCENSATGKSCEIDSTPVRCRQGFCLKITQEGRGHVKLSRGSEVVLDACDSSCEIMIPKGTGDILVDCSGGQQHFLKDNLVDLGCPNIPLLGKMAIYICRMSNHPKTTMAFLFWFSFGYVITCILCKVIFYLLVVVGTLGKKFKQYRELKPQTCTICETNPVNAIDAEMHDLNCSYNICPYCASRLTSDGLARHVIQCPKRKEKIEETELYLNLERIPWVVRKLLQVSESTGVALKRSSWLVILLVLLTVSLSPVQSAPISHGETVEVYQTREGYTSICLFVLGSILFLVSCLMKGLVDSVGNSFFPGLSICKTCSIGSINGFEIESHKCYCSLFCCPYCRHCSADIEIHRLHLSICKKRKTGSNVMLAVCKRMCFRATVEVSNKALLIRNIINTTFVVCILILAVCVVSTSAVEMENLPAGTWEKEEDLTNFCHQECQVTETECLCPYEALVLRKPLFLDSIVKGMKNLLNSTSLETSLSIEAPWGAINVQSTFKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVDYIKTEAIVCVELTSQERQCSLIEAGTRFNLGPVTITLSEPRNIQQKLPPEIVTLHPRIEEGFFDLMHIQKVLSASTVCKLQSCTHGVPGDLQIYHIGNLLKGDKVNGHLIHKIEPHFNTSWMSWDGCDLDYYCNMGDWPSCSYTGVTQHNHAAFVNMLNIETDYTKNFHFHSKRVTAHGDTPQLDLKARPTYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSKEDTQKCVNTKLEQPQSILIEHKGTIFGKQNDTCTAKASCWLESVKSFFYGLKNMLSGIFGNVFIGVFLFLAPFIMLILFFMFGWRILFCFKCCRRTRGLFKYRHLKDDEEIGYRKIIERLNNKKGKNKLLDGERLADRKIAELFSTKTHIG

SEQ ID NO: 1195 - protein, 1689 aa, Artificial Sequence
  derived and/or modified protein sequence (wt) from CCHFV(SPU 44/08)__KJ682805.1__GP
MPFNIMYTPLLCAILCLQLWSLEGIYGLSNNTQHNDTSTIKVPEESQKTSLPANTASPITSDPPPTTPTASASGPEGSGDTSTSPPVTTQGPTPPETTPEPHTTIDIDKSSTAIADISTQTVKNIPTPTAHTSLPSTLSAPTMPQEAHHTARGLLSVTSTKPGEASTPTSPGEASTEASSPQPTIRETPSPPPTTQTPTEINNPNTSRQPMPSTQPAAPSSVTHPAQPTPSQSDVPTAAQDIHPSPTNRSKRNLEMEIILTLSQGLKKYYGKVLKLLDLTLEEDTEGLLEWCKRNLGLTCDDNFFQKRIEEFFLTGEGHFNEVLQFKTPSTLSPTEPARVESPTVEPFKSYFAKGFLLMDSGYFSAKCYPKSSNSGLQLINVTQHLIRITDTPGPKITNLKTINCINLKALVFKEHREIEINVLLPQVAVNLSNCHVLIKSHVCDYSIDIDGPVRLPRIHHEGTFIPGTYKIVIDKKNKQNDRCTLVTNCVIKGREIRKGQSVLRQYRTEIKIGKASSGSRRLLSEESNDDCLSRTQLLRTENAEIHSDNYGGPGDKITICNGSTIVDQRLGSELGCYTINRVKSFKLCENSATGKSCEIDSTPVRCRQGFCLKITQEGRGHVKLSRGSEVVLDACDSSCEIMIPKGTGDILVDCSGGQQHFLKDNLVDLGCPNIPLLGKMAIYICRMSNHPKTTMAFLFWFSFGYVITCILCKAIFYLLIVVGTLGKKFKQYRELKPQTCTICETNPVNAIDAEMHDLNCSYNICPYCASRLTSDGLARHVMQCPKRKEKIEETELYLNLERIPWVVRKLLQVSESTGVALKRSSWLVILLVLLTVSLSPVQSAPISHGETVEVYQTREGYTSICLFVLGSILFLVSCLMRGLVDSVSNSFFPGLSICKTCSIGSINGFEIESHKCYCSLFCCPYCRHCSADIEIHKLHLSICKKRKTGSNVMLAVCKRMCFRATVEVSNKALLIRNIINTTFVVCILILAVCVVSTSAVEMENLPAGTWEKEEDLTNFCHQECQVTETECLCPYEALVLRKPLFLDSIVKGMKNLLNSTSLETSLSIEAPWGAINVQSTFKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVDYIKTEAIVCVELTSQERQCSLIEAGTRFNLGPVTITLSEPRNIQQKLPPEIVTLHPRIEEGFFDLMHIQKVLSASTVCKLQSCTHGVPGDLQIYHIGNLLKGDKVNGHLIHKIEPHFNTSWMSWDGCDLDYYCNMGDWPSCSYTGVTQHNHAAFVNMLNIETDYTKNFHFHSKRVTAHGDTPQLDLKARPTYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSKEDTQKCVNTKLEQPQSILIEHKGTIIGKQNDTCTAKASCWLESIKSFFYGLKNMLSGIFGNVFIGIFLFLAPFIMLILFFMFGWRILFCFKCCRRTRGLFKYRHLKDDEEIGYRKIIERLNNKKGKNKLLDGERLADRKIAELFSTKTHIG

SEQ ID NO: 1196 - protein, 1689 aa, Artificial Sequence
  derived and/or modified protein sequence (wt) from CCHFV(Matin)__AF467769.2__GP
MSFNIMYTLLLCAILCSQLWSSEGIHGLSNETQHGNASTIKAPEVSQGLGLPVSTAPPITSDPPSITSAASVSGPEGSGDTNTSPPVTTQGLTLPETTLELLTTTNTGASSTVIVDVSTQTVKDTPVSTAHTSPPGTPSAPTTPQGTHHTARGLLSVTSTKSEEASTQTNPKKTSMETNSPGPATSETPSPSPTTQAPTENNNPNTPRQPTPPTQPATPSPVTSPALLASSQGDTSTAVQDVHPSPTNRSKRNLEMEIILTLSQGLKKYYGKILKLLDLTLEEDTEGLLEWCKRNLGLVCDDSFFQKRIEEFFLTGEGHFNEVLQFKTPSTLSPTEPARAGSPTVEPFKSYFARGLLSMDSGYFSAKCYPRASNSGLQLINITQHSARITDTPGPKITNLKTINCINLKASTFKEHREIEINVLLPQVAVNLSSCHVLIKSHVCDYSLDIDGPVRLPRIHHEGTFIPGTYKIVIDKKNKQNDRCTIVTNCVIKGREIRKGQSVLRQYKTEIKIGKASSGSRRLLSEESGDDCISRTQLLRTETAEIHSDSYGGPGDKITICNGSTVVDQRLGSELGCYTINRVKSFKLCENSATGKSCEIDSTPVKCRQGFCLKITQEGRGHVKLSRGSEVVLDACDSSCEIMIPKGTGDILVDCSGGQQHFLKDNLIDLGCPNIPLLGKMAIYICRMSNHPKTTMVFLFWFSFGYVITCILCKVIFYLLIVVGTLGKKFKQYRELKPQTCTICETTPVNAIDAEMHDLNCSYNICPYCASRLTSDGLARHVMQCPKRKEKIEETELYLNLERIPWVVRKLLQVSESTGVALKRSSWLVVLLVLLTVSLSPVQSAPIGHGKTVETYQIREGYTSVCLFVLGSILFIVSCLMKGLVDSDGNSFFPGLSICKTCSIGSINGFEIESHKCYCSLFCCPYCRHCSTDREIHKLHLSICKKRKTGSNVMLAVCKRMCFRATVEVSNKALLIRSIINTTFVVCILILAVCVVSTSAVEMESLPAGTWEREEDLINFCHQECQVTETECLCPYEALVLRKPLFLDSIIKGMKNLLNSTSLETSLSIEAPWGAINVQSTFKPTMSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEVIVCVELTSQERQCSLIEAGTRFNLGPVTITLSEPRNIQQKLPPEIVTLHPRIEEGFFDLMHVQKVLSASTVCKLQSCTHGVPGDLQVYHIGNLLKGDKVNGHLIHKIEPHFNTSWMSWDGCDLDYYCNMGDWPSCSYTGVTQHNHAAFVNMLSIETDYTKNFHFHSKRVTAHGDTPQLDLKARPTYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSKEDTQKCVNTKLEQPQSILIEHKGTIIGKQNDTCTAKASCWLESVKSFFYGLKNMLSGIFGNVFIGIFLFLAPFALLILFFMFGWRILFCFKCCRRTRGLFKYRHLKDDEETGYRKIIERLNNKKGKNKLLDGERLADRKIAELFSTKTHVG

SEQ ID NO: 1197 - protein, 1689 aa, Artificial Sequence
  derived and/or modified protein sequence (wt) from CCHFV(TADJ/HU8966)__AY179962.1__GP
MPVSIMHMLLMCAVLCLQLYGLGGTLRSNNGTEHNKTNVLTTPGDKLSPEPPVSTALPVTPDSSTVTPTTPASGLEGSGEVYTSPPITTKGLSPSEATSEPPATTGMGISSASGVDFSTQAARDTSTLTVLTSPPNSPNTPPTSQDTHHPVRSLLSVTSPRPEETTAPSKSGKESPAANSSHPVTSRPSSPLITVRGPTENSSHNTTGQLESMTQSTTLVPMASPTQTVLSQSVTSIAVQDAHPSSTNRSKRNLEMEIILTLPQGLKKYYGKVLRLLQLTLEEDTEGLLEWCKRNLGLDCDDTFFQKRIEEFFITGEGHFNEVLQFRTPGTLSTTESTHAGSPTAEPFKSYFAKGFLSIDSGYFSAKCYSRTSNSGLRLINVTRHSTRIADTPGPKITNLKTISCINLRASIFKEHREVEINVLLPQVAVNLSNCHVAIKSHVCDYSLDVDGTVRLPHIHHGGTFIPGTYKIVIDKKNKLNDRCTLFTNCVIKGREVRKGQSILRQYKTEIRIGKASTGSRRLLSEESGDDCISRTQLLRTETAEIHGDDYGGPGDKITICNGSTIVDQRLGSELGCYTINRVKSFKLCENSATGKNCEIDSVPVKCRQGYCLKITQEGRGHVKLSRGSEVVLDACDSSCEVMIPKGTGDISVDCSGGQQHFLKDNLIDLGCPKIPLLGKMAIYICRMSNHPKTTMAFLFWFSFGYVITRILCKAIFYLLIIVGTLGKRFKQYRELKPQTCTICETTPANAIDAEMHDLNCSYNICPYCASRLTSDGLARHVTQCPKRKERVEETELYLNLERIPWIVRKLLQVSESTGVALKRSSWLIVLLVLFTVSLSPVQSAPIGYGNTIETYQAREEYTSICLFVLGSILFIVSCLMKGLVDSIGNIFFPGLTICKTCSIGSINGFEIESHKCYCSLLCCPYCRHCSADREIHQLHLSICKKRKTGSNVMLAVCKRMCFRATMEVSNKALLIRSIINTTFVVCILILAVCIVSTSAVEMESLPAGTWEREEDLTNFCHQECQVTETECLCPYEALVLRRPLFLDSIVKGMKNPLNSTSLETSLSIEAPWGAINVQSTYKPTVSTANIALSWSSIEHRGNNILVSGRSESIMKLEERTGISGDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFIDYMFVKWKVDYIKTEAIVCVELTSQERQCSLVEAGTRFNLGPVTITLSEPRNIQQKLPPEIITLHPRIEEGFFDLMHVQKVLSASTVCKLQSCTHGVPGDLQVYHIGNLLKGDKENGHLIHKIEPHFNTSWMSWDGCDLDYYCNMGDWPSCTYTGVTQHNHASFVNLLNIETDYTKSFHFHSKRVTAHGDTPQLDLKARPTYGAGEITVLVEVADMELHTKKIEITGLKFASLTCTGCYACSSGISCKVRIHVDEPDELTVHVKSDDPDVVAASSSLMARKLEFGTDSTFKAFSAMPKTSLCFYIVEREYRKSCSKEDTQKCVNTKLEQPQSILIEHKGTIIGKQNNTCTAKASCWLESVKSFFYGLKNMLSGIFGNVFVGIFLFLAPFILLILFFMFGWRILSCFKCCRRTRGLLKHRHLKDDEETGYRRIIERLNNKKGKNKLLDGERLADRRIAELFSTKTHIG

SEQ ID NO: 1198 - protein, 1689 aa, Artificial Sequence
  derived and/or modified protein sequence (wt) from CCHFV(88166)__AB069675.1__GP
MSFSVMYTPLLCAVLCLQLWSLEGSHGLSNKTQHSNTSTTKAPEVSQELGLPVSTVSTITSDPPSITSAVSVSGSEGSGDTNTSPSVTTQGPTLPETTLEPLTTTDTDASSTVVVDVSTQTVKDTPISTTYTSLPSTPSEPTTPQGTHHTARGLLSVTSTKPEEASTQANPGKISMETNSPRLAISETPSFSPTTQAPTENSNPITSKQLMLSAQPVTPNPMTSPVQPALSQSDTSTAIQDIHPSPTGRSKRNLEMEIILTLSQGLKKYYGKILKLLDLTLEEDTEGLLEWCKRNLGLVCDDNFFQKRIEEFFLTGKGHFNEVLQFKTPSTLSPTGPARTGSPTVEPFKSYFAKGFLSMDSGYFSAKCYPRASNSGLQLINVTQHSTRITDTPGPKITNLKTINCINLKASVFKEHREIEINVLLPQVAVNLSSCHVLIKSHVCDYSLDIDGPVRLPRIHHEGTFIPGTYKIVIDKKNKQNDRCTLVTNCVIKGREIRKGQSVLRQYRTEIKIGKASSGSRRLLSEESGDDCISRTQLLRTETAEIHSDNYGGPGDKITICNGSTVVDQRLGSELGCYTINRVKSFKLCENSATGKSCEIDSTPVKCRQGFCLKITQEGRGHVKLSRGSEVVLDACDSSCEIMIPKGTGDILVDCSGGQQHFLKDNLIDLGCPNIPLLGKMAIYICRMSNHPKTTMGFLFWFSFGYVVTCILCKVIFYLLIVVGTLGKKFKQYRELKPQTCTICETTPVNAIDAEMHDLNCSYNICPYCASRLTSDGLARHVMQCPKRKEKIEETELYLNLERIPWVVRKLLQVSESTGVALKRSSWLVVLLVLLTVSLSPVQSAPIGHGKTVETYQTREGYTSICLFVLGSILFIVSCLMKGLVDSVGNSFFPGLSICKTCSIGSVNGFEIESHKCYCSLFCCPYCRHCSADREIHRLHLSICKKRKTWSNVMLAVCKRMCFRATVEVSNKALLIRNIINTTFVLCILILAVCVVSTSAVEMESLPAGTWEREEDLTNFCHQECQVTETECLCPYEALVLRKPLFSDSIVKGMKNLLNSTSLETSLSIEAPWGAINVQSTFKPTMSAANIALSWSSVEHRGNKILVSGRSESIMKLEERTGISWNLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFIKWKVEYIKTEAIVCVELTSQERQCTLIEAGTRFNLGPVTITLSEPRNIQQKLPPEIVTLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHAAFVNMLNIETDYTKNFHFHSKRVTAHGDTPQLDLKARPTYGAGEITVLVEVADMELHTKKIEISGLKFASLTCTGCYACSSGISCKVRIHVDEPDELTVHVKSEDPDLVAASSSLMARKLEFGTDSTFKAFSAMPKTSLCFYIVEREYCKSCSKEDTQKCVNTKLEQPQSILIEHKGTIIGKQNNTCTAKASCWLESVKSFFYGLKNMLSGIFGNVFIGVFLFFAPFILLILFFMFGWRILFCFKCCRRTRGLFKYRHLKDDEETGYRKIIERLNNKKGKNKLLDGERLADRKIAELFSTKTHIG

SEQ ID NO: 1199 - protein, 1689 aa, Artificial Sequence
  derived and/or modified protein sequence (wt) from CCHFV(8402)__AB069674.1__GP
MSFSVMYTPLLCAVLCLQLWSLEGSHGLSNKTQHSNTSTTKAPEVSQELGLPVSTVSTITSDPPSITSAVSVSGSEGSGDTNTSPSVTTQGPTLPETTLEPLTTTDTDASSTVVVDVSTQTVKDTPISTTYTSLPSTPSEPTTPQGTHHTARGLLSVTSTKPEEASTQANPGKISMETNGPRLAISETPSFSPTTQAPTENSNPITSKQLMLSAQPVTPNPMTSPVQPALSQSDTSTAIQDVHPSPTGRSKRNLEMEIILTLSQGLKKYYGKILKLLDLTLEEDTEGLLEWCKRNLGLVCDDNFFQKRIEEFFLTGKGHFNEVLQFKTPSTLSPTGPARTGSPTVEPFKSYFAKGFLSMDSGYFSAKCYPRASNSGLQLINVTQHSTRITDTPGPKITNLKTINCINLKASVFKEHREIEINVLLPQVAVNLSSCHVLIKSHVCDYSLDIDGPVRLPRIHHEGTFIPGTYKIVIDKKNKQNDRCTLVTNCVIKGREIRKGQSVLRQYRTEIKIGKASSGSRRLLSEESGDDCISRTQLLRTETAEIHNDNYGGPGDKITICNGSTVVDQRLGSELGCYTINRVKSFKLCENSATGKSCEIDSTPVKCRQGFCLKITQEGRGHVKLSRGSEVVLDACDSSCEIMIPKGTGDILVDCSGGQQHFLKDNLIDLGCPNIPLLGKMAIYICRMSNHPKTTMAFLFWFSFGYVVTCILCKVIFYLLIVVGTLGKKFKQYRELKPQTCTICETTPVNAIDAEMHDLNCSYNICPYCASRLTSDGLARHVMQCPKRKEKIEETELYLNLERIPWVVRKLLQVSESTGVALKRSSWLVVLLVLLTVSLSPVQSAPIGHGKTVETYQTREGYTSICLFVLGSILFIVSCLMKGLVDSVGNSFFPGLSICKTCSIGSVNGFEIESHKCYCSLFCCPYCRHCSADREIHRLHLSICKKRKTGSNVMLAVCKRMCFRATVEVSNKALLIRNIINTTFVLCILILAVCVVSTSAVEMESLPAGTWEREEDLTNFCHQECQVTETECLCPYEALVLRKPLFSDSIVKGMKNLLNSTSLETSLSIEAPWGAINVQSTFKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFIKWKVEYIKTEAIVCVELTSQERQCTLIEAGTRFNLGPVTITLSEPRNIQQKLPPEIVTLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHAAFVNMLNIETDYTKNFHFHSKRVTAHGDTPQLDLKARPTYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSKEDTQKCVNTKLEQPQSILIEHKGTIIGKQSNTCTAKASCWLESVKSFFYGLKNMLSGIFGNVFIGVFLFFAPFILLILFFMFGWRILFCFKCCRRTRGLFKYRHLKDDEETGYRKIIERLNNKKGKNKLLDGERLADRKIAELFSTKTHIG

SEQ ID NO: 1200 - protein, 1689 aa, Artificial Sequence
  derived and/or modified protein sequence (wt) from CCHFV(7803)__AB069672.1__GP
MPVSIMHISLMCAVLCLQLYGLGETHGSSNETEHNKTNVVTTPGDSQSPEPLVSTTLPVTLDSSTVTPTTPASEPEGSGEVYTSPPITTEGLSPSEATSELPVTTGIGISSASDVDSSTQAAGDTSTPTVRTSPPNSPSTPPTSQDTHHPMRNLLSVTSLKSEETSAPSKSGKESPAASSPHPVASRPPTHPITAQGPTENNSHNTTGQLESVTQSATLGPMASPTQTVLSQNVTSIAIQDTHPSPTNRSKRNLEMEIILTLPQGLKKYYGKVLRLLQLTLEEDTEGLLEWCKRNLGLDCDDTFFQKRIEEFFITGEGHFNEVLQFRTPGTLSTTESTHAESPTAEPFKSYFAKGFLSIDSGYFSAKCYSRTSDSGLQLINVTRHSTRIADTPGPKITNLKTISCINLKASVFKEHREVEINVLLPQVAVNLSNCHVTIKSHVCDYSLDIDGTVRLPHIHHEGTFIPGTYKIVIDKKNKLNDRCTLFTNCVIKGREVRKGQSVLRQYKTEIRIGKASTGSRRLLSEESGDDCISRTQLLRTETAEIHGDNYGGPGDKITICNGSTIVDQRLGSEMGCYTINRVKSFKLCENSATGKSCEIDSIPVKCRQGYCLKITQEGRGHVKLSRGSEVILDACDSSCEVMIPKGTGDILVDCSGGQQHFLKDNLIDLGCPSIPLLGKMAIYICRMSNHPKTTMAFLFWFSFGYVITCILCKAIFYLLIIVGTLGKRFKQYRELKPQTCTICETTPANAIDAEMHDLNCSYNICPYCASRLTSDGLARHVTQCPKRKEKVEETELYLNLERIPWVVRKLLQVSESTGVALKRSSWLIVLLVLFAISLSPVQSAPISHGKTIETYQAREEYTSICLFVLGSILFIVSCLMKGLVDSIGNIFFPGLSICKTCSIGSINGFEIESHKCYCSLLCCPYCRHCSADREIHQLHLSICKKRKTGSNVMLAACKRMCFRATMEVSNKALLIRSIINTTFVVYILILAVCVVSTSAVEMESLPAGTWEREEDLTNFCHQECQVTETECLCPYEALVLRRPLFLDSIVRGMKNPLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTTSTCLHKEWPHSRNWRCNPTWCWGVGTGCTCCGLDVKDLFTDYMIVKWKVEYIKTRGIVCVELTSQERQCSLIEAGTRFNLGSVTITLSEPRNIQQKLPPEIITLHPRIEEGFFDLMHVQKVLSASTVCKLQSCTHGVPGDLQVYHVGNLLKGDKVNGHLIHKIEPHLNTSWMSWDGCDLDYYCNMGDWPSCTYTGVTQHNHASFVNLLNIETDYTKSFHFHSKRVTAHGDTPQLDLKARPTYGAGEITVLVEVADMEFTPKKIEISGLKFASLTCTGCYACSSGISCKVRIHVDEPDELTVHVKSDDPDVVAASSSLMARKLEFGTDSTFKAFSAMPKTSLCFYIVEREYCKSCSKEDTQKCVNTKLEQPQSILIEHKGTIIGKQNNTCTAKASCWLESVKSFFYGLKNMLSGIFGNFFMGIFLFLAPFILLILFFMFGWRILFCFKCCRRTRGLFKYRHLKDDEETGYRRIIERLNNKKGKNKLLDGERLADRRIAELFSTKTHIG

SEQ ID NO: 1201 - protein, 1689 aa, Artificial Sequence
  derived and/or modified protein sequence (wt) from CCHFV(75024)__AB069671.1__GP
MPVSIMHISLMCAVLCLQLYGLGETHGSSNETEHNKTNVVTTPGDSQSPEPLVSTTLPVTLDSSTVTPTTPASGPEGSGEVYTSPPITTEGLSPSEATSELPATTGIGISSASDVDSSTQAAGDTSTPTVRTSPPNSSSTPPTSQDTHHPMRNLLSVTSLKPEETSAPSKSGKESPAASSPHPVASRPPTPPTTAQGPIENNSHNTTGQLESVTQSATLGPMASPTQTVLSQNVTSIAIQDTHPSPTNRSKRNLEMEIILTLPQGLKKYYGKVLRLLQLTLEEDTEGLLEWCKRNLGLDCDDTFFQKRIEEFFITGEGHFNEVLQFRTPGTLSTTESTHAESPTAEPFKSYFAKGFLSIDSGYFSAKCYSRTSNSGLQLINVTRHSTRIADTPGPKITNLKTISCINLKASVFKEHREVEINVLLPQVAVNLSNCHVTIKSHVCDYSLDIDGTVRLPHIHHEGTFIPGTYKIVIDKKNKLNDRCTLFTNCVIKGREVRKGQSVLRQYKTEIRIGKASTGSRRLLSEESGDDCISRTQLLRTETAEIHGDNYGGPGDKITICNGSTIVDQRLGSEMGCYTINRVKSFKLCENSATGKSCEIDSIPVKCRQGYCLKITQEGRGHVKLSRGSEVVLDACDSSCEVMIPKGTGDILVDCSGGQQHFLKDNLIDLGCPSIPLLGKMAIYICRMSNHPKTTMAFLFWFSFGYVITCILCKAIFYLLIIVGTLGKRFKQYRELKPQTCTICETTPANAIDAEMHDLNCSYNICPYCASRLTSDGLARHVTQCPKRKEKVEETELYLNLERIPWVVRKLLQVSESTGVALKRSSWLIVLLVLFAISLSPVQSAPIGHGKTIETYQAREEYTSICLFVLGSILFIVSCLMKGLVDSIGNIFFPGLSICKTCSIGSINGFEIESHKCYCSLLCCPYCRHCSADREIHQLHLSICKKRKTGSNVMLAVCKRMCFRATMEVSNKALLIRSIINTTFVVCILILAVCVVSTSAVEMESLPAGTWEREEDLTNFCHQECQVTETECLCPYEALVLRRPLFLDSIVRGMKNQLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTTSTCLHKEWPHSRNWRCNPTWCWGVGTGCTCCGLDVKDLFTDYMIVKWKVEYIKTEAIVCVELTSQERQCSLIEAGTRFNLGSVTITLSEPRNIQQKLPPEIITLHPRIEEGFFDLMHVQKVLSASTVCKLQSCTHGVPGDLQVYHVGNLLKGDKVNGHLIHKIEPHLNTSWMSWDGCDLDYYCNMGDWPSCTYTGVTQHNHASFVNLLNIETDYTKSFHFHSKRVTAHGDTPQLDLKARPTYGAGEITVLVEVADMEFTPKKIEISGLKFASLTCTGCYACSSGISCKVRIHVDEPDELTVHVKSDDPDVVAASSSLMARKLEFGTDSTFKAFSAMPKTSLCFYIVEREYCKSCSKEDTQKCVNTKLEQPQSILIEHKGTIIGKQNNTCTAKASCWLESVKSFFYGLKNMLSGIFGNLFMGIFLFLAPFILLILFFMFGWRILFCFKCCRRTRGLFKYRHLKDDEETGYRRIIERLNNKKGKNKLLDGERLADRRIAELFSTKTHIG

SEQ ID NO: 1202 - protein, 1689 aa, Artificial Sequence
  derived and/or modified protein sequence (wt) from CCHFV(66019)__AB069669.1__GP
MPANIMYTLLVCAVLCPQLWSLEGTHVPHNETKHNGTGITAAPGESQGPMSPASTAVPLTPEPPNTKPAASASELESSGEGHTSLLATTQGLTSPEATPELPTTTDTGVSSTSVVDIGTQMAKDTPTSTAHTSLPSNPSAPSTAQGTHHTIRGLLSVTSTKPEEASTPTDPGKAGAETGSPRPAISRKPTLSPTAEAPTEINNSSTPKQPEPSIQPATPSLVISPAQPAFPQSATSTAAQDIYSSPTNRSKRNLKMEIILTLSQGLKKYYGKIQKTLGLTLEEDTEGLLEWCKRNLGLTCDDNFFQKRIEEFFLTGEGYFNEVLQFKTPSTPGSTEPTHTEAPTVKPFKSYFARGFLTIDSGYFSAKCYSRTSNSGLQLINVTQHPARIADTPGPKITNLKTINCINLKASVFKEHREIEINVLLPQVAVNLSNCHVLIKSHVCDYSLDIDGTIRLPRIYHEGTFIPGTYKIVIDKRDKQNDRCTLVTNCVIKGREVRRGQSALRQYRTEIRIGKASAGSRRLLSEESGDDCISRTQLLRTETAEVHGDNYGGPGDKITICNGSTIVDQRLGSELGCYTINRVKSFKLCENSGTGKSCKIDNTPVKCRQGFCLKITQEGRGHVKLSRGSEVVLDACDSSCEIMIPKGTGDILVDCSGGQQHFLKDNLVDLGCPNIPLLGKMAIYICRMSNHPKTTMAFLFWFSFGYVITCIFCKIIFYLLIVVGTLGKKFKQYRELKPQTCTICETTPTNAIDAEMHDLKCSYNICPYCASRLTSDGLARHVTQCPKRKEKVEETELYLNLERIPWIVRKLLQVSESTGVALKRSSWLIVLLVLLTVSLSPVQSAPIGHGKTIEAYQTREGYTSVCLFMLGGILFVVSCLMKGLVDSVSNSFFPGLSICKTCSIGSVNGFEIESHKCYCSLLCCLYCRHCSADREIHQLHLSICKKRRAGGNVMLAVCKRMCLRATMEVSNKVLFIRSIINTTFVICILVLAVCIVSTSAVEMESLPAGTWEREEDLTNFCHQECQVTETECLCPYEALVLRKPLFSDSIVKGMKNLLNSTSLETSLSIEAPWGAINVQSTFKPTVSTANIALSWSSVEHRGNKILVSGRSESIMKLEERTGISWDLGVEDASESKLLTVSVMDLSQMYSPVFEYLSGDRQVEEWPKATCTGNCPDRCGCTSSTCLHKEWPHSRNWRCNPTWCWGVGTGCTCCGLDVKDLFTDYMFVKWKVEYIKTEAIVCVELNSQERQCSLIEAGTRFNLGPVTITLSEPRNIQQKLPSEIITLHPRIEEGFFDLMHVQKVLSASTVCKLQSCTHGVPGDLQIYHIGNLLKGDRVNGHLIHKIEPHFNTSWMSWDGCDLDYYCNMGDWPSCTYTGVTQHNHAAFVNLLNIETDYTKNFHFHSKRVTAHGDTPQLDLKARPTYGAGEITVLVEVADMELHTKKIAISGLKFASLTCTGCYACSSGISCKVRIHVDEPDELTVHVKSEDPDIVAASSSLMARKLEFGTDSTFKAFSAMPKTSLCFYIVEREYCESCSKEDTQKCVNTKLEQPQSILIEHKGTIIGKQNDTCTAKASCWLESVKSFFYGLKNMLSGIFGNVFIGIFLFLAPFILLILFFMFGWRILFCFKCCRRTRGLFKYRYLKDDEESGYRRIIERLNNKKGKNKLLDGERLADRRIAELFSTKTHIG

SEQ ID NO: 1203 - protein, 1689 aa, Artificial Sequence
  derived and/or modified protein sequence (wt) from CCHFV(BA8402)__AF350449.1__GP
MSFSVMYTPLLCAVLCLQLWSLEGSHGLSNKTQHSNTSTTKAPEVSQELGLPVSTVSTITSEPPSITSAVSVSGSEGSGDTNTSPSVTTQGPTLPETTLEPLTTTDTDASSTVVVDVSTQTVKDTPISTTYTSLPSTPSEPTTPQGTHHTARGLLSVTSTKPEEASPQANPGKISMETNGPRLAISETPSFSPTTQAPTENSNPITSKQLMLSAQPVTPNPMTSPVQPALSQSDTSTAIQDVHPSPTGRSKRNLEMEIILTLSQGLKKYYGKILKLLDLTLEEDTEGLLEWCKRNLGLVCDDNFFQKRIEEFFLTGKGHFNEVLQFKTPSTLSPTGPARTGSPTVEPFKSYFAKGFLSMDSGYFSAKCYPRASNSGLQLINVTQHSTRITDTPGPKITNLKTINCINLKASVFKEHREIEINVLLPQVAVNLSSCHVLIKSHVCDYSLDIDGPVRLPRIHHEGTFIPGTYKIVIDKKNKQNDRCTLVTNCVIKGREIRKGQSVLRQYRTEIKIGKASSGSRRLLSEESGDDCISRTQLLRTETAEIHNDNYGGPGDKITICNGSTVVDQRLGSELGCYTINRVNSFNLCENTATGKSCEIDSTPVKCRQGFCLKITQEGRGHVKLSRGSEVVLDACESSCEIMIPKGTGDILVDCSGGQQHFLKDNLIDLGCPNIPLLGKMAIYICRMSNHPKTTMAFLFWFSFGYVVTCILCKVIFYLLIVVGTLGKKFKQYRELKPQTCTICETTPVNAIDAEMHDLNCSYNICPYCASRPTSDGLARHVMQCPKRKEKIEETALYLNLERIPWVVRKLLQVSESTGVALKRSSWLVVLLVLLTVSLSPVQSAPIGHGKTVETYQTREGYTSICLFVLGSILFIVSCLMKGLVDSVGNSFFPGLSICKTCSIGSVNGFEIESHKCYCSLFCCPYCRHCSADREIHRLHLSICKKRKTGSNVMLAVCKRMCFRATVEVSNKALLIRNIINTTFVLCILILAVCVVSTSAVEMESLPAGTWEREEDLTNFCHQECQVTETECLCPYEALVLRKPLFSDSIVKGMKNLLNSTSLETSLSIEAPWGAINVQSTFKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFIKWKVEYIKTEAIVCVELTSQERQCTLIEAGTRFNLGPVTITLSEPRNIQQKLPPEIVTLHPRIEEGFFDLMHVQKVLSASTVCKLQSCTHGVPGDLQVYHIGNLLKGDKVNGHLIHKIEPHFNTSWMSWDGCDLHYYCNMGDWPSCTYTGVTQHNHAAFVNMLNIETDYTKNFHFHSKRVTAHGDTPQLDLKARPTYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCESCSKEDTQKCVNTKLEQPQSILIEHKGTIIGKQSNTCTAKASCWLESVKSFFYGLKNMLSGIFGNVFIGVFLFFAPFILLILFFMFGWRILFCFKCCRRTRGLFKYRHLKDDEETGYRKIIERLNNKKGKNKLLDGERLADRKIAELFSTKTHIG

SEQ ID NO: 1204 - protein, 1689 aa, Artificial Sequence
  derived and/or modified protein sequence (wt) from CCHFV(BA66019)__AF350448.1__GP
MPANIMYTLLVCAVLCPQLWSLEGTHVPHNETKHNGTGITAAPGESQGPMSPASTAVPLTPEPPNTKPAASASELESSGEGHTSLLATTQGLTSPEATPELPTTTDTGVSSTSVVDIGTQMAKDTPTSTAHTSLPSNPSAPSTAQGTHHTIRGLLSVTSTKPEEASTPTDPGKAGAETGSPRPAISRKPTLSPTAEAPTEINNSSTPKQPEPSIQPATPSLVISPAQPAFPQSATSTAAQDIYSSPTNRSKRNLKMEIILTLSQGLKKYYGKIQKTLGLTLEEDTEGLLEWCKRNLGLTCDDNFFQKRIEEFFLTGEGYFNEVLQFKTPSTPGSTEPTHAEAPTVKPFKSYFARGFLTINSGYFSAKCYSWTSNSGLQLINVTQHPARIADTPGPKITNLKTINCINLKASVFKEHREIEINVLLPQVAVNLSNCHVLIKSHVCDYSLDIDGTIRLPRIYHEGTFIPGTYKIVIDKRDKQNDRCTLVTNCVIKGREVRKGQSALRQYRTEIRIGKASAGSRRLLSEESGDDCISRTQLLRTETAEVHGDNYGGPGDKITICNGSTIVDQRLGSELGCYTINRVKSFKLCENSGTGKSCKIDKHPVKCRQGFCLKITQEGRGHVKLSRGSEVVLDACDSSCEIMIPKGTGDILVDCSGGQQHFLKDNLVDLGCPNIPLLGKMAIYICRMSNHPKTTMAFLFWFSFGYVITCIFCKIIFYLLIVVGTLGKKFKQYRELKPQTCTICETTPTNAIDAEMHDLKCSYNICPYCASRLTSDGLARHVTQCPKRKEKVEETELYLNLERIPWIVRKLLQVSESTGVALKRSSWLIVLLVLLTVSLSPVQSAPIGHGKTIEAYQTREGYTSVCLFMLGGILFVVSCLMKGLVDSVSNSFFPGLSICKTCSIGSVNGFEIESHKCYCSLLCCLYCRHCSADREIHQLHLSICKKRRAGGNVMLAVCKRMCLRATMEVSNKVLFIRSIINTTFVICILVLAVCIVSTSAVEMESLPAGTWEREEDLTNFCHQECQVTETECLCPYEALVLRKPLFSDSIVKGMKNLLNSTSLETSLSIEAPWGAINVQSTFKPTVSTANIALSWSSVEHRGNKILVSGRSESIMKLEERTGISWDLGVEDASESKLLTVSVMDLSQMYSPVFEYLSGDRQVEEWPKATCTGDCPDRCGCTSSTCLHKEWPHSRNWRCNPTWCWGVGTGCTCCGLDVKDLFTDYMFVKWKVEYIKTEAIVCVELNSQERQCSLIEAGTRFNLGPVTITLSEPRNIQQKLPPEIITLHPRIEEGFFDLMHVQKVLSASTVCKLQSCTHGVPGDLQIYHIGNLLKGDRVNGHLIHKIEPHFNTSWMSWDGCDLDYYCNMGDWPSCTYTGVTQHNHAAFVNLLNIETDYTKNFHFHSKRVTAHGDTPQLDLKARPTYGAGEITVLVEVADMELHTKKIAISGLKFASLTCTGCYACSSGISCKVRIHVDEPDELTVHVKSEDPDIVAASSSLMARKLEFGTDSTFKAFSAMPKTSLCFYIVEREYCESCSKEDTQKCVNTKLEQPQSILIEHKGTIIGKQNDTCTAKASCWLESVKSFFYGLKNMLSGIFGNVFIGIFLFLAPFILLILFFMFGWRILFCFKCCRRTRGLFKYRYLKDDEESGYRRIIERLNNKKGKNKLLDGERLADRRIAELFSTKTHIG

SEQ ID NO: 1205 - protein, 1689 aa, Artificial Sequence
  derived and/or modified protein sequence (wt) from CCHFV(BA88166)__AF338470.1__GP
MSFSVMYTPLLCAVLCLQLWSLEGSHGLSNKTQHSNTSTTKAPEVSQELGLPVSTVSTITSDPPSITSAVSVSGSEGSGDTNTSPSVTTQGPTLPETTLEPLTTTDTDASSTVVVDVSTQTVKDTPISTTYTSLPSTPSEPTTPQGTHHTARGLLSVTSTKPEEASTQANPGKISMETNSPRLAISETPSFSPTTQAPTENSNPITSKQLMLSAQPVTPNPMTSPVQPALSQSDTSTAIQDIHPSPTGRSKRNLEMEIILTLSQGLKKYYGKILKLLDLTLEEDTEGLLEWCKRNLGLVCDDNFFQKRIEEFFLTGKGHFNEVLQFKTPSTLSPTGPARTGSPTVEPFKSYFAKGFLSMDSGYFSAKCYPRASNSGLQLINVTQHSTRITDTPGPKITNLKTINCINLKASVFKEHREIEINVLLPQVAVNLSSCHVLIKSHVCDYSLDIDGPVRLPRIHHEGTFIPGTYKIVIDKKNKQNDRCTLVTNCVIKGREIRKGQSVLRQYRTEIKIGKASSGSRRLLSEESGDDCISRTQLLRTETAEIHSDNYGGPGDKITICNGSTVVDQRLGSELGCYTINRVKSFKLCENSATGKSCEIDSTPVKCRQGFCLKITQEGRGHVKLSRGSEVVLDACDSSCEIMIPKGTGDILVDCSGGQQHFLKDNLIDLGCPNIPLLGKMAIYICRMSNHPKTTMGFLFWFSFGYVVTCILCKGIFYLLIVVGTLGKKFKQYRELKPQTCTICETTPVNAIDAEMHDLNCSYNICPYCASRLTSDGLARHVMQCPKRKEKIEETELYLNLERIPWVVRKLLQVSESTGVALKRSSWLVVLLVLLTVSLSPVQSAPIGHGKTVETYQTREGYTSICLFVLGSILFIVSCLMKGLVDSVGNSFFPGLSICKTCSIGSVNGFEIESHKCYCSLFCCPYCRHCSADREIHRLHLSICKKRKTWSNVMLAVCKRMCFRATVEVSNKALLIRNIINTTFVLCILILAVCVVSTSAVEMESLPAGTWEREEDLTNFCHQECQVTETECLCPYEALVLRKPLYLDSIVKGMKNLLNSTSLETSLSIEAPWGAINVQSTFKPTMSAANIALSWSSVEHRGNKILVSGRSESIMKLEERTGISWNLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFIKWKVEYIKTEAIVCVELTSQERQCTLIEAGTRFNLGPVIITLSEPRNIQQKLPPEIVTLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHAAFVNMLNIETDYTKNFHFHSKRVTAHGDTPQLDLKARPTYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSKEDTQKCVNTKLEQPQSILIEHKGTIIGKQNNTCTAKASCWLESVKSFFYGLKNMLSGIFGNVFIGVFLFFAPFILLILFFMFGWRILFCFKCCRRTRGLFKYRHLKDDEETGYRKIIERLNNKKGKNKLLDGERLADRKIAELFSTKTHIG

SEQ ID NO: 1206 - protein, 1689 aa, Artificial Sequence
  derived and/or modified protein sequence (wt) from CCHFV(UCCR4459)__KY484032.1__GP
MSFSIMYTPLLCAVLCLQLWSLEGSHGLSNKTQHSNTSTTKAPEVSQEFGLPVSTVSTITSDPPSITSAVSVSGSEGSGDTNTSPSVTTQGLTLPETTLELLTTTDTDASSTVVVDVSTQTVKDTPISTTHTSLPSTPSATTTPQGTHHTARGLLSVTSTKPEGASTQANPEKISMETNSPRLAISETPSFSPTTQAPTENSNPITSKQLIFSAQPVTPNPVTPPVQPALSQSDTSTAIQDIHPSPTSRSKRNLEMEIILTLSQGLKKYYGKILKLLDLTLEEDTEGLLEWCKRNLGLVCDDDFFQKRIEEFFLTGEGHFNEVLQFKTPSTLSPTGPARTGSPTVEPFKSYFAKGFLSMDSGYFSAKCYPRASNSGLQLINVTQHSTRITDTPGPKVTNLKTINCINLKASVFKEHREIEINVLLPQVAVNLSSCHVLIKSHVCDYSLDIDGPVRLPRIHHEGTFIPGTYKLVIDKKNKQNDRCTLITNCVIKGREIRKGQSVLRQYRTEIKIGKASSGSRRLLSEESGDDCISRTQLSRTETAEIHSDNYGGPGDKITICNGSTIVDQRLGSELGCYTINRVKSFKLCENSATGKSCEIDSTPIKCRQGFCLKITQEGRGHVKLSRGSEVVLDACDSSCEIMIPKGTGDILVDCSGGQQHFLKDNLIDLGCPNIPLLGKMAIYICRMSNHPKTTMAFLFWFSFGYVITCILCKVIFYLLIVVGTLGKKFKQYRELKPQTCTICETTPVNAIDAEMHDLNCSYNICPYCASRLTSDGLARHVMQCPKRKEKVEETELYLNLERIPWVVRKLLQVSESTGVALKRSSWLVVLLVLLTVSLSPVQSAPIGHGKTVETYQTREGYTSICLFVLGSILFIVSCLMKGLVDSVGNSFFPGLSICKTCSIGSINGFEIESHKCYCSLFCCPYCRHCSADREIHKLHLSICKKRKTGSNVMLAVCKRMCFRATVEVSNKALLIRNIINTTFVVCILILAVCVVSTSAVEMESLPAGTWEREEDLTNFCHQECQVTETECLCPYEALVLRKPLFSDSIVKGMKNLLNSTSLETSLSIEAPWGAINVQSTFKPTVSAANIALSWSSVEHRGNKILVSGRSESIMKLEERTGISWDLGVEDASESKLLTVSIMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIVTLHPRIEEGFFDLMHVKKVLSASTVCKLQSCTHGVPGDLQVYHIGNLLKGDKVNGHLIHKIEPHFNTSWMSWDGCDLDYYCNMGDWPSCSYTGVTQHNHAAFVNMLNIETDYTKIFHFHSKRVTAHGDTPQLDLKARPTYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSKEDTQKCVNTKLEQPQSILIEHKGTIIGKQNDTCTSKAGCWLESVKSFFYGLKNMLSGIFGNVFIGIFLFLAPFILLILFFMFGWRILFCFKCCRRTRGLFKYRHLKDDEETGYRKIIERLNNKKGKNKLLDGERLADRKIAELFSTKTHIG

SEQ ID NO: 1207 - protein, 1689 aa, Artificial Sequence
  derived and/or modified protein sequence (wt) from CCHFV(K168_125)__KX013460.1__GP
MPISTMHISLMCAVLCLQLYGLGGTHGLHNGTEHNKTNAVTTSSNSQSSESPARTAPPVTPDSPTVTPTTPASAPEGSGEAHSSPPNNTEGPSLPESTSEPPAATSTGIPSASDVNSSTQAARDTSTPTVRTSPPNSPSTPPTPQETHHPVRNLLSVTSHKPEETSAPSESGKESPAANSPHPVASRPPTPSTTAQGPTENNNYNTTGQLESLTQSTTLGPMTSLTQTDLPQSVTSIAVQDTHPSPTNRSKRNLEMEIILTLPQGLKKYYGKVLRLLQLTLEEDTEGLLEWCKRNLGLDCDDTFFQKRIEEFFITGEGHFNEVLQFRTPGTLSTTESTHAGLPTAEPFKSYFAKGFLSIDSGYFSAKCYSRTSNSGLQLINVTRHSTRIADTPGLKITNLKTISCINLKASVFKEHREVEINVLLPQVAVNLSNCHVTIKSHVCDYSLDIDGTVRLPHIHHDGTFIPGTYKIVIDRKNKLNDRCTLFTNCVIKGREVRKGQSVLRQYKTEIRIGKASTGSRRLLSDESGDDCISRTQLLRTETAEIHGDNYGGPGDKITICNGSTIVDQRLGSELGCYTINRVKSFKLCENSATGKSCEVDSIPVKCRQGYCLKITQEGRGHVKLSRGSEVVLDACDSSCEVMIPKGTGDILVDCSGGQQHFLKDNLIDLGCPKVPLLGKMAIYICRMSNHPKTTMAFLFWFSFGYVITCIVCKAIFYLLIIVGTLGKRFKQYRELKPQTCTICETTPTNAIDAEMHDLNCSYNICPYCASRLTSDGLARHVTHCPKRKEKVEETELYLNLERIPWVVRKLLQVSESTGVALKRSSWLIVLLVLFAVSLSPVQSAPIGHGKTIETYQVREEYTSICLFVLGSILFIVSCLMKGLVNSVGNIFFPGLSICKTCSIGSINGFEIESHKCYCSLLCCPYCRHCSADREIHQLHLSICKKRKTGSNVMLAVCKRMCFRATVEVSNKALSIRSIINTTFVVCILILAVCVVSTSAVEMESLPAGTWEREEDLTNFCHQECQVTETECLCPYEALVLRRPLFLDSIVKGKKNLLNSTSLETSLSIEAPWGAINVQSTYKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFINLLNIETDYTKSFHFHSKRVTAHGDTPQLDLKARPNYGAGEITVLVEVADMELHTKKIEISGLKFASLTCTGCYACSSGISCKVRIHVDEPDELTVHVKSDDPDVVAASSSLMARKLEFGTDSTFKAFSAMPKTSLCFYIVEREYCKSCSKEDTQKCVNTKLEHPQSILIEHKGTIIGKQNNTCTAKTSCWLESVKSFFYGLKNMLSGIFGNVFVGIFLFLAPFILLILFFMFGWRILFCFKCCRRTRGLFRYKHLEDDEETGYRRIIERLNNKKGKNKLLDGERLADRRIAELFSTKTHIG

SEQ ID NO: 1208 - protein, 1689 aa, Artificial Sequence
  derived and/or modified protein sequence (wt) from CCHFV(K168_40)__KX013457.1__GP
MPISTMHISLMCAVLCLQLYGLGGTHGLHNGTEHNKTNAVTTSSNSQSSESPARTAPPVTPDSPTVTPTTPASAPEGSGEAHSSPPNNTEGPSLPESTSEPPAATSTGIPSASDVNSSTQAARDTSTPTVRTSPPNSPSTPPTPQETHHPVRNLLSVTSHKPEETSAPSESGKESPAANSPHPVASRPPTPSTTAQGPTENNNYNTTGQLESLTQSTTLGPMTSLTQTDLPQSVTSIAVQDTHPSPTNRSKRNLEMEIILTLPQGLKKYYGKVLRLLQLTLEEDTEGLLEWCKRNLGLDCDDTFFQKRIEEFFITGEGHFNEVLQFRTPGTLSTTESTHAGLPTAEPFKSYFAKGFLSIDSGYFSAKCYSRTSNSGLQLINVTRHSTRIADTPGPKITNLKTISCINLKASVFKEHREVEINVLLPQVAVNLSNCHVTIKSHVCDYSLDIDGTVRLPHIHHDGTFIPGTYKIVIDRKNKLNDRCTLFTNCVIKGREVRKGQSVLRQYKTEIRIGKASTGSRRLLSDESGDDCISRTQLLRTETAEIHGDNYGGPGDKITICNGSTIVDQRLGSELGCYTINRVKSFKLCENSATGKSCEVDSIPVKCRQGYCLKITQEGRGHVKLSRGSEVVLDACDSSCEVMIPKGTGDILVDCSGGQQHFLKDNLIDLGCPKIPLLGKMAIYICRMSNHPKTTMAFLFWFSFGYVITCIVCKAIFYLLIIVGTLGKRFKQYRELKPQTCTICETTPTNAIDAEMHDLNCSYNICPYCASRLTSDGLARHVTHCPKRKEKVEETELYLNLERIPWVVRKLLQVSESTGVALKRSSWLIVLLVLFAVSLSPVQSAPIGHGKTIETYQVREEYTSICLFVLGSILFIVSCLMKGLVNSVGNIFFPGLSICKTCSIGSINGFEIESHKCYCSLLCCPYCRHCSADREIHQLHLSICKKRKTGSNVMLAVCKRMCFRATVEVSNKALSIRSIINTTFVVCILILAVCVVSTSAVEMESLPAGTWEREEDLTNFCHQECQVTETECLCPYEALVLRRPLFLDGIVKGMKNLLNSTSLETSLSIEAPWGAINVQSTYKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFINLLNIETDYTKSFHFHSKRVTAHGDTPQLDLKARPNYGAGEITVLVEVADMELHTKKIEISGLKFASLTCTGCYACSSGISCKVRIHVDEPDELTVHVKSDDPDVVAASSSLMARKLEFGTDSTFKAFSAMPKTSLCFYIVEREYCKSCSKEDTQKCVNTKLEHPQSILIEHKGTIIGKQNNTCTAKTSCWLESVKSFFYGLKNMLSGIFGNVFVGIFLFLAPFILLILFFMFGWRILFCFKCCRRTRGLFRYKHLEDDEETGYRRIIERLNNKKGKNKLLDGERLADRRIAELFSTKTHIG

SEQ ID NO: 1209 - protein, 1689 aa, Artificial Sequence
  derived and/or modified protein sequence (wt) from CCHFV(K128_76)__KX013454.1__GP
MPISVMHISLMCAVLCLQLYGLGGTHGSHNETEHNKTNAVTTSSDSQSPEPPTRTTLPVTPDSPTVTPTTPASAPEGSGEVHTSPPNTTEGPSLPESTPEPPTATSTGIPSASDVNSSTQAARDTSTPTVHTSPPNSPSTPPTLQETHHPMRNLLSVTSHKPEETSAPSESGKESPAANSPHPVADRPSTSSTTAQGPTENNSYNTTEQLESLTQSTTLGPMTSLTQTVLSQSVTSIAVQDTHLSPTNRSKRNLEMEIILTLPQGLKKYYGKVLRLLQLTLEEDTEGLLEWCKRNLDLDCDDTFFQKRIEEFFITGEGYFNEVLQFRTPGTLSTTESTHAGLPTAEPFKSYFAKGFLSIDSGYFSAKCYSRTSNSGLQLINVTRHSTRIADTPGPKITNLKTISCINLKASVFKEHREVEINVLLPQVAVNLSNCHVTIKSHVCDYSLDIDGTVKLPHIHHDGTFIPGTYKIVIDRKNKLNDRCTLFTNCVIKGREVRKGQSVLRQYKTEIRIGKASTGSRRLLSDESGDDCISRTQLLRTETAEIHGDNYGGPGDKITICNGSTIVDQRLGSELGCYTINRVKSFKLCENSATGKSCEIDSIPVKCRQGYCLKITQEGRGHVKLSRGSEVVLDACDSSCEVMIPKGTGDILVDCSGGQQHFLKDNLIDLGCPKIPLLGKMAIYICRMSNHPKTTMAFLFWFSFGYVITCIVCKAIFYLLIIVGTLGKRFKQYRELKPQTCTICETTPTNAIDAEMHDLNCSYNICPYCASRLTSDGLARHVTHCPKRKEKVEETELYLNLERIPWVVRKLLQVSESTGVALKRSSWLIVLLVLFAVSLSPVQSAPISHGKTIETYQVREEYTSICLFVLGSILFIVSCLMKGLVNSVGNIFFPGLSICKTCSIGSINGFEIESHKCYCSLLCCPYCRHCSADREIHQLHLSICKKRKTGSNVMLAVCKRMCFRATMEVSNKALFIRSIINTTFVVCILILAVCVVSTSAVEMESLPAGTWEREEDLTNFCHQECQVTETECLCPYEALVLRRPLFQDSIVKGMKNLLNSTSLETSLSIEAPWGAINVQSTYKPAVSAANIALSWSSVEHRGSKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDRVNGHLIHKIEPHFNTSWMSWDGCDLDYYCNMGDWPSCTYTGVTQHNHASFVNLLNIETDYTKSFHFHSKRVTAHGDTPQLDLKARPNYGAGEITVLVEVADMELHTKKIEISGLKFASLTCTGCYACSSGISCKVRIHVDEPDELTVHVKSDDPDVVAASSSLMARKLEFGTDSTFKAFSAMPKTSLCFYIVEREYCKSCSKEDTQKCVNTKLEQPQSILIEHKGTIIGKQNNTCTAKTSCWLESVKSFFYGLKNMLSGIFGNVFVGIFLFLAPFILLILFFMFGWRILFCFKCCRRTRGLFRYKHLENDEETGYRRIIERLNNKKGKNKLLDGERLADRRIAELFSTKTHIG

SEQ ID NO: 1210 - protein, 1689 aa, Artificial Sequence
  derived and/or modified protein sequence (wt) from CCHFV(Hodzha)__KX013448.1__GP
MPVSIMHILLMCAVLCLQQYGLGETHRPNNGTEHNKTNVLTTPSDKLSPEPPVSTALSVTPDSSTVTPTTPVSGLEGSGEVYTSPPVTTKGLSPSKATSELPATTGIDTSSASDVDSSTQAARDTSTLTVRTSPPSSPSTPPTSQDTYHLVRNLLSVTSPRPEETTAPSKSGKESPVANSPHPVTSRPSSPPITVQGPTENSSHNTTGQLESMAQSTTLVPMASPTQTVLSQSVTSLAVQDAHPSPTNRSKRNLEMEIILTLPQGLKKYYGKVLRLLQLTLEEDTEGLLEWCKRNLGLDCDDTFFQKRIEEFFITGEGHFNEVLQFKTPSTLSTTESTHAVSPTAEPFKSYFAKGFLSIDSGYFSAKCYSKTSNSGLQLINVTRHSTRIADTPGPKITNLKTISCINLKASVFKEHREVEINVLLPQVAVNLSNCHVTIKSHVCDYSLDVDGTVRLPHIHHGGTFIPGTYKIVIDKKNKLNDRCTLYTNCVIKGREVRKGQSILRQYKTEIRIGKASTGSRRLLSEESGDDCISRTQLLRTETAEIHGDDYGGPGDKITICNGSTIVDQRLGSELGCYTINRVKSFKLCENSATGKSCEIDSTPVKCRQGYCLKITQEGRGHVKLSRGSEVVLDACDSSCEVMIPKGTGDILVDCSGGQQHFLKDNLIDLGCPRIPLLGKMAIYICRMSNHPETTMAFLFWFSFGYVITCILCKAIFYLLIIVGTLGKRFKQYRELKPQTCTICETTPANAIDAEMHDLNCSYNICPYCASRLTSDGLARHVTQCPKRKEKVEETELYLNLERIPWIVRKLLQVSESTGVALKRSSWLIVLLVLFAVSLSPVQSAPIGHGKTIETYQAREEYTSICLFVLGSILFIVSCLMKGLVDSIGNIFFPGLTICKTCSIGSINGFEIESHKCYCSLLCCPYCRHCPADREIHQLHLSICKKRKTGSNVMLAVCKRMCFRATMEVSNKALLIRSIINTTFVVCILILAVCVVSTSAVEMESLPAGTWEREEDLTNFCHQECQVTETECLCPYEALVLRRPLFLDSIVKGKKNLLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCSERCGCTSSTCLHKEWPHSRNWRCNPTWCWGVGTGCTCCGLDVKDLFTDYMFVKWKVDYIKTEAIVCVELTSQERQCSLVEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFVNLLNIETDYTKSFHFHSKRVTAHGDTPQLDLKARPTYGAGEITVLVEVADMELHTKKIEITGLKFASLTCTGCYACSSGISCKVRIHVDEPDELTVHVKSDDPDVVAASSSLMARKLEFGTDSTFKAFSAMPKTSLCFYIVEREYCKSCSKEDTQKCVNTKLEQPQSILIEQKGTIIGKQNNTCTAKASCWLESVKSFFYGLKNMLSGIFGNVFVGIFLFLAPFILLILFFMFGWRILFCFKCCRRTRGLFKYKHLKDDEETGYRRIIERLNNKKGKNKLLDGERLADRRIAELFSTKTHIG

SEQ ID NO: 1211 - protein, 1689 aa, Artificial Sequence
  derived and/or modified protein sequence (wt) from CCHFV(Hy13)__AY900145.1__GP
MSFSIMYTPLLCAVLCLQLWSLEGSHGLSNKTQHSNTSTTKAPEVSQEFGLPVSTVSTITSDPPSITSAVSVSGSEGSGDTNTSPSVTTQGLTLPETTLELLTTTDTDASSTVVVDVSTQTVKDTPISTTHTSLPSTPSATTTPQGTHHTARGLLSVTSTKPEGASTQANPEKISMETNSPRLAISETPSFSPTTQAPTENSNPITSKQLIFSAQPVTPNPVTPPVQPALSQSDTSTAIQDIHPSPTSRSKRNLEMEIILTLSQGLKKYYGKILKLLDLTLEEDTEGLLEWCKRNLGLVCDADFFQKRIEEFFLTGEGHFNEVLQFKTPSTLSPTGPARTGSPTVEPFKSYFAKGFLSMDSGYFSAKCYPRASNSGLQLINVTQHSTRITDTPGPKVTNLKTINCINLKASVFKEHREIEINVLLPQVAVNLSSCHVLIKSHVCDYSLDIDGPVRLPRIHHEGTFIPGTYKLVIDKKNKQNDRCTLITNCVIKGREIRKGQSVLRQYRTEIKIGKASSGSRRLLSEESGDDCISRTQLSRTETAEIHSDNYGGPGDKITICNGSTIVDQRLGSELGCYTINRVKSFKLCENSATGKSCEIDSTPIKCRQGFCLKITQEGRGHVKLSRGSEVVLDACDSSCEIMIPKGTGDILVDCSGGQQHFLKDNLIDLGCPNIPLLGKMAIYICRMSNHPKTTMAFLFWFSFGYVITCILCKVIFYLLIVVGTLGKKFKQYRELKPQTCTICETTPVNAIDAEMHDLNCSYNICPYCASRLTSDGLARHVMQCPKRKEKVEETELYLNLERIPWVVRKLLQVSESTGVALKRSSWLVVLLVLLTVSLSPVQSAPIGHGKTVETYQTREGYTSICLFVLGSILFIVSCLMKGLVDSVGNSFFPGSSICKTCSIGSINGFEIESHKCYCSLFCCPYCRHCSADREIHKLHLSICKKRKTGSNVMLAVCKRMCFRATVEVSNKALLIRNIINTTFVVCILILAVCVVSTSAVEMESLPAGTWEREEDLTNFCHQECQATETECLCPYEALVLRKPLFSDSIVKGMKNLLNSTSLETSLSIEAPWGAINVQSTFKPTVSAANIALSWSSVEHRGNKILVSGRSESIMKLEERTGISWDLGVEDASESKLLTVSIMDLSQMYSPVFEYLSGDRQVEEWPKATCTGDCPERCGCTSSTCLHKEWPHSRNWRCNPTWCWGVGTGCTCCGLDVKDLFTDHMFVKWKVEYIKTEAIVCVELTSQERQCSLIEAGTRFNLGPVTITLSEPRNIQQKLPPEIVTLHPRIEEGFFDLMHVKKVLSASTVCKLQSCTHGVPGDLQVYHIGNLLKGDKVNGHLIHKIEPHFNTSWMSWDGCDLDYYCNMGDWPSCSYTGVTQHNHAAFVNMLNIETDYTKIFHFHSKRVTAHGDTPQLDLKARPTYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSKEDTQKCVNTKLEQPQSILIEHKGTIIGKQNDTCTSKAGCWLESVKSFFYGLKNMLSGIFGNVFIGIFLFLAPFILLILFFMFGWRILFCFKCCRRTRGLFKYRHLKDDEETGYRKIIERLNNKKGKNKLLDGERLADRKIAELFSTKTHIG

SEQ ID NO: 1212 - protein, 1689 aa, Artificial Sequence
  derived and/or modified protein sequence (wt) from CCHFV(SPU415/85)__DQ211635.1__GP
MPVNIMYTPLVCAVICLQLWNLGGTLVFINRTQHNETGTVATPEGTLRPRLPVSTALPTKSDRPSVGPAASSSGLEGSGEPNTSPSITTKGLTPPETTPALPTATDTDASSTGVVDVSTQMTKDIPMSTAYTNPPSTPSAPSTPQGTHHTARGLLSVASTKSEEVSMSTSPAKTSTETSSPPPATSETPTPSPTTQVPTGNNNPNTSRQPTPSAQPAMSNPATSPAQPNLSQSAPPTADQGVHPSPTNRSKRNLEIEIILTLSQGLRKYYGKILKLLDLTLEEDTEGLLEWCKRNLGLTCDDNFFQKRIEEFFLTGEGYFNEVLQFKVPSTLSSTEPTHTRPPTVEPFKSYFAKGFLSMNSGYFSAKCYPRTSNSGLQLINVTKHSAKIADTPGPKITNLKTINCINLRASVFKEHREVEINVLLPQVAVNLSNCHAQIKSHVCDYSLATDGMVRLPHIHHEGTFIPGTYKIVIDKKNKQNDRCTLVTNCVIKGREVRKGQSALRQYKTEIRIGKASSGSRRLLSEESDGDCISRTQLLRTETTEIHSDNYGGPGDKITICNGSTIVDQRLGSELGCYTINRVKSFKLCENSATGKSCEIDSTPVKCRQGFCLKITQEGRGHVKLSRGSEIVLDACDSNCEIMIPKGTGDILVDCSGGQQHFLKDNLIDLGCPNIPLLGKMAIYICRMSNHPKTTMAFLFWFSFGYVITCILCKVIFYLLIVAGTVGKKFKQYRELRPQTCTICETIPVNAIDAEMHDLNCSYNICPYCASRLTSDGLARHVMQCPKRKEKVEETELYLNLERIPWVVRKLLQVSESTGVALKRSSWLTVLLVLLIVSLSPVQSAPIGHGKTIETYQAREGYTSFCLFILGSILFVVSCLVKGLIDSVGNSFFPGLSICKTCSIGSINGFEIESHKCYCSLFCCPYCRHCSADREIHKLHLSICKKRKTGSNVMLAVCKRMCFRATIEVSNRALLIRNIINTTFVVCILTLAVCVVSTSAVEMESLPAGTWEKEEDLTNFCHQECQVTETECLCPYEALVLRKPLFLDSIVKGMKNLLNSTSLETSLSIEAPWGAINVQSTFKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQRVLSASTVCKLQSCTHGVPGDLQVYHIGNLLKGDKVNGHLIHKIEPHFNTSWMSWDGCDLDYYCNMGDWPSCTYTGVTQHNHAAFVNLLNIETDYTKNFHFHSKRVTAHGDTPQLDLKARPTYGAGEVTVLVEVADMELHTKKIEISGLKFASLTCTGCYACSSGISCKVKIHVDEPDELTVHVKSEDPDIVAAGSSLMARKLEFGADSTFKAFSAMPKTSLCFYIVEREYCKSCSREDTRKCVNTKLDRPQSILIEHKGTIIGKQNNTCTAKASCWLESVKSFFYGLKNMLSGIFGNVFIGIFLFIAPFVLLILFFMFGWRILFCFKCCRRTRGLFKYRHLKDDEETGYRKIIERLNNKKGKNKLLDGERLADRKIAELFSTKSHIG

SEQ ID NO: 1213 - protein, 1689 aa, Artificial Sequence
  derived and/or modified protein sequence (wt) from CCHFV(SPU97/85)__DQ211633.1__GP
MTVNTVCTPLVCAVFCLQLWNLGGTLVPTNRTQHNKTGTMATPEGTLGPRLPVSTALPTKSDRPSVGPAAPSSGLEGSGEPNTSPSITTKGLALPETTPAPPTATDTDASSTGVVNVSTQMTKDIPMSTAYTNPPSTPSAPSTPQGTHHTARGLLSVASTKSEEVSMSTSPGKTSTETSSPPPATSETPAPSPTTQAPTGNNNPNTSRQPTPSAQPAMSNPTTSPAQPNLLQNAPPTADQGVHPGPTNRSKRNLEMEIILTLSQGLRKYYGKILKFLDLTLEEDTEGLLEWCKRNLGLTCDDNFFQKRIEEFFLTGEGYFNEVLQFKVPSTLSSTEPTHTGSPTVEPFKSYFAKGFLSMNSGYFSAKCYPRTSNSGLQLINVTKHSAKIADTPGPKITNLKTINCINLRASVFKEHREVEINVLLPQVAVNLSNCHAQIKSHVCDYSLATDGMVRLPRIHHEGTFIPGTYKIVIDKKNKQNDRCTLVTNCVIKGREVRKGQSALRQYKTEIRIGKASSGSRRLLSEESDGDCISRTQLLRTETAEIHSDNYGGPGDKITICNGSTIVDQRLGSELGCYTINRVKSFKLCENSATGKSCEIDSTPVKCRQGFCLKITQEGRGHVKLSRGSEIVLDACDSSCEIMIPKGTGDILVDCSGGQQHFLKDNLIDLGCPNIPLLGRMAIYICRMSNHPKTTMAFLFWFSFGYVITCILCKVIFYLLIVAGTVGKKFKQYRELRPQTCTICETTPVNAIDAEMHDLNCSYNICPYCASRLTSDGLARHVMQCPKRKEKIEETELYLNLERIPWVVRKLLQVSESTGVALKRSSWLTVLLVLLIVSLSPVQSAPIGHGKTIETYQAREGYTSFCLFILGSILFIVSCLVKGLIDSVGNSFFPGLSICKTCSIGSVNGFEIESHKCYCSLFCCPYCRHCSADREIHKLHLSICKKRKTGSNVMLAVCKRMCFRATIEVSNRALLIRSIINTTFAVCILTLAVCVVSTSAVEMESLPAGTWEREEDLTNFCHQECQVTETECLCPYEALVLRKPLFLDSIVKGKKNLLNSTSLETSLSIEAPWGAINVQSTFKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHAAFVNLLNIETDYTKNFHFHSKRVTAHGDTPQLDLKARPTYGAGEVTVLVEVADMELHTKKIEISGLKFASLSCTGCYACSSGISCKVRIHVDEPDELTVHVKSEDPDIVAAGSSLMARKLEFGADSTFKAFSAMPKTSLCFYIVEREYCKSCSREDTQKCVNTKLERPQSILIEHKGTIIGKQNDTCTAKASCWLESVKSFFYGLKSMLSGIFGNVFIGIFLFIAPFVLLILFFMFGWRILFCFKCCRRTRGLFKYRHLKDDEETGYRKIIERLNNKKGKNKLLDGERLADRKIAELFSTKSHIG

SEQ ID NO: 1214 - protein, 1689 aa, Artificial Sequence
  derived and/or modified protein sequence (wt) from CCHFV(C-68031)__DQ211629.1__GP
MSFSIMYTPLLCAVLCLQLWSLEGSHGLSNKTQHSNTSTTKAPEVSQEFGLPVSTVSTITSDPPSITSAVSVSGSEGSGDTNTSPSVTTQGLTLPETTLELLTTTDTDASSTVVVDVSTQTVKDTPISTTHTSLPSTPSAPTTPQGTHHTARGLLSVTSTKPEGASTQANPEKISMETNSPRLAISETPSFSPTTQAPTENSNPITSKQLILSAQPVTPNPVTPPVQPALSQSDTSTAIQDIHPSPTSRSKRNLEMEIILTLSQGLKKYYGKILKLLDLTLEEDTEGLLEWCKRNLGLVCDDDFFQKRIEEFFLTGEGHFNEVLQFKTPSTLSPTGPARTGSPTVEPFKSYFAKGFLSMDSGYFSAKCYPRASNSGLQLINVTQHSTRITDTPGPKVTNLKTINCINLKASVFKEHREIEINVLLPQVAVNLSSCHVLIKSHVCDYSLDIDGPVRLPRIHHEGTFIPGTYKLVIDKKNKQNDRCTLITNCVIKGREIRKGQSVLRQYRTEIKIGKASSGSRRLLSEESGDDCISRTQLSRTETAEIHSDNYGGPGDKITICNGSTIVDQRLGSELGCYTINRVKSFKLCENSATGKSCEIDSTPIKCRQGFCLKITQEGRGHVKLSRGSEVVLDACDSSCEIMIPKGTGDILVDCSGGQQHFLKDNLIDLGCPNIPLLGKMAIYICRMSNHPKTTMAFLFWFSFGYVITCILCKVIFYLLIVVGTLGKKFKQYRELKPQTCTICETTPVNAIDAEMHDLNCSYNICPYCASRLTSDGLARHVMQCPKRKEKVEETELYLNLERIPWVVRKLLQVSESTGVALKRSSWLVVLLVLLTVSLSPVQSAPIGHGKTVETYQTREGYTSICLFVLGSILFIVSCLMKGLVDSVGNSFFPGLSICKTCSIGSINGFETESHKCYCSLFCCPYCRHCSADREIHKLHLSICKKRKTGSNVMLAVCKRMCFRATVEVSNKALLIRNIINTTFVVCILILAVCVVSTSAVEMESLPAGTWEREEDLTNFCHQECQVTETECLCPYEALVLRKPLFSDSIVKGMKNLLNSTSLETSLSIEAPWGAINVQSTFKPTVSAANIALSWSSVEHRGNKILVSGRSESIMKLEERTGISWDLGVEDASESKLLTVSIMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIVTLHPRIEEGFFDLMHVKKVLSASTVCKLQSCTHGVPGDLQVYHIGNLLKGDKVNGHLIHKIEPHFNTSWMSWDGCDLDYYCNMGDWPSCSYTGVTQHNHAAFVNMLNIETDYTKIFHFHSKRVTAHGDTPQLDLKARPTYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSKEDTQKCVNTKLEQPQSILIEHKGTIIGKQNDTCTSKAGCWLESVKSFFYGLKNMLSGIFGNVFIGIFLFLAPFILLILFFMFGWRILFCFKCCRRTRGLFKYRHLKDDEETGYRKIIERLNNKKGKNKLLDGERLADRKIAELFSTKTHIG

SEQ ID NO: 1215 - protein, 1689 aa, Artificial Sequence
  derived and/or modified protein sequence (wt) from CCHFV(Baghdad 12)__AJ538197.2__GP
MPVSIMHISLIYAVLCLQLYGLGETHGSSSGTEHNRTNVVATPGGSQSPEPLVSTTLPVTLDSSTVTPATQASGPEGSGEVYTSPPTTTEGLSPSDATSELPTTTGIGISSSSDVNSSTQAAGDTSTPTARTSLPDSPSTPPTSQDTHHPMRNLLSVTSLKPEETPAPSKSGKESPAASSPHPVASRPPTPSTTAQGPTENNSRNTTVQLKSVTQSATLGPMASPTQTVLLQSVTSIAIQDTHPSPTNRSRRNLEMEIILTLPQGLKKYYGKVLRLLQLTLEEDTEGLLEWCKRNLGLDCDDTFFQKRIEEFFITGEGHFNEVLQFRTPGTLSTTESTHAGSPTVEPFKSYFAKGFLLIDSGYFSAKCYSRTSNSGLQLINVTRHSTKIADTPGPKITNLKTISCINLKASIFKEHREIEINVLLPQVAVNLSNCHVTIKSHVCDYSLNIDGTVKLPHIHHEGIFIPGTYKIVIDKKNKLNDRCTLFTNCVIKGREVRKGQSVLRQYKTEIRIGKASTGSRRLLSEESGDDCISRTRLLRTETAEIHGDSYGGPGDKITICNGSTIVDQRLGSEMGCYTINRVKSFKLCENSATGKSCKIDSIPVKCRQGYCLKITQEGRGHVKLSRGSEVVLDACDSSCEVMIPKGTGDILVDCSGGQQHFLKDNLIDLGCPNIPLLGKMAIYICRMSNHPKTTMAFLFWFSFGYVITCILCKAIFYLLIIVGTLGKRFKQYRELKPQTCTICETTPVNAIDAEMHDLNCSYNICPYCASRLTSDGLARHVTQCPKRKEKVEETELYLNLERIPWVVRKLLQVSESTGVALKRSSWLIVLLVLLAVSSSPVQSAPIGYGKTIETYQAREGYTSICLFVLGSILFIVSCLTKGLVDSIGNIFFPGLSICKTCSIGSINGFEVESHKCYCSLLCCPYCRHCSADREIHQLHLSICKKRKTGSSVMLAVCKRMCFRATMEVSNKALLIRSIINTTFVVCILTLAVCVVSTSAVEMESLPAGTWEREEDLTNFCHQECQVTETECLCPYEALVLRKPLFLDSIVKGTKNLLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTTSTCLHKEWPHSRNWRCNPTWCWGVGTGCTCCGLDVKDLFTDYMFVKWKVEYIKTDAIVCVELTSQERQCSLIEAGTRFNLGSVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFVNLLNIETDYTKSFHFHSKRVTAHGDTPQLDLKVRPTYGAGEITVLVEVADMELHTKKIEISGLKFASLTCTGCYACSSGISCKVRIHVDEPDELTVHVKSDDPDVVAASSSLMARKLEFGTDSTFKAFSAMPKTSLCFYIVEREYCKSCSKEDTQKCVNTKLEQPQSILIEHKGTIIGKQNNTCTAKTSCWLESVKSFFYGLKNMLSGIFGNFFMGIFLFLAPFILLILFFMFGWRILFCFKCCRRTRGLFKYRHLKDDEETGYRRIIERLNNKKGKNKLLDGERLADRRIAELFSTKTHIG

SEQ ID NO: 1216 - protein, 1689 aa, Artificial Sequence
  derived and/or modified protein sequence (wt) from CCHFV(Hodzha)__AY223476.1__GP
MPVSIMHILLMCAVLCLQQYGLGETHRPNNGTEHNKTNVLTTPGDKLSPELPVSTALSVTPDSSTVTPTTPVSGLEGSGDVYTSPPVTTKGLSPSKATSELPASSGIDTSSASDVDSSTQAARDTSTLTVRTSPPSSPSTPPTSQDTYHLVRNLLSVTSPWPEETTAPSKSGKESPVANSPHPVTSRPSSPPITVQGPTENSSHNTTGQLESMAQSTTLVPMASPTQTVLSQSVTSLAVQDAHPSPTNRSKRNLEMVIILTLPQGLKKYYGKVLRLLQLTLEEDTEGLLEWCKRNLGLDCDDTFFQKRIEEFFITGEGHFNEVLQFKTPSTLSTTESTHAVSPTAEPFKSYFAKGFLSIDSGYFSAKCYSKTSNSGLQLINVTRHSTRIADTPGPKITNLKTISCINLKASVFKEHREVEINVLLPQVAVNLSNCHVTIKSHVCDYSLDVDGTVRLPHIHHGGTFIPGTYKIVIDKKNKLNDRCTLYTNCVIKGREVRKGQSILRQYKTEIRIGKASTGSRRLLSEESGDDCISRTQLLRTETAEIHGDDYGGPGDKITICNGSTIVDQRLGSELGCYTINRVKSFKLCKNSATGKSCEIDSTPVKCRQGYCLKITQEGRGHVKLSRGSEVVLDACDSSCEVMIPKGTGDILVDCSGGQQHFLKDNLIDLGCPRIPLLGKMAIYICRMSNHPKTTMAFLFWFSFGYVITCILCKAIFYLLIIVGTLGKRFKQYRELKPQTCTICETTPANAIDAEMHDLNCSYNICPYCASRLTSDGLARHVTQCPKRKEKVEETELYLNLERIPWIVRKLLQVSESTGVALKRSSWLIVLLVLFAVSLSPVQSAPIGHGKTIETYQAREDYTSICLFVLGSILFIVSCLMKGLVDSIGNIFFPGLTICKTCSIGSINGFEIESHKCYCSLLCCPYCRHCSADREIHQLHLSICKKRKTGSNVMLAVCKRMCFRATMEVSNKALLIRSIINTTFVVCILILAVCVVSTSAVEMESLPAGTWEREEDLTNFCHQECQVTETECLCPYEALVLRRPLFLDSIVKGTKNLLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVDYIKTEAIVCVELTSQERQCSLVEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFVNLLNIETDYTKSFHFHSKRVTAHGDTPQLDLKARPTYGAGEITVLVEVADMELHTKKIEITGLKFASLTCTGCYACSSGISCKVRIHVDEPDELTVHVKSDDPDVVAASSSLMARKLEFGTDSTFKAFSAMPKTSLCFYIVEREYCKSCSKEDTQKCVNTKLEQPQSILIERKGTIIGKQNNTCTAKASCWLESVKSFFYGLKNMLSGIFGNVFVGIFLFLAPFILLILFFMFGWRILFCFKCCRRTRGLFKYKHLKDDEETGYRRIIERLNNKKGKNKLLDGERLADRRIAELFSTKTHIG

SEQ ID NO: 1217 - protein, 1688 aa, Artificial Sequence
  derived and/or modified protein sequence (wt) from CCHFV(Kosovo/9553/2001)__AY675511.1__GP
MPINIMHTLLVCFILYLQLLGLGGAHGQSNATEHNGTNTTTAPGTSQSPKPPASTTPSHAPESSTIKLTTPTSETEGSGETTPPTSTTQGSPPLETTPERSTTTATSTSGTDNMNSTTQMTDNTPTLTASTSPSSSPSTPSTSQGLHYPVRSLLSVSSPKTVTTPTPMSPGEMSSETSSQHSAMSRTPTPHTATQVSTENANRSTSRQSESSAQPATQSPVTSPAQSILLMSATPTTIQNIHPSPTNRSKRNLEMEIILTLSQGLKKYYGKILKLLHLTLEEDTEGLLEWCKRNLGSNCDDDFFQKRIEEFFITGEGYFNEVLQFKTLSTPSPTEPSHARLPTAEPFKSYFAKGFLSIDSGYFSAKCYPRSSTSGLQLINVTQHPARIAETPGPKITSLKTINCINLRASVFKEHREVEINVLLPQIAVNLSNCHVVINSHVCDYSLDTDGPVRLPRIYHEGTFMPGTYKIVIDRKNKLNDRCTLVTNCVIKGREVRKGQSVLRQYKTEIKIGKAPTGSRKLLSEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYIARMSNHPKTTMAFLFWFSLGYVITCILCKALFYSLIIIGTLGKKIKQYRELKPQTCTICETAPVNAIDAEMHDLNCSYNICPYCASRLTSDGLARHVKQCPKRKEKVEETELYLNLERIPWVVRKLLQVSESTGVALKRSSWLIVLLVLLTVSLSPVQSAPVGHGKTIETYQTREGFTSICLFMLGSILFIVSCLVKGLVDSVSDSFFPGLSVCKTCSIGSINGFEIESHKCYCSLFCCPYCRHCSADREIHQLHLSICKKRKTGSNVMLAVCKRMCFRATIEASRRALLIRSIINTTFVICILTLTICVASTSAVEMETLPAATWEREEDLTNFCHQECQVPETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEKEYCKSCSEDDTKKCVDTKLEQPQSILIEHRGTIIGKPNDTCPAKTSCWLESVKSFFYGLKNMLGSVFGNFFIGILLFLAPFFLWMLSFMFGWKILFCFKCCRRTRGLFKYRHLKDDEETGYRRIIERLNNKKGKNRLLDGERLADRKIAELFSTKTHIG

SEQ ID NO: 1218 - protein, 1688 aa, Artificial Sequence
  derived and/or modified protein sequence (wt) from CCHFV(200406546-Turkey)__KR864902.1__GP
MPTNITHTLLVCFILYLQLLGRGGAHGQSNATEHNGTNTTTAPGTSQSHKPLVSTTPPHTLESSTIKHTTPTSETEGSGETTPPPNTTQGPSPPEATPERPATTATSTPSTDNTNSTTQMNDNNPTSTISTSPSSSPSTPPTPQGIHHPARSLLSVSSLKTATTPTPTSPGEISSETSSQHSAMSRTPTLHTTTQVSTESTNHSTPRQSESSAQPTTPSPMTSPAQSILPMSAAPTAIQNIHPSPTNRSKRNLEVEIILTLSQGLKKYYGKILKLLHLTLEEDTEGLLEWCKRNLGSSCDDDFFQKRIEEFFVTGEGYFNEVLQFKTLSTLSPTEPSHAKLPTVEPFKSYFAKGFLSIDSGYFSAKCYPRSSTSGLQLINVTQHPARIAETPGPKTTSLKTINCINLRASVFKEHREIEINVLLPQIAVNLSNCHAVIKSHVCDYSLDTDGPVRLPHIYHEGTFIPGTYKIVIDKKNKLNDRCILVTNCVIKGREVRKGQSVLRQYKTEIKIGKASTGSRKLLSEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDVCDSSCEVMIPKGTGDILVDCSGGQQHFLKDNLIDLGCPHVPLLGRMAIYICRMSNHPRTTMAFLFWFSFGYVITCIFCKALFYSLIIIGTLGKKFKQYRELKPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVGHGKTIETYQTREGFTSICLFMLGSILFIVSCLVKGLVDSVSDSFFPGLSVCKTCSIGSINGFEIESHKCYCSLFCCPYCRHCSADREIHQLHLSICKKRKTGSNVMLAVCKRMCFRATIEASRRALLIRSIINTTFVICILTLTICVVSTSAVEMENLPAGTWEREEDLTNFCHQECQVTETECLCPYEALVLRKPLFLDSIVKGMKNLLNSTSLETSLSIEAPWGAINVQSTFKPTVSTANIALSWSSIEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLTARKLEFGTDSTFKAFSAMPKTSLCFYIVEKEYCKSCNEDDTQKCVDTKLEQPQSILIEHKGTIIGKQNDTCTAKASCWLESVKSFFYGLKNMLGSVFGNFFIGILLFLAPFVLLVLFFMFGWKILFCFKCCRRTRGLFKYRHLKDDEETGYKRIIERLNNKKGKNRLLDGERLADRKIAELFSTKTHIG

SEQ ID NO: 1219 - protein, 1688 aa, Artificial Sequence
  derived and/or modified protein sequence (wt) from CCHFV(Haskovo-V46/13)__KR092379.1__GP
MPTNIMHTLLVCFILYLQLLGLGGAHGQSNTTEHNGTNNTTAPGTSQSPKPHMSTTPPHAPESSTIKPTTPTSETEGSGETTPPSNTTQGPSPPETTSERPATTAISTSSTDNMNPTSQMTDNTPTSTVSISPSSSPSTPSTPQGMHHPARSLLSVSSPKTATTPTPTSPVEVGSETSSQHSAMSSTPTPHTATQVSTENTNHSTPRQSEPSAQQTTPSPMPSPAQSTLLMSAAPTAVQNTHPSPTNRSKRNLEMEIILTLSQGLKKYYGKILKLLHLTLEEDTEGLLEWCKRNLGSNCDDDFFQKRIEEFFMTGEGYFNEVLQFKTLSTLSPMEPSHAELPTAEPFKSYFAKGFLSIDSGYFSAKCYPRSSTSGLQLINVTQHPARIAETPGPKTTSLKAINCINLRASVFKEHREIEINVLLPQIAVNLSNCHVVINSHVCDYSLDTDGPVRLPHIYHEGTFIPGTYKIVIDKKNKLNDRCTLVTNCVIKGREVRKGQSVLRQYKTEIKIGKASTGSRKLLSEELGDDCISRTQLLRTETAEIHDDNYGGPGDKITICNGSTIVDQRLGSELGCYTINRGKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETTPVNAIDAEMHDLNCSYNICPYCASRLTSDGLARHVTQCPKRKEKVEETELYLNLERIPWIVRKLLQVSESTGVALKRSSWLIVLLVLLPVSLSPVQSAPVGHGKTIETYQTREGFTSICLFMLGSILFIVSCLVKGLVDSVGDSFFPGLSVCKTCSIGSINGFEIESHKCYCSLFCCPYCRHCSADREIHQLHLSICKKRKTGSNVMLAVCKRMCFRATIEASRRALLIRSIINTTFAMCILTLTICVVSTSAVEMENLPAGTWEREEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLTCTGCYACSSGISCKVRIHVDEPDELTVHVKSSDPDVVAAGTSLMARKLEFGTDSTFKAFSAMPKTSLCFYIVEREYCKSCSEDDTQKCVDTKLEQPQSILIEHKGTIIGKQNDTCTARASCWLESVKSFFYGLKNMLGSVFGNFLIGILLFLAPFVLLVLFFMFGWKILFCFKCCRRTRGLFKYRHLKDDEETGYRRIIERLNSKKGKNRLLDGERLADRKIAELFSTKTHIG

SEQ ID NO: 1220 - protein, 1688 aa, Artificial Sequence
  derived and/or modified protein sequence (wt) from CCHFV(VLG/TI29414)__AY179961.1__GP
MPTNIMHTLLVCFILYLQLLGLGGAHIQSNATEHNGTNTTTAPSTSQSPKPLVSTAPPHALESSTIKPTTPVSETEGSGGTTPPPNTTQGPSPPEATPERPATTATSTPSTDNTNSTTHVTDNNPTSTISTSPSSSPSTPSTPQGIHHPARNLLSVSSPKTATTPTPTSPGDISSETSSLHSAMSRTSTLYTATQVSTENANHSAPRQSESSAQQTTTSPMTSPAQPILVMSAAPTAIQNIHPSPTNRSKRNLEMEIILTLSQGLKKYYGKILKLLHLTLEEDTEGLLEWCKRSLGSNCDDDFFQKRIEEFFMTGEGYFNEVLQFKTLSTLSPTEPSHARPPTVEPFKSYFAKGFLSIDSGYFSAKCYPRLSTSGLQLINVTQHPARIAETPGPKTTSLKTINCINLRASVFKEHREIEINVLLPQIAVNLSNCHVVINSHVCDYSLDTDGPVRLPHIYHEGTFIPGTYKIVIDKKNKLNDRCTLVTNCVIKGREVRKGQSVLRQYKTEIKIGKASTGSRKLLSEEPGDDCISRTQLLRAEPAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVPQCPKRKEKVEETELYLNLERIPWNVRKLLQVSESTGVALKRSSWLIVLLVLLTVSLSPVQSAPVGHGKTIETYQTREGFTSICLFMLGSILFLVSCLVKGLVDSVSDSFFPGLSVCKTCSIGSINGFEIESHKCYCSLFCCPYCRHCSADREIHQLHLSICKKRKMGSNVMLAVCKRMCFRATIEASRRALLIRSIINTTFVICILTLTICVVSTSAVEMENLPSGTWEREEDLTNFCHQECQVTETECLCPYEALVLRKPLFLDSIVKGMKNLLNSTNLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWEVGTGCTCCGWNVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRVNGHLIHKIEPHFNTSWMSWDGCDLDYYCNMGDWPSCTYTGMTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSNDPDVIAASTSLMARKLEFGTDSTFKAFSAMPKTSLCFYIAEREYCKSCSEEDTQKCVDTKLEQPQSILIEHKGTIIGKQNDTCTAKASCWLESVKSFFYGLKNMLGSVFGNFFIGILLFLAPFVLLVLFFMFGWKILFCFKCCRRTRGLLKYRLLKDDEETGYRRIIERLNNKKGKNRLLDGERLADRKIAELFSTKTHIG

SEQ ID NO: 1221 - protein, 1688 aa, Artificial Sequence
  derived and/or modified protein sequence (wt) from CCHFV(UCCR4405)__KY484029.1__GP
MPINIMHALLVCFILYLQLSGLGGAHRQSNATEHNGTNTTTAPGTSQSPKPPVSTTLPHTPEASTIKLTTPTSETEGSGETTPPPNTTQGLPLPGTTPERSATTATSTSSTDDMNSTTQMTDNTPTSTVSIGLSSSPSMPSTSQGIHYPVRSLLSVSSPKTATTPTPMSPGEVSPETSSQHSAMSRIPTLYTATQVSTENTNRSIPRQSESSVQPATQSPITSPAQTILLMSAAPTAIQDMHPSPKNRSKRNLEVEIILTLSQGLKKYYGKILKLLHLTLEEDTEGLLEWCKRNLGSNCDDDFFQKRIEEFFITGEGYFNEVLQFKTPSTLSPTEPSHVRLPTAEPFKSYFAKGFLSIDSGYFSAKCYPRSSTSGLQLINVTQHPARIAETPGPKTTSLKTINCINLRASVFKEHREVEINVLLPQIAVNLSNCHVVINSHVCDYSLDTDGPVRLPRIHHEGAFIPGTYKIVIDKKNKLNDRCSLVTNCVIKGREVRKGQSVLRQYKTEIKIGKASTGSRKLLSEEPGDDCISRTQLLKTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLKCSYNICPYCASRLTSDGLARHVTQCPKRKEKVEETELYLNLERIPWIVRKLLQVSESTGVALKRSSWLIVLLVLLTVSLSPVQSAPVGHGKTIETYQTREGFTSICLFMLGSILFIVSCLVKGLVDSVSDSFFPGLSVCKTCSIGSINGFEIESHKCYCSLFCCPYCRHYSADREIHQLHLSICKKRKTGSNVMLAVCKRMCFKATIEASRRALLIRSIINTTFVICILILAICVVSTSAVEMENLPAGTWEREEDLTNFCHQECQVTETECLCPYEALVLRKPLFLDSTVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRVNGHLIHKIEPHFNTSWMSWDGCDLDYYCNMGNWPSCTYTGVTQHNHAAFVNLLNIETDYTKTFHFHSKRVTAHGDTPQLDLKARPTYGAGEITVLVEVADMELHTKKVEISGLKFASLVCTGCYACSSGISCKVRIHVDEPDELTVHVKSSDPDVVAASTSLMARKLEFGTDSIFKAFSAMPKTSLCFYIVEREYCKSCSEDDTKKCVDTKLEQPQSILIEHKGTIIGKQNDTCTAKASCWLESVKSFFYGLKNMLGSVFGNFFVGILLFLAPFVLLVLFFMFGWKILFCFKCCRRTRGLFKYRHLKDDEETGYRRIIERLNSKKGKNRLLDGERLADRKIAELFSTKTHIG

SEQ ID NO: 1222 - protein, 1688 aa, Artificial Sequence
  derived and/or modified protein sequence (wt) from CCHFV(Ast133)__KX056060.1__GP
MPINIKHTLLVCFILYLQLSGLGGAHGQSNATEHNGTNTTTVPGTSQSPKPPASTTPPHTPESSTVKLTTPTSETEGSGETTPPPNTTQGLPLPGTTPERSATTATSTSSTDNMNSTTQVTDNTPTSTVSISPSSSPSMPSTSQGIHHPVRSLLSVSSPKTVTTPTPMSPGEMSPETSSQHFAMSRIPTLYTATQVSTENTDRSTPRQSESSVQPATQSPITSPAQTILLMSAAPKAIQDMHPSPTNRSKRNLEVEIILTLSQGLKKYYGKILKLLHLTLEEDTEGLLEWCKRNLGSNCDDDFFQKRIEEFFITGEGYFNEVLQFKTLSTLSPTEPSHVRLPTAEPFKSYFAKGFLSIDSGYFSAKCYPRSSTSGLQLINVTQHPARIAETPGPKTTSLKTINCINLRASVFKEHREVEINVLLPQIAVNLSNCHVVINSHVCDYSLDTDGPVRLPRIHHEGTFIPGTYKIVIDRKNKLNDRCSLVTNCVIKGREVRKGQSVLRQYKTEIKIGKASTGSRKLLSEEPDDDCISRTQLLKTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEIMIPKGTGDILVDCSGGQQHFLKDNLIDLGCPHIPLLGKMAIYICRMSNHPRTTMAFLFWFSFGYVITCIFCKALFYLLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLTVSLSPVQSAPVGHGKTIETYQTREGFTSICLFMLGSILFIVSCLVKGLVDSVSDSFFPGLSVCKTCSIGSINGFEIESHKCYCSLFCCPYCRHCSADREIHQLHLSICKKRKTGSNVMLAVCKRMCFKATIEASRRALLIRSIINTTFVMCILTLAICVVSTSAVEMEDLPAGTWEREEDLTNFCHQECQVTETECLCPYEALVLRKPLFSDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLTCTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGSFFVGILLFLAPFVLLVLFFMFGWKILFCFKCCRRTRGLFKYRHLKDDEETGYRRIIERLNSKKGKNRLLDGERLADRKIAELFSSKTHIG

SEQ ID NO: 1223 - protein, 1688 aa, Artificial Sequence
  derived and/or modified protein sequence (wt) from CCHFV(Ast137)__KX056057.1__GP
MPINIMHTLLVCFILYLQLSGLGGAHGQSNATEHNGTNTTTVPGTSQSPKPPASTTLPHTPESSTVKLTTPTSETEGSGETTPPPNTTQGLPPPGTTPERPATTATSTSSTDNMNSTTQVTDNTPTSTVSISPSSSPSMPSTSQGIHYPVRSLLSVSSPKTVTTPTPMSPGEMSPETSSQHSAMSRIPTLYTAAQVSTENTNRSTPRQSESSAQPATQSPTTFPAQTILLMSAAPKAIQDMHPSPTNRSKRNLEVEIILTLSQGLKKYYGKILKLLHLTLEEDTEGLLEWCKRNLGSNCDDDFFQKRIEEFFITGEGYFNEVLQFKTLSTLSPTEPSHVRLPTAEPFKSYFAKGFLSIDSGYFSAKCYPRSSTSGLQLINVTQHPARIAETPGPKTTSLKTINCINLRASVFKEHREVEINVLLPQIAVNLSNCHVVINSHVCDYSLDTDGPVRLPRIHHEGTFIPGTYKIVIDKKNKLNDRCSLVTNCVIKGREVRKGQSVLRQYKTEIKIGKASTGSRKLLSEEPGDDCISRTQLLKTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEIMIPKGTGDILVDCSGGQQHFLKDNLIDLGCPHIPLLGKMAIHICRMSNHPRTTMAFLFWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLTVSLSPVQSAPVGHGKTIETYQTREGFTNICLFMLGSILFIVSYLVKGLVDSVSDSFFPGLSVCKTCSIGSINGFEIESHKCYCSLFCCPYCRHCSADREIHQLHLGICKKRKTGSNVMLAVCKRMCFKATIEASRRALLIRSIINTTFVICILTLAICVVSTSAVEMENLPAGTWEREEDLTNFCHQECQVTETECLCPYEALVLRKPLFLDSIVKGTKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRLNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEVSGLKFASLACTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGNFFVGILLFLAPFVLLVLFFIFGWKILFCFKCCRRTRGLFKYRHLKDDEETGYRKIIERLNSKKGKNRLLDGERLADRKIAELFSTKTHIG

SEQ ID NO: 1224 - protein, 1688 aa, Artificial Sequence
  derived and/or modified protein sequence (wt) from CCHFV(Ast149)__KX056054.1__GP
MPINIMHTLLVCFILYLQLSGLGGAHGQSNATEHNGTNTTTAPGTSQSPKPPASTTPPHTPESSTVKLTTPTSETEGSGETTPPPNTTQGLPPPGTTPERPATTATSTSSTDNMNSTTQVTDNTPTSTVSTSPSSSPSMPSTSQGIHYPVRSLLSVSSPKTVTTPTPMSPGEMSPETSSQHSAMSRIPTLYTAAQVSTENANRSTPRQSESSAQPATQSPTTFPAQTILLMSAAPKAIQDMHPSPTNRSKRNLEVEIILTLSQGLKKYYGKILKLLHLTLEEDTEGLLEWCKRNLGSNCDDDFFQKRIEEFFITGEGYFNEVLQFKTLSTLSPTEPSHVRLPTAEPFKSYFAKGFLSIDSGYFSAKCYPRSSTSGLQLINVTQHPARIAETPGPKTTSLKTINCINLRASVFKEHREVEINVLLPQIAVNLSNCHVVIYSHVCDYSLDTDGPVRLPRIHHEGTFIPGTYKIVIDKKNKLNDRCSLVTNCVIKGREVRKGQSVLRQYKTEIKIGKASTGSRKLLSEEPGDDCISRTQLLKTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEIMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLTVSLSPVQSAPVGHGKTIETYQTREGFTNICLFMLGSILFIVSCLVKGLVDSVSDSFFPGLSVCKTCSIGSINGFEIESHKCYCSLFCCPYCRHCSADREIHQLHLGICKKRKTGSNVMLAVCKRMCFKATIEASRRALPIRSIINTTFVICILTLAICVVSTSAVEMENLPAGTWEREEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRLNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEVSGLKFASLACTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGNFFVGILLFLAPFVLLALFFIFGWKILFCFKCCRRTRGLFKYRHLKDDEETGYRKIIERLNSKKGKNRLLDGERLADRKIAELFSTKTHIG

SEQ ID NO: 1225 - protein, 1688 aa, Artificial Sequence
  derived and/or modified protein sequence (wt) from CCHFV(Ast199)__KX056051.1__GP
MPINIMHTLLVCFILYLQLSGLGGAHVQSNATEHNGTNTTTVPGTSQSPKPPASTTLPHTPESSTVKLTTPTSETEGSGETTPPPNTTQGLPPPGTTPERPATTATTTSSTDNMNSTTQVTDNTPTSTVSISPSSNPSMPSTSQGIHYPVRSLLSVSSPKTVTTPTPMSPGEMSPETSSQHSAMSRIPTLYTAAQVSTENTNRSTPRQSESSAQPATQSPTTFPAQTIPLMSAAPKAIQDMHPSPTNRSKRNLEVEIILTLSQGLKKYYGKILKLLHLTLEEDTEGLLEWCKRNLGSNCDDDFFQKRIEEFFITGEGYFNEVLQFKTPSTLSPTEPSHVRLPTAEPFKSYFAKGFLSIDSGYFSAKCYPRSSTSGLQLINVTQHPARIAETPGPKTTSLKTINCINLRASVFKEHREVEINVLLPQIAVNLSNCHVVINSHVCDYSLDTDGPVRLPRIHHEGTFIPGTYKIVIDKKNKLNDRCSLVTNCVIKGREVRKGQSVLRQYKTEIKIGKASTGSRKLLSEEPGDDCISRTQLLKTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEIMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRCSWLIVLLVLLTVSLSPVQSAPVGHGKTIETYQTREGFTNICLFMLGSILFIVSCLVKGLVDSVSDSFFPGLSVCKTCSIGSINGFEIESHKCYCSLFCCPYCRHCSADREIHQLHLGICKKRKTGSNVMLAVCKRMCFKATIEASRRALLIRSIINTTFVICILTLAICVVSTSAVEMENLPAGTWEREEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRLNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEVSGLKFASLACTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGNFFVGILLFLAPFVLLVLFFIFGWKILFCFKCCRRTRGLFKYRHLKDDEETGYRKIIERLNSKKGKNRLLDGERLADRKIAELFSTKTHIG

SEQ ID NO: 1226 - protein, 1688 aa, Artificial Sequence
  derived and/or modified protein sequence (wt) from CCHFV(Saf)__KX013487.1__GP
MPTNIMHTLLVCFILYLQLLGLGGAHGQSNATEHNGTNTTTAPSTSQSPKPLVSTAPPHALESSTIKPTTPASETEGSGETTPPPNTTQGPSPPETTPERPATTATSTPSTDNTNSTTHVTDNNPTSTISTSPSSSPSTPSTPQGIHHPARNLLSVSSPKTATTPTPTSPGEISSETSSLHSAMSRTSTLYTATQVSTENANHSAPRQSESSAQPTTTSPMTSPAQSILVMSAAPTAIQNIHPSPTNRSKRNLEMEIILTLSQGLKKYYGKILKLLHLTLEEDTEGLLEWCKRNLGSNCDDDFFQKRIEEFFMTGEGYFNEVLQFKTLSTLSPTEPSHARPPTVEPFKSYFAKGFLSIDSGYFSAKCYPRSSTSGLQLINVTQHPARIAETPGPKTTSLKTINCINLRASVFKEHREIEINVLLPQIAVNLSNCHVVINSHVCDYSLDTDGPVRLPHIHHEGTFIPGTYKIVIDKENKLNDRCTLVTNCVIKGREVRKGQSVLRQYKTEIKIGKASTGSRKLLSEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHYLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVGHGKTIETYQTREGFTSICLFMLGSILFLVSCLVKGLVDSVSDSFFPGLSVCKTCSIGSINGFEIESHKCYCSLFCCPYCRHCSADREIHQLHLSICKKRKTGSNVMLAVCKRMCFRATIEASRRALLIRSIINTTFVICILTLTICVVSTSAVEMENLPSGTWEREEDLTNFCHQECQVTETECLCPYEALVLRKPLFSDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYMKTFHFHSKRVTAHGDTPQLDLKARPTYGAGEITVLVEVADMELHTKKVEISGLKFVSLACTGCYACSSGISCKVRIHVDEPDELTVHVKSSDPDVVAASTSLMARKLEFGTDSTFKAFSAMPKTSLCFYIVEREYCKSCSEEDTQKCVDTKLEQPQSILIEHKGTIIGKQNDTCTAKASCWLESVKSFFYGLKNMLGSVFGNFFIGILLFLAPFVLLVLFFMFGWKILFCFKCCRRTRGLLKYRHLKDDEETGYRRIIERLNNKKGKNRLLDGERLADRKIAELFSTKTHIG

SEQ ID NO: 1227 - protein, 1688 aa, Artificial Sequence
  derived and/or modified protein sequence (wt) from CCHFV(Min)__KX013481.1__GP
MPTNIMHTLLVCFILYLQLLGLGGAHGQSNATEHNGTNTTTAPSTSQSPKPLVSTAPPHALESSTIKPTTPASETEGSGETTPPPNTTQGPSPPETTPERPATTATSTPSTDNTNSTTHVTDNNPTSTISTSPSSSPSTPSTPQGIHHPARNLLSVSSLKTATTPTPTSPGEISSETSSLHSAMSRTSTLYTATQVSTENANHSAPRQSESSAQPTTTSPMTSPAQSILVMSAAPIAIQNIHPSPTNRSKRNLEMEIILTLSQGLKKYYGKILKLLHLTLEEDTEGLLEWCKRNLGSNCDDDFFQKRIEEFFMTGEGYFNEVLQFKTLSTLSPTEPSHARPPTVEPFKSYFAKGFLSIDSGYFSAKCYPRSSTSGLQLINVTQHPARIAETPGPKTTSLKTINCINLRASVFKEHREIEINVLLPQIAVNLSNCHVVINSHVCDYSLDTDGPVRLPHIYHEGTFIPGTYKIVIDKKNKLNDRCTLVTNCVIKGREVRKGQSVLRQYKTEIKIGKASTGSRKLLSEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVGHGKTIETYQTREGFTSICLFMLGSILFLVSCLVKGLVDSVSDSFFPGLSVCKTCTIGSINGFEIESHKCYCSLFCCPYCRHCSADREIHQLHLSICKKRKTGSNVMLAVCKRMCFRATIEASRRALLIRSIINTTFVICILTLTICVVSTSAVEMENLPSGTWEREEDLTNFCHQECQVTETECLCPYEALVLRKPLFLDSIVKGTKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRINGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEEDTQKCVDTKLEQPQSILIEHKGTIIGKQNDTCTAKASCWLESVKSFFYGLKNMLGSVFGNFFIGILLFLAPFVLLVLFFMFGWKILFCFKCCRRTRGLLKYRHLKDDEETGYRRIIERLNNKKGKNRLLDGERLADRKIAELFSTKTHIG

SEQ ID NO: 1228 - protein, 1688 aa, Artificial Sequence
  derived and/or modified protein sequence (wt) from CCHFV(Mamon)__KX013478.1__GP
MPTNIMHTLLVCFILYLQLLGLGGAHGQSNTTEHNGTNTTTAPSTSQSPKPLVSTAPPHALESSTIKPTTPASETEGSGETTPPPNITQGPSPPETTPERPATTATSTPSTDNTNSTTHVTDNNPTSTISTSPSSSPSTPSTPQGIHHPARNLLSVSSPKTATTPTPTSPGEISSKTSSLHSAMSRTSTLYTATQVSTENANHSAPRQSESSAQPTTTSPMTSPAQSILVMSAAPTAIQNIHPSPTNRSKRNLEMEIILTLSQGLKKYYGKILKLLHLTLEEDTEGLLEWCKRNLGSNCDDDFFQKRIEEFFMTGEGYFNEVLQFKTLSTLSPTEPSHARPPTVEPFKSYFAKGFLSIDSGYFSAKCYPRSSTSGLQLINVTQHPARIAETPGPKTTSLKTINCINLRASVFKEHREIEINVLLPQIAVNLSNCHVVINSHVCDYSLDTDGPVRLPHIYHEGTFIPGTYKIVIDKKNKLNDRCTLVTNCVIKGREVRKGQSVLRQYKTEIKIGKASTGSRKLLSEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVSDACDSSCEVMIPKGTGDILVDCSGGQQHFLKDNLIDLGCPHIPLLGKMAIYICRMSNHPRTTVAFLFWFSFGYVITCIFCKALFYSLIIIGTLGKKIKQYRELKPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVGHGKTIETYQTREGFTSICLFMLGSILFLVSCLVKGLVDSVSDSFFPGLSVCKTCSIGSINGFEIESHKCYCSLFCCPYCRHCSADREIHQLHLSICKKRKTGSNVMLAVCKRMCFRATIEASRRALLIRSIINTTFVICILTLTICVVSTSAVEMENLPSGTWEREEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEEDTQKCVDTKLEQPQSILIEHKGTIIGKQNDTCTAKTSCWLESVKSFFYGLKNMLGSVFGNFFIGILLFLAPFVLLVLFFMFGWKILFCFKCCRRTRGLLKYRHLKDDEETGYRRIIERLNNKKGKNRLLDGERLADRKIAELFSTKTHIG

SEQ ID NO: 1229 - protein, 1688 aa, Artificial Sequence
  derived and/or modified protein sequence (wt) from CCHFV(K340_6)__KX013475.1__GP
MPINIMHTLLVCFILYLQLSGLGGAHVQSNATEHNGTNTTTAPGTSQSPKPPASTTLPHTPESSTVKPTTPTSETEGSGETTPPPNTTQGLPPTGTTPERSATTATSTSSTDNMNSTTQVTDSTPTSTVSTSPSSSSSMPSTSQGIHHPVRSLLSVSSPKTVTTPTPMSPGEMSPETSSQHSAMSRVPTLYTATQVSTENTDRSTPRQSESSVQPATQSPITSPAQTILLMSAAPKAIQDMHPSPTNRSKRNLEVEIILTLSQGLKKYYGKILKLLHLTLEEDTEGLLEWCKRNLGSNCDDDFFQKRIEEFFITGEGYFNEVLQFKTLSTLSPTEPSHVRLPTAEPFKSYFAKGFLSIDSGYFSAKCYPRSSTSGLQLINVTQHPARIAETPGPKTTSLKTINCINLRASVFKEHREVEINVLLPQIAVNLSNCHVVINSHVCDYSLDTDGPVRLPRIHHEGTFIPGTYKIVIDRKNKLNDRCSLVTNCVIKGREVRKGQSVLRQYKTEIKIGKASTGSRKLLSEEPGDDCISRTQLLKTETAEIHDDNYGGPGDKITICNGSTIVDQRLGSELGCYTINRVKSFKLCENSTTGKTCEIDSTPVKCRQGFCLKITQEGRGHVKLSRGSEVVLDACDSSCEIMIPKGTGDILVDCSGGQQHFLKDNLIDLGCPHIPPLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLTVSLSPVQSAPVGHGKTIETYQTREGFTSICLFMLGSILFIVSCLVKGLVDSVSDSFFPGLSVCKTCSIGSINGFEIESHKCYCSLFCCPYCRHCSADREIHQLHLSICKKRKTGSNVMLAVCKRMCFKATIEASRRALLIRSIINTTFVMCILTLAICVVSTSAVEMEDLPAGTWEREEDLTNFCHQECQVTETECLCPYEALVLRKPLSLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVTDMELHTKKVEISGLKFASLTCTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGSFFVGILLFLAPFVLLVLFFMFGWKILFCFKCCRRTRGLFKYRHFKDDEETGYRRIIERLNSKKGKNRLLDGERLADRKIAELFSTKTHIG

SEQ ID NO: 1230 - protein, 1688 aa, Artificial Sequence
  derived and/or modified protein sequence (wt) from CCHFV(K323_27)__KX013472.1__GP
MPINIMHTLLVCFILYLQLSGLGGAHGQSNATEHNGTNTTTVPGTSQSPKPPASTTLPHTPESSTVKLTTPTSETEGSGETTPPPNTTQGLPLPGTTPERSATTATSTSSTDNMNSTTQVTDNTPTSTVSISPSSSPSMPSTSQGIHHPVRSLLSVSSPKTVTTPTPMSPGEMSPETSSQHSAMSRIPTLYTATQVSTENTDRSTPRQSESSVQPATQSPITSPAQTILLMSAAPKAIQDMHPSPTNRSKRNLEVEIILTLSQGLKKYYGKILKLLHLTLEEDTEGLLEWCKRNLGSNCDDDFFQKRIEEFFITGEGYFNEVLQFKTLSTLSPTESSHVRLPTAEPFKSYFAKGFLSIDSGYFSAKCYPRSSTSGLQLINVTQHPARIAETPGPKTTSLKTINCINLRASVFKEHREVEINVLLPQIAVNLSNCHVVISSHVCDYSLDTDGPVRLPRIHHEGTFIPGTYKIVIDRKDKLNDRCSLVTNCVIKGREVRKGQSVLRQYKTEIKIGKASTGSRKLLSEEPGDDCISRTQLLKTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEIMIPKGTGDILVDCSGGQQHFLKDNLIDLGCPHIPLLGKMAIYICRMSNHPRTTMAFLFWFSFGYVITCIFCKALFYLLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLTVLLVLLTVSLSPVQSAPVGHGNTIETYQTREGFTSICLFMLGSILFIVSCLVKGLVDSVSDSFFPGLSVCKTCSIGSINGFEIESHKCYCSLFCCPHCRHRSADREIHQLHLSICKKRKTGSNVMLAVCKRMCPKATIEASRRALPIRSIINTTLVMCILTLAICVVSTSAVEMEDLPAGTWEREEDLTNFCHQECQVTETECLCPYEALVLRKPLFLDSIAKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTGQERQCSLIEAGTRFNLGPVTITLSEPRNIQQKLPPEIITLHPKIEEGFFDLMHVQKVLSASTVCKLQSCTHGIPGDLQIYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLTCTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGSFFVGILLFLAPFVLLVLFFMFGWKILFCFKCCRRTRGLFKYRHLNDDEETGYRRIIERLNSKKGKNRLLDGERLADRKIAELFSTKTHIG

SEQ ID NO: 1231 - protein, 1688 aa, Artificial Sequence
  derived and/or modified protein sequence (wt) from CCHFV(K315_14)__KX013469.1__GP
MPFNIMHTLLVCFILYLQLSGLGGAHGQSNETEHNGTNTTTVPGTSQSPKPPASTTLQHTPESSTVKLTTPTSETEGSGETTPPPNTTQGLPPPGTTPERSATTATSTSSTDNMNSTTQVTDNTPTSTVSISPSSSPSMPSTSQGIHYPIRSLLSVSSPKTVTTPTPISPGEMSPETSSQHSAMSRIPTLYTATQVSTENTNRSTPRQSESSVQPATQSPITSPAQTILLMSAAPKAIQDMHPSPTNRSKRNLEVEIILTLSQGLKKYYGKILKLLHLTLEEDTEGLLEWCKRNLGSNCDDDFFQKRIEEFFITGEGYFNEVLQFKTLSTLSPTEPSHVRLPTAEPFKSYFAKGFLSIDSGYFSAKCYPRSSTSGLQLINVTQHPARIAETPGPKTTSLKTINCINLRASVFKEHREVEINVLLPQIAVNLSNCHVVINSHVCDYSLDTDGPVRLPRIHHEGTFIPGTYKIVIDKKNKLNDRCSLVTNCVIKGREVRKGQSVLRQYKTEIRIGKASTGSRKLLSEEPGDDCISRTQLLKTETAEIHDDNYGGPGDKITICNGSTVVDQRLGSELGCYTINRVKSFKLCKNSATGKTCEIDSTPVKCRQGFCLKITQEGRGHVKLSRGSEVVLDVCDSSCEIMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSEGLARHVTQCPKRKEKVEETELYLNLERIPWIVRKLLQVSESTGVALKRSSWLIVLLVLLTVSLSPVQSAPVGHGKTIETYQTREGFTSICLFMLGSILFIVSCLVKGLVYSVSDSFFPGLSVCKTCSIGSINGFEIESHKCYCSLFCCPYCRHCSADREIHQLHLSICKKRKTGSNVMLAVCKRMCFKATIEASRRALLIRSIINTTFVICILTLAICVVSTSAVEMEDLPAGTWEREEDLTNFCHQECQVTETECLCPYEALVLRKPLFLDSIVKGMKKLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLTCTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGSFFVGILLFLAPFVLLVLFFMFGWKILFCFKCCRRTRGLFKYRHLKDDEETGYRRIIERLNSKKGKNRLLDGERLADRKIAELFSTKTHIG

SEQ ID NO: 1232 - protein, 1688 aa, Artificial Sequence
  derived and/or modified protein sequence (wt) from CCHFV(K229_243)__KX013466.1__GP
MPTNIMHTLLVCFILYLQLLGLGGAQGQSNATEHNETNTTTAPSTSQSPKPPVSTTPPHALESSTIKPTTPARETEGSGETTPPPNTTQGPSPPEATPERPATTATSTPSTDNTNSTTHVTDNNPTSTISTSPSSSPSTPFTPQGIHHPARNLLSVSSPKTATTPTPTSPRELSSETSSLHSAISRTSTLYTATQVSTENANHSAPRQSESSAQPTTTSPMTSPAQSILVMSAAPTAIQNIHPSPTNRSKRNLEMEIILTLSQGLKKYYGKILKLLHLTLEEDTEGLLEWCKRNLGSNCDDDFFQKRIEEFFMTGEGYFNEVLQFKTLSTLSPTEPSHARPPAVEPFKSYFAKGFLSIDSGYFSAKCYPRSSTSGLQLINVTQHPARIAETPGPKTTSLKTINCINLRASVFKEHREIEINVLLPQIAVNLSNCHVVINSHVCDYSLDTDGPVRLPHIYHEGTFIPGTYKIVIDKKNKLNDRCTLVTNCVIKGREVRKGQSVLRQYKTEIKIGKASTGSRKLLSEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVGHGKTIETYQTREGFTSICLFMLGSILFLVSCLVKGLVDSVSDSFFPGLSVCKTCSIGSINGFEIESHKCYCSLFCCPYCRHCSADREIHQLHLSICKKRKTGSNVMLAVCKRMCFRATIEASRRALLIRSIINTTFVICILTLTICVVSTSAVEMENLPAGTWEREEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEKEYCKSCSEEDTQKCVDTKLEQPQSILIEHKGTIIGKQNDTCTAKASCWLESVKSFFYGLKNMLGSVFGNFFIGILLFLTPFVLLVLFFMFGWKILFCFKCCRRTRGLLKYRHLKDDEETGYRRIIERLNNKKGKNRLLDGERLADRKIAELFSTKTHIG

SEQ ID NO: 1233 - protein, 1688 aa, Artificial Sequence
  derived and/or modified protein sequence (wt) from CCHFV(K229_194)__KX013463.1__GP
MPINIMHTLLVCFILYLQLSGLGGAHGQSNATEHNGTNTTTVPGTSQSPKPPASTTLPHTPESSTVKLTTPTSETEGSGETTPPPNTTQGLPPPGTTPERPATTATSTSSTDNMNSTTQVTDNTPISTVSISPSSSPSMPSTSQGIHYPVRSLLSVSSPKTVTTPTPMSPGEMSPETSSQHSAMSRIPTLYTATQVSTENTNRSTPRQSESSAQPATQSPTTSPTQTILLMSAAPKAIQDMHPSPTNRSKRNLEVEIILTLSQGLKKYYGKILKLLHLTLEEDTEGLLEWCKRNLGSNCDDDFFQKRIEEFFITGEGYFNEVLQFKTLNTLSPTEPSHVRLPTAEPFKSYFAKGFLSVDSGYFSAKCYPRSSTSGLQLINVTQHPARIAETPGPKTTSLKTINCINLRASVFKEHREVEINVLLPQIAVNLSNCHVVINSHVCDYSLDTDGPVRLPRIHHEGTFIPGTYKIVIDKKNKLNDRCSLVTNCVIKGREVRKGQSVLRQYKTEIKIGKASTGSRKLLSEEPGDDCISRTQLLKTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEIMIPKGTGDILVDCSGGQQHFLKGNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLTVSLSPVQSAPVGHGKTIETYQTREGFTNICLFMLGSILFIVSCLVKGLVDSVSDSFFPGLSVCKTCSIGSINGFEIESHKCYCSLFCCPYCRHCSADREIHQLHLGICKKRKTGSNVMLAVCKRMCFKATIEASRRALLIRSIINTTFVICILTLAICVVSTSAVEMENLPAGTWEREEDLTSFCHQECQVTETECLCPYEALVLRKPLFLDSIVKGKKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRLNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYSCSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGNFFVGILLFLAPFVLLVLFFMFGWKILFCFKCCRRTRGLFKYRHLKDDEETGYRKIIERLNSKKGKNRLLDGERLADRKIAELFSTKTHIG

SEQ ID NO: 1234 - protein, 1688 aa, Artificial Sequence
  derived and/or modified protein sequence (wt) from CCHFV(Gaib)__KX013445.1__GP
MPVSIMYIPLVYAVIYLQLYGLGGAHGLLNKTEQNETGITATHGRVQGPPSASITLPVTPDPLSATSAASTSGPEGSGEVPTSPSTITQGLTSSENTPQLPTATDTGISSTSIIDVSTQTAGDTSTPTAHTSLPNSPSAPFTSQDTRHTVRGLLTVTSTKSDEASTLTDPKEASTEARSPSPSISRTPTPSPTVQASTENNTPSTPRQPEPTTRPALPSPTTSPTQPSLSQSATSAAIQDMHPSPTNRSRRNLEMEIILTLSQGLKKYYGKILKLLDLTLEEDTEGLLEWCKRNLDLTCDENFFLKRIEEFFLSGEGHFNEVLQFKAPSTMSSTEPTHAGPPTVEPFKSYFAKGFLSIDSGYFSAKCYPRTSNSGLQLINVTQHTARIADTPGPKITNVKTINCINLKASVFKKHREVEINVLLPQIAVNLSNCHVLIKSHVCDYSLNFDGMVRLPRIHHEGTFIPGTYKIVIDRKNKQNDRCTLVTNCVIKGREVRKGQSALRQYRTEIKIGEASIGSRRLLSEESSDDCISRTQLLRTETAEIHNDNYGGPGDKITICNGSTIVDQRLGSELGCYTINRVKSFKLCENSATGKSCEIDSIPVKCRQGFCLKITQEGRGHVKLSRGSEVVLDACDSSCEIMIPKGTGDILVDCSGGQQHFLKDNLIDLGCPNIPLLGKMAIYICRMSNHPKTTMAFLFWFSFGYVITCIFCKAIFYLLIIVGTLGKKFKQYRELKPQTCTICETTPVNAIDAEMHDLNCSYNICPYCASRLTSDGLARHVVHCPKRKEKIEETELYLNLERVPWVVRKLLQVSESTGVALKRSSWLIVLLVLLTVSLSPVQSAPIGHGKTIETYQTREGYTSICLFVLGGILFIVSCLMKGLVDSVGNNFFPGLTICKTCSISSINGFEIESHKCYCSLLCCPYCRHCSADREIHQLHLSICKKRKTGSNVMLAVCKRMCLRVTTEVSNRALFIRSIINTTFVICILILAVCVISTSAVEMENLPAGTWEREEDLTNFCHQECQVTETECLCPYEALVLRKPLFSDSIVKGMKNLLNSTSLETSLSIEAPWGAINVQSTFKPTVSTANIALSWSSIEHRGNKILVSGRSESIMKLEERTGISWDLGVEDASESRLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHAAFVNLLNIETDYTKNFHFHSKRVTAHGDTPQLDLKARPTYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSREDTQKCVSTKLEQPQSILIEHKGTIIGKQNNTCTTKTTCWLESVKSFFYGLKNMLSSIFGNVFVGIFSFLAPFILLILFFMFGWRILFCFKCCRRTRGLFKYRHLKDDEETGYRRIIERLNNKKGKSKLLDGERLADRKIAELFSTKTHIG

SEQ ID NO: 1235 - protein, 1688 aa, Artificial Sequence
  derived and/or modified protein sequence (wt) from CCHFV(Kosova Hoti)__EU037902.1__GP
MPINIMHTLLVCFILYLQLLGLGGAHGQSNATEHNGTNTTTAPGTSQSPKPPASTTPSHAPEPSTIKLTTPTSETEGSGETTPPTNTTQDSPPLETTPERSATTATSTSGTDNMNSTTQMTDNTPTSTVSTSLSSSPSTPSTSQGMHHPVRSLLSVSSPKTATTPTPMSPGEMSSETSSQHSAMSRTPTPHTATQVSTENANRSTSRQSESSAQPATQSPVTSPAQSILLMSATPTTIQNIHPSPTNRSKRNLEMEIILTLSQGLKKYYGKILKLLHLTLEEDTEGLLEWCKRNLGSNCDDDFFQKRIEEFFITGEGYFNEVLQFKTLSTPSSTEPSHARLPTAEPFKSYFAKGFLSIDSGYFSAKCYPRSSTSGLQLINVTQHPARIAETPGPKTTSLKTINCINLRASVFKEHREVEINVLLPQIAVNLSNCHVVINSHVCDYSLDTDGPVRLPRIYHEGTFMPGTYKIVIDRKNKLNDRCTLVTNCVIKGREVRKGQSVLRQYKTEIKIGKAPTGSRKLLSEEPGDDCISRTQLLRTETAEIHDDNYGGPGDKITICNGSTIVDQRLGSELGCYTINRVKSFKLCENSATGKTCEIDSTPVKCRQGFCLKITQKGRGHVKLSRGSEVVLDACDSNCEVMIPKGTGDILVDCSGGQQHFLKDNLIDLGCPHIPLLGKMAIYICRMSNHPKTTMAFLFWFSFGYVITCIFCKALFYSLIIIGTLGKKIKQYRELKPQTCTICETAPVNAIDAEMHDLNCSYNICPYCASRLTSDGLARHVKQCPKRKEKVEETELYLNLERIPWVVRKLLQVSESTGVALKRSSWLIVLLVLLTVSLSPVQSAPVGHGKTIETYQTREGFTSICLFMLGSILFIVSCLVKGLVDSVSDSFFPGLSVCKTCSIGSINGFEIESHKCYCSLFCCPYCRHCSADREIHQLHLNICKKRKTGSNVMLAVCKRMCFRATIEASRRALLIRSIINTTFVICILTLTICVVSTSAVEMENLPAGTWEREEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGISWDLGVEDASESKLLTVSIMDLSQMYSPVFEYLSGDRQVEEWPKATCTGDCPQRCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAAGTSLMARKLEFGTDSTFKAFSAMPKTSLCFYIVEKEYCKSCSEDDTKKCVDTKLEQPQSILIEHRGTIIGKQNDTCTAKASCWLESVKSFFYGLKNMLGSVFGNFFIGILLFLAPFVLLVLFFMFGWKILFCFKCCRRTRGLFKYRHLKDDEETGYRRIIERLNNKKGKNRLLDGERLADRKIAELFSTKTHIG

SEQ ID NO: 1236 - protein, 1688 aa, Artificial Sequence
  derived and/or modified protein sequence (wt) from CCHFV(Turkey200310849)__DQ211636.1__GP
MPTNIMHTLLVCFILYLQLLCLGGAHGQLNTTEHNGTNNTTAPGASQSPKPPMSTTPPHAPESSTIKPTTPISEAEGSGETTSTPNTTQGLSSPETTSERPATTAISTSSTDSTNPTTQMTDNTPTLTVSTSPSSSPSTPSTPQGIYHPARSLLSVSSPKTVTTPTPTSPGEMSSETSSQHSAMSRIPTPHTATRVSTENTNHSTPRQSESSAQQTTPSPMTSPAQSILLMSAAPTAVQDIHPSPTNRSKRNLETEIILTLSQGLKKYYGKILKLLHLTLEEDTEGLLEWCKRNLGSNCDDDFFQKRIEEFFMTGEGYFNEVLQFKTLSTLSPTEPSHARLPTAEPFKSYFAKGFLSIDSGYFSAKCYPRSSASGLQLINVTQHPARIAETPGPKTTSLKTINCINLRASVFKEHREIEINVLLPQIAVNLSNCHVVINSHVCDYSLDTDGPVRLPRIYHEGTFIPGTYKIVIDKKNKLNDRCTLVTNCVIKGREVRKGQSVLRQYKTEIKIGKASTGFRKLLSEEPGDDCISRTQLLRTETAEIHDDNYGGPGDKITICNGSTIVDQRLGSELGCYTINRVKSFKLCENSATGKTCEVDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCISCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLTVSLSPVQSAPVGHGKTIEIYQTREGFASICLFMLGSILFIVSCLVKGLVDSVSDSFFPGLSVCKTCSIGSVNGFEIESHKCYCSLFCCPYCRHCSADREIHQLHLSICKKRKTGSNVMLAVCKRMCFRATIEASRRALLIRSIINTTFVICILTLTICVVSTSAVEMENLPAGTWEREEDLTNFCHQECQVTETECLCPYEALVLRKPLFLDSIVKGMKNLLNSTSLETSLSIEAPWGAINVQSTFKPAVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQVYHIGNLLKGDRVNGHLIHKIESHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEDDTQKCVDTRLEQPQSILIEHKGTIIGKQNDTCTAKASCWLESVKSFFYGLKNMLGSVFGNLFIGILLFLAPFVLLVLFFMFGWKILFCFKCCRRTRGLFKYRHLKDDEETGYRRIIERLNSKKGKNRLLDGDRLADRKIAELFSTKTHIG

SEQ ID NO: 1237 - protein, 1688 aa, Artificial Sequence
  derived and/or modified protein sequence (wt) from CCHFV(Kashmanov)__DQ211631.1__GP
MPTNIMHTLLVCFILYLQLLGLGGAHGQSNATEHNGTNTTTAPSTSQSPKPLVSTAPPHALESSTIKPTTPASETEGSGETTPPPNTTQGPSPPETTPERPATTATSTPSTDNTNSTTHVTDNNPTSTISTSPSSSPSTPSTPQGIHHPARNLLSVSSPKTATTPTPTSPGEISSEASSLHSAMSRTSTLYTATQVSTENANHSAPRQSESSAQPTTTSPMTSPAQSILVMSAAPIAIQNIHPSPTNRSKRNLEMEIILTLSQGLKKYYGKILKLLHLTLEEDTEGLLEWCKRNLGSNCDDDFFQKRIEEFFMTGEGYFNEVLQFKTLSTLSPTEPSHAGPPTVEPFKSYFAKGFLSIDSGYFSAKCYPRSSTSGLQLINVTQHPARIAETPGPKTTSLKTINCINLRASVFKEHREIEINVLLPQIAVNLSNCHVVINSHVCDYSLDTDGPVRLPHIYHEGTFIPGTYKIVIDKKNKLNDRCTLVTNCVIKGREVRKGQSVLRQYKTEIKIGKASTGSRKLLSEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVGHGKTIETYQTREGFTSICLFMLGSILFLVSCLVKGLVDSVSDSFFPGLSVCKTCTIGSINGFEIESHKCYCSLFCCPYCRHCSADREIHQLHLSICKKRKTGSNVMLAVCKRMCFRATIEASRRALLIRSIINTTFVICILTLTICVVSTSAVEMENLPSGTWEREEDLTNFCHQECQVTETECLCPYEALVLRKPLFLDSIVKGMKNSLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRINGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEEDTQKCVDTKLEQPQSILIEHKGTIIGKQNDTCTAKASCWLESVKSFFYGLKNMLGSVFGNFFIGILLFLAPFVLLVLFFMFGWKILFCFKCCRRTRGLLKYRHLKDDEETGYRRIIERLNNKKGKNRLLDGERLADRKIAELFSTKTHIG

SEQ ID NO: 1238 - protein, 1688 aa, Artificial Sequence
  derived and/or modified protein sequence (wt) from CCHFV(Drosdov)__DQ211630.1__GP
MPINIMHALLVCFILYLQLSGLGGAHRQSNATEHNGTNTTTAPGTSQSPKPPVSTTLPHTPEASTIKLTTPTSETEGSGETTPPPNTTQGLPLPGTTPERSATTATSTSSTDDMNSTTQMTDNTPTSTVSIGLSSSPSMPSTSQGIHYPVRSLLSVSSPKTATTPTPMSPGEVSPETSSQHSAMSRIPTLYTATQVSTENTNRSIPRQSESSVQPATQSPITSPAQTILLMSAAPTAIQDMHPSPKNRSKRNLEVEIILTLSQGLKKYYGKILKLLHLTLEEDTEGLLEWCKRNLGSNCDDDFFQKRIEEFFITGEGYFNEVLQFKTPSTLSPTEPSHVRLPTAEPFKSYFAKGFLSIDSGYFSAKCYPRSSTSGLQLINVTQHPARIAETPGPKTTSLKTINCINLRASVFKEHREVEINVLLPQIAVNLSNCHVVINSHVCDYSLDTDGPVRLPRIHHEGAFIPGTYKIVIDKKNKLNDRCSLVTNCVIKGREVRKGQSVLRQYKTEIKIGKASTGSRKLLSEEPGDDCISRTQLLKTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLKCSYNICPYCASRLTSDGLARHVTQCPKRKEKVEETELYLNLERIPWIVRKLLQVSESTGVALKRSSWLIVLLVLLTVSLSPVQSAPVGHGKTIETYQTREGFTSICLFMLGSILFIVSCLVKGLVDSVSDSFFPGLSVCKTCSIGSINGFEIESHKCYCSLFCCPYCRHYSADREIHQLHLSICKKRKTGSNVMLAVCKRMCFKATIEASRRALLIRSIINTTFVICILILAICVVSTSAVEMENLPAGTWEREEDLTNFCHQECQVTETECLCPYEALVLRKPLFLDSTVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYMKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRVNGHLIHKIEPHFNTSWMSWDGCDLDYYCNMGNWPSCTYTGVTQHNHAAFVNLLNIETDYTKTFHFHSKRVTAHGDTPQLDLKARPTYGAGEITVLVEVADMELHTKKVEISGLKFASLVCTGCYACSSGISCKVRIHVDEPDELTVHVKSSDPDVVAASTSLMARKLEFGTDSIFKAFSAMPKTSLCFYIVEREYCKSCSEDDTKKCVDTKLEQPQSILIEHKGTIIGKQNDTCTAKASCWLESVKSFFYGLKNMLGSVFGNFFVGILLFLAPFVLLVLFFMFGWKILFCFKCCRRTRGLFKYRHLKDDEETGYRRIIERLNSKKGKNRLLDGERLADRKIAELFSTKTHIG

SEQ ID NO: 1239 - protein, 1688 aa, Artificial Sequence
  derived and/or modified protein sequence (wt) from CCHFV(1231-CR/TI-2015)__KU161585.1__GP
MPINIMHTLLVCFILYLQLLGLGGAHEQSNATDHNRTNTITAPSTSQNPKPPASTTPPHTPESSTIKLITSTGEAEGSGETTPPLNTTQGPFPPETTSEHPASTATNTSSTNSMNSTTQMTDKTLTSTVSTSLSISPSTPSTSQGIHYPIRSLLSVSSPRTAATPTPMSTREMSSETNSQHSAVSRTPTFHTATQVSTENDNRSTPRQSESSAQPATQSPMTSPAQSILLVSAAPTTIQNIHPSPTNRSKRNLEMEIILTLPQGLKKYYGKILKLLHLTLEEDTEGLLEWCKRNLGSNCDDEFFQKRIEEFFITGEGYFNEVLQFKTLSTLSPMEPSHARPPTAEPFKSYFAKGFLSIDSGYFSAKCYPRSSSSGLQLINITQHPARIAETPGPKTTSLKTINCINLRASVFKEHREVEINVLLPQIAVNLSNCHVVINSHVCDYSLDTDGPVRLPRIYHEGTFIPGTYKIVIDKKNKLNDRCTLVTNCVTKGREVRKGQSVLRQYKTEIKIGKASTGSRKLLSEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLTVSLSPVQSAPVGHGKTIETYQTREGFTSICLFMLGSILFIVSCLVKGLVESVSDSFFPGLSVCRTCSIGSINGFEIESHKCYCSLFCCPYCRHCSADREIHQLHLSICKKRKTGSNVMLAVCKRMCFRATMEASRRALLIRSIINTTFVICILTLTICVVSTSAVEMENLPAGTWEREEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGNFFIGILLFLAPFVLLVLFFMFGWKILFCFKCCRRTRGLFKYRHLKDDEETGYRRIIERLNNKKGKNRLLDGERLADRKIAELFSTKTHIG

SEQ ID NO: 1240 - protein, 1688 aa, Artificial Sequence
  derived and/or modified protein sequence (wt) from CCHFV(1-CR/HU-2015)__KU161584.1__GP
MPINIMHTLLVCFILYLQLLGLGGAHEQSNATDHNRTNTITAPSTSQNPKPPASTTPPHTPESSTIKLITSTGEAEGSGETTPPLNTTQGPFPPETTSEHPASTATNTSSTNSMNSTTQMTDNTLTSTVSTSLSISPSTPSTSQGIHYPVRSLLSVSSPKTAATPTPMSTREMSSETSSQHSAMSRTPTFHTATQVSTENANRSTPRQSESSAQPATQSPMTSPAQSIFLVSAAPTTIQNIHPSPTNRSKRNLEMEIILTLPQGLKKYYGKILKLLHLTLEEDTEGLLEWCKRNLGSNCDDEFFQKRIEEFFITGEGYFNEVLQFKTLSTLSPTEPSHARPPTAEPFKSYFAKGFLSIDSGYFSAKCYPRSSTSGLQLINITQHPARIAETPGPKTTSLKTINCINLRASVFKEHREVEINVLLPQIAVNLSNCHVVINSHVCDYSLDTDGPVRLPRIYHEGTFIPGTYKIVIDKKNKLNDRCTLVTNCVIKGREVRKGQSVLRQYKTEIKIGKASTGSRKLLSEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLTVSLSPVQSAPVGHGKTIETYQTREGFTSICLFMLGSILFIVSCLVKGLVDSVSDSFFPGLSVCRTCSIGSINGFEIESHKCYCSLFCCPYCRHCSADREIHQLHLSICKKRKTGSNVMLAVCKRMCFRATMEASRRALLIRSIINTTFVICILTLTICVVSTSAVEMENLPAGTWEREEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGNFFIGILLFLAPFVLLVLFFMFGWKILFCFKCCRRTRGLFKYRHLKDDEETGYRRIIERLNNKKGKNRLLDGERLADRKIAELFSTKTHIG

SEQ ID NO: 1241 - protein, 1688 aa, Artificial Sequence
  derived and/or modified protein sequence (wt) from CCHFV(V42/81)__GU477490.1__GP
MPTNTMHTLLVCFILYLQLLGLGGAHVQPNATEHNRTNTTTAPGTSHSLKPLVSTTPPQAPESSTIKPTTPTSETEGSGEATPLSNTIQAPSSPETTSERPATAVISTSGTDSTNSTTQTTDNNPTTTVGTSPSSSPSTPSTPQGIHHHARSLLSVTSPETVTTPKPTSPREMSSETSNQHSAMSRTPTHHTVTQVSTENTSHSTPRQPESSAQPTSSSPMTSPAQSTLLMSAAPTAVQSIHPSPTNRSKRNLETEIILTLSQGLKKYYGKILKLLHLTLEEDTEGLLEWCKRNLGSNCDDDFFQKRIEEFFMTGEGYFNEVLQFKTPSTVSPTEPSHARLPTAEPFKSYFAKGFLSIDSGYFSAKCYSRSSTSGLQLINVTQHPARIAETPGPKTTSLKTINCINLRASVFKENREIEISVLLPQIAVNLSNCHVVINSHVCDYSLDTDGPVRLPRINHEGTFIPGTYKIVIDKKNKLNDRCTLVTNCVIKGREVRKGQSVLRQYKTEIKIGKASTGSRKLLSKEPGDDCISRTQLMRTETAEIHDDNYGGPGDKITICNGSTIVDQRLGSELGCYTINRVKSFKLCENSATGKACEVDSTPVKCRQGFCLKITQEGRGHVKLSRGSEVVLDACDSSCEVMIPKGTGDILVDCSGGQQHFLKDNLIDLECPHIPLLGKLAIYICRMSNHPRTTMAFLFWFGFGYVITCILCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVVLKRSSWLIVLLVLLTVSLSPVQSAPVGHGKTIETYQTREGFTSICLFMLGSILFIVSCIVKGLVDSVSDSFFPGLSVCKTCSISSINGFEIESHKCYCSLFCCPYCRHCSADREIHQLHLSICRKRRTGSNVMLAVCKRMCFRATIEVSRRALLIRSIINTTFVICILTLTICVVSTSAVEMENLPAGTWEREEDLTNFCHQECQVTETECLCPYEALVLRKPLFLDSIVKGKKNLLNSTSLETSLSIEAPWGAINIQSTFKPTVSAANIALSWSSVEHRGNKILVSGRSESIMKLEERTGVSWNLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFIDHMFVKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGETPQLDLKARPAYGAGEITVLVEVADMELHTKKVEISGLKFASLACTGCYACSSGISCKVRIHVDEPDELTVHVKSNDPDVVAASTSLMARKLESGTDSTFKAFSAMPKTSLCFYIVEREYCKSCSEDDTQKCVETKLEQPQSILIEHKGTIIGKQNDTCTAKASCWLESVKSFFYGLKNMLGSVFGNFFIGILLFLAPFVLLVLFFMFGWKILFCFKCCRRTRGLFKYRHLKEDEETGYRRIIERLNSKKGKNRLLDGERLADRKIAELFSTKTHIG

SEQ ID NO: 1242 - protein, 1688 aa, Artificial Sequence
  derived and/or modified protein sequence (wt) from CCHFV(ROS/HUVLV-100)__DQ206448.1__GP
MPTNIMHTLLVCFILYLQLLGLGGAHRQSNATEHNGTNTTTAPSTSQSPKPLVSTAPPHALESSTIKPTTPVSETEGSGETTPPPNTTQGPSPPEATPERPTTTATSTPSTDNTNSTTHVTDNNPTSTISTSPSSSPSTPSTPQGIHHPARNLLSVSSPKTATTPTPTSPGEISSETSSLHSAMSRTSTLYTATQVSTENANHSAPRQSESSAQQTTTSPMTSPAQSILVMSAAPTAIQNIHPSPTNRSKRNLEMEIILTLSQGLKKYYGKILKLLHLTLEEDTEGLLEWCKRNLGSNCDDDFFQKRIEEFFMTGEGYFNEVLQFKTLSTLSPTEPSHARPPTVEPFKSYFAKGFLSIDSGYFSAKCYPRLSTSGLQLINVTQHPARIAETPGPKTTSLKTINCINLRASVFKEHREIEINVLLPQIAVNLSNCHVVINSHVCDYSLDTDGPVRLPHIYHEGTFIPGTYKIVIDKKNKLNDRCTLVTNCVIKGREVRKGQSVLRQYKTEIKIGKASTGSRKLLSEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVGHGKTIETYQTREGFTSICLFMLGSILFLVSCLVKGLVDSVSDSFFPGLSVCKTCSIGSINGFEIESHKCYCSLFCCPYCRHCSADREIHQLHLSICKKRKTGSNVMLAVCKRMCFRATIEASRRALLIRSIINTTFVICILTLTICVVSTSAVEMENLPSGTWEREEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEEDTQKCVDTKLEQPQSILIEHKGTIIGKQNDTCTAKASCWLESVKSFFYGLKNMLGSVFGNFFIGILLFLAPFVLLVLFFMFGWKILFCFKCCRRTRGLLKYRLLKDDEETGYRRIIERLNNKKGKNRLLDGERLADRKIAELFSTKTHIG

SEQ ID NO: 1243 - protein, 1688 aa, Artificial Sequence
  derived and/or modified protein sequence (wt) from CCHFV(5180-R-2011)__KR814874.1__GP
MPTNIMHTLLVCFILYLQLLGLGGAHRQSNATEHNGTNTTTAPSTSQSPKPPVSTAPPYAPESSTIKPTTPASETEGSGETTPPPNTTQGPSPPEATPERPATTATSTPSTDNTNSTTHATDNNPTSTISTSPSSSPSTPSTPQGIHHPARNLLSVSSPKTATTPTPTSPGDISSETSSLHSAMSRTPTLHTATQASTENANHSAPRQSESSAQQTTTSPMTSPAQPILVMSAAPTAIQNIHPSPTNRSKRNLEMEIILTLSQGLKKYYGKILKLLHLTLEEDTEGLLEWCKRNLGSNCDDDFFQKRIEEFFMTGEGYFNEVLQFKTLSTLSPTEPSHARPPTVEPFKSYFAKGFLSIDSGYFSAKCYPRLSTSGLQLINVTQHPARIAETPGPKTTSLKTINCINLRASVFKEHREIEINVLLPQIAVNLSNCHVVINSHVCDYSLDTDGPVRLPHIYHEGTFIPGTYKIVIDKKNKLNDRCTLVTNCVIKGREIRKGQSVLRQYKTEIKIGKASTGSRKLLSEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDTSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVGHGKTIETYQTREGFTSVCLFMLGSILFLVSCLVKGLVDSVSDSFFPGLSVCKTCSIGSINGFEIESHKCYCSLFCCPYCRHCSADREIHQLHLSICKKRKMGSNVMLAVCKRMCFRATIEASRRALLIRSIINTTFVICILTLTICVVSTSAVEMENLPSGTWEREEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSNDPDVVAASTSLMARKLEFGTDSTFKAFSAMPKTSLCFYIVEREYCKSCSEEDTQKCVDTKLEQPQSILIEHKGTIIGKQNDTCTAKASCWLESVKSFFYGLKNMLGSVFGNFFIGILLFLAPFVLLVLFFMFGWKILFCFKCCRRTRGLLKYRLLKDDEETGYRRIIERLNNKKGKNRLLDGERLADRKIAELFSTKTHIG

SEQ ID NO: 1244 - protein, 1688 aa, Artificial Sequence
  derived and/or modified protein sequence (wt) from CCHFV(5170-R-2011)__KR814873.1__GP
MPFNIMHTLLVCFILYLQLSGLGGAHGQSNETEHNGTNTTTVPGTSQSPKPPASTTLQHTPESSTVKLTTPTSETEGSGETTPPPNTTQGLPPPGTTPERSATTATSTSSTDNMNSTTQVTDNTPTSTVSISPSSSPSMPSTSQGIHYPIRSLLSVSSPKTVTTPTPISPGEMSPETSSQHSAMSRIPTLYTATQVSTENTNRSTPRQSESSVQPATQSPITSPAQTILLMSAAPKAIQDMHPSPTNRSKRNLEVEIILTLSQGLKKYYGKILKLLHLTLEEDTEGLLEWCKRNLGSNCDDDFFQKRIEEFFITGEGYFNEVLQFKTLSTLSPTELSHVRLPTAEPFKSYFAKGFLSIDSGYFSAKCYPRSSTSGLQLINVTQHPARIAETPGPKTTSLKTINCINLRASVFKEHREVEINVLLPQIAVNLSNCHVVINSHVCDYSLDTDGPVRLPRIHHEGTFIPGTYKIVIDKKNKLNDRCSLVTNCVIKGREVRKGQSVLRQYKTEIKIGKASTGSRKLLSEEPGDDCISRTQLLKTETAEIHDDNYGGPGDKITICNGSTIVDQRLGSELGCYTINRVKSFKLCENSATGKTCEIDSTPVKCRQGFCLKITQEGRGHVKLSRGSEVVLDVCDSSCEIMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSEGLARHVTQCPKRKEKVEETELYLNLERIPWIVRKLLQVSESTGVALKRSSWLIVLLVLLTVSLSPVQSAPVGHGKTIETYQTREGFTSICLFMLGSILFIVSCLVKGLVDSVSDSFFPGLSVCKTCSIGSINGFEIESHKCYCSLFCCPYCRHCSADREIHQLHLSICKKRKTGSNVMLAVCKRMCFKATIEASRRALLIRSIINTTFVICILTLAICVVSTSAVEMEDLPAGTWEREEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLTCTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGSFFVGILLFLAPFVLLVLFFMFGWKILFCFKCCRRTRGLFKYRHLKDDEETGYRRIIERLNSKKGKNRLLDGERLADRKIAELFSTKTHIG

SEQ ID NO: 1245 - protein, 1688 aa, Artificial Sequence
  derived and/or modified protein sequence (wt) from CCHFV(4701-ST-2009)__KR814872.1__GP
MPINIMHTLLVCFILYLQLSGLGGAHGQSNATEHNGTNTTTAPGTSQSPKPPASTTLPHTPESSTVKLTTPTSETEGSGETTPPPNTTQGLPLTGTTPERSATTATSTSSTDNMNSTTQVTDNTPTSTVSISPSSSSSMPSTPQGTHHPVRSLLSVSSPKTVTTPTPMSPGEMSPETSSQHSAMSRVPTLYTATQVSTENTDRSTPRQSESSVQPATQSPITSPAQTILLMSAAPKAIQDMHPSPTNRSKRNLEVEIILTLSQGLKKYYGKILKLLHLTLEEDTEGLLEWCKRNLGSNCDDDFFQKRIEEFFITGEGYFNEVLQFKTLSTLSPTEPSHVRLPTAEPFKSYFAKGFLSIDSGYFSAKCYPRSSTSGLQLINVTQHPARIAETPGPKTTSLKTINCINLRASVFKEHREVEINVLLPQIAVNLSNCHVVINSHVCDYSLDTDGPVRLPRIHHEGTFIPGTYKIVIDRKNKLNDRCSLVTNCVIKGREVRKGQSVLRQYKTEIKIGKASTGSRKLLSEEPGDDCISRTQLLKTETAEIHDDNYGGPGDKITICNGSTVVDQRLGSELGCYTINRVKSFKLCENSATGKTCEIDSTPVKCRQGFCLKITQEGRGHVKLSRGSEVVLDACDSSCEIMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLTVSLSPVQSAPVGHGKTIETYQTREGFTSICLFMLGSILFIVSCLVKGLVDSVSDSFFPGLSVCKTCSIGSINGFEIESHKCYCSLFCCPYCRHCSADREIHQLHLSICKKRKTGSNVMLAVCKRMCFKATIEASRRALLIRSIINTTFVMCILTLAICVVSTSAVEMEDLPAGTWEREEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLTCTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGGFFVGILLFLAPFVLLVLFFMFGWKILFCFKCCRRTRGLFKYRHLKDDEETGYRRIIERLNSKKGKNRLLDGERLADRKIAELFSTKTHIG

SEQ ID NO: 1246 - protein, 1688 aa, Artificial Sequence
  derived and/or modified protein sequence (wt) from CCHFV(4574-ST-2008)__KR814870.1__GP
MPTNIMHTLLVCFILYLQLLGPGGAHGQPNATEHNRTNTTTAPSTSQSPKPPVSTAPPHALESPTIKSTTPTSETEGSGETTSPPNTTQGPSLPETTPKRPATTATSTPSTDNTNSTTHVTDNNPTSTISTSPSSSPSTPSTPRGIHHPARNLLSVSSPKTATTPTPTSPGEISSETSSLHSAMSRTSTLYTATQASTENANHSAPRQSESPAQPTTTSLMTSPAQSILVMSAAPTAIQNIHPSPTNRSKRNLEMEIILTLSQGLKKYYGKILKLLHLTLEEDTEGLLEWCKRNLGSNCEDDFFQKRIEEFFMTGEGYFNEVLQFKTLSTLSPTEPSHARPPTVEPFKSYFAKGFLSIDSGYFSAKCYPRSSTSGLQLINVTQHPARIAETPGPKTTSLKTINCINLRASVFKEHREIEINVLLPQIAVNLSNCHVVINSHVCDYSLDTDGPVRLPHIYHEGTFIPGTYKIVIDKKNKLNDRCTLVTNCVIKGREVRKGQSVLRQYKTEIKIGKVSTGSRKLLSEESGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCLFCKALFYSLIIIGTLGKKIKQYRELRPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVGHGKTIETYQTREGFTSICLFMLGSILFLVSCLVKGLVDSVSDSFFPGLSVCKTCSIGSINGFEIESHKCYCSLLCCPYCRHCSADREIHQLHLSICKKRKTGSNVMLAVCKRMCFRATIEASRRALLIRSIINTTFVICILTLTICVVSTSAVEMENLPSGTWEKEEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEEDTQKCVDTKLEQPQSILIEHKGTIIGKQNDTCTAKASCWLESVKSFFYGLKNMLGSVFGNFFIGILLFLAPFVLLVLFFMFGWKILFCFKCCRRARGLLKYRHLKDDEETGYRKIIERLNNKKGKNRLLDGERLADRKIAELFSTKTHIG

SEQ ID NO: 1247 - protein, 1688 aa, Artificial Sequence
  derived and/or modified protein sequence (wt) from CCHFV(4495-ST-2008)__KR814869.1__GP
MPTNIMHTLLVCFILYLQLLGPGGAHGQPNATEHNRTNTTTAPSTSQSPKPPVSTAPPHALESPTIKSTTPTSETEGSGETTPPPNTTQGPSPPETTPERPATTATSTPSTDNTNSTTHVTDNNPTSTISTSPSSSPSTPSTPRGIHHPARNLLSVSSPKTATTPTPTSPGEISSETSSLHSAMSRTSTLYTATQASTENANHSTPRQSESPAQPTTTSLMTSPAQSILVMSAAPTAIQNIHPSPTNRSKRNLEMEIILTLSQGLKKYYGKILKLLHLTLEEDTEGLLEWCKRNLGSNCDDDFFQKRIEEFFMTGEGYFNEVLQFKTLSTLSPTEPSHARPPTVEPFKSYFAKGFLSIDSGYFSAKCYPRSSTSGLQLINVTQHPARIAETPGPKTTSLKTINCINLRASVFKEHREIEINVLLPQIAVNLSNCHVVINSHVCDYSLDTDGPVRLPHIYHEGTFIPGTYKIVIDKKNKLNDRCTLVTNCVIKGREVRKGQSVLRQYKTEIKIGKVSTGSRKLLSEESGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCLFCKALFYSLIIIGTLGKKIKQYRELRPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVGHGKTIETYQTREGFTSICLFMLGSILFLVSCLVKGLVDSVSDSFFPGLSVCKTCSIGSINGFEIESHKCYCSLLCCPYCRHCSADREIHQLHLSICKKRKTGSNVMLAVCKRMCFRATIEASRRALLIRSIINTTFVICILTLTICVVSTSAVEMENLPSGTWEKEEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGISWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEEDTQRCVDTKLEQPQSILIEHKGTIIGKQNDTCTAKASCWLESVKSFFYGLKNMLGSVFGNFFIGILLFLAPFVLLVLFFMFGWKILFCFKCCRRARGLLKYRHLKDDEETGYRKIIERLNNKKGKNRLLDGERLADRKIAELFSTKTHIG

SEQ ID NO: 1248 - protein, 1688 aa, Artificial Sequence
  derived and/or modified protein sequence (wt) from CCHFV(3809-ST-2007)__KR814867.1__GP
MPTNIMHTLLVCFILYLQLLGLGGAQGQSNATEHNETNTTTAPSTSQSPKPPVSTTPLHALESSTIKPTTPARETEGSGETTPPPNTTQGPSPPEATPERPATTATSAPSTDNTNSTTHVTDNNPTSTISTSPSSSPSTPFTPQGIHHPARNLLSVSSPKTATTPTPTSPGELSSETSSLHSAISRTSTLYTATQVSTENANHSAPRQSESSAQPTTTSPMTSPAQSILVMSAAPTAIQNIHPSPTNRSKRNLEMEIILTLSQGLKKYYGKILKLLHLTLEEDTEGLLEWCKRNLGSNCDDDFFQKRIEEFFMTGEGYFNEVLQFKTLSTLSPTEPSHARPPAVEPFKSYFAKGFLSIDSGYFSAKCYPRSSTSGLQLINVTQHPARIAETPGPKTTSLKTINCINLRASVFKEHREIEINVLLPQIAVNLSNCHVVINSHVCDYSLDTDGPVRLPHIYHEGTFIPGTYKIVIDKKNKLNDRCTLVTNCVIKGREVRKGQSVLRQYKTEIKIGKASTGSRKLLSEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVGHGKTIETYQTREGFTSICLFMLGSILFLVSCLVKGLVDSVSDSFFPGLSVCKTCSIGSVNGFEIESHKCYCSLFCCPYCRHCSADREIHQLHLSVCKKRKTGSNVMLAVCKRMCFRATIEASRRALLIRSIINTTFVICILTLTICVVSTSAVEMENLPAGTWEREEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEKEYCRSCSEEDTQKCVDTKLEQPQSILIEHKGTIIGKQNDTCTAKASCWLESVKSFFYGLKNMLGSVFGNFFIGILLFLTPFVLLVLFFMFGWKILFCFKCCRRTRGLLKYRHLKDDEETGYRRIIERLNNKKGKNRLLDGERLADRKIAELFSTKTHIG

SEQ ID NO: 1249 - protein, 1688 aa, Artificial Sequence
  derived and/or modified protein sequence (wt) from CCHFV(3756-ST-2007)__KR814866.1__GP
MPINIMHTLLVCFILYLQLSGLGGAHGQSNATEHNRTNTTTVPGTSQSPKPPASTTLPHTPESSTVKLTTPTSETEGSGETTPPPNTTQGLPLPGTTPERSATTATSTSSTDNMNTTTQVTDNTPTSTVSISPSSSPSMPSTSQGIHYPVRSLLSVSSPKTVTTPTPMSPGEMSPETSSQHSAMSRIPTLYTATQVSTENINRSTPRQSESSVQPATQSPITSPAQTILLMSAAPKAIQDMHPSPTNRSKRNLEVEIILTLSQGLKKYYGKILKLLHLTLEEDTEGLLEWCKRNLGSNCDDDFFQKRIEEFFITGEGYFNEVLQFKTLSTLSPTEPSHVRLPTAEPFKSYFAKGFLSIDSGYFSAKCYPRSSTSGLQLINVTQHPARIAETPGPKTTSLKTINCINLRASVFKEHREVEINVLLPQIAVNLSNCHVVINSHVCDYSLDTDGPVRLPRIHHEGTFIPGTYKIVIDRKNKLNDRCSLVTNCVIKGREVRKGQSVLRQYKTEIKIGKASTGSRKLLSEEPGDDCISRTQLLKTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEIMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLTVSLSPVQSAPVGHGKTIETYQTREGFTSICLFMLGSILFIVSCLVKGLVDSVSDSFFPGLSVCKTCSIGSINGFEIESHKCYCSLFCCPYCRHCSADREIHQLHLSICKKRKTGSNVMLAVCKRMCFKATIEASRRALLIRSIINTTFVICILTLAICVVSTSAVEMEDLPAGTWEREEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLTCTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGSFFVGILLFLTPFVLLVLFFMFGWKILFCFKCCRRTRGLFKYRHLKDDEETGYRRIIERLNSKKGKNRLLDGERLADRKIAELFSTKTHIG

SEQ ID NO: 1250 - protein, 1688 aa, Artificial Sequence
  derived and/or modified protein sequence (wt) from CCHFV(81-R-2014)__KR814865.1__GP
MPTNIMHTLLVCFILYLQLLGLGGAHGQSNATEHNGTNTTTVPSTSQSPKPLVSTTPPHALESSTIKPTTPTSETEGSGETAPLPNTTQGPPPPETTPERPATTVTSTPSTDNTNSTIHVTDNNPTSTISTSPSSSPSTPSTPQGIHHPARSLLSVSSPKTATTPTPTSPGEINSETSSLHSAMSRTPTLHTATQVSTENANHSAPRQSESSAQPTTTSLMTSPAQSILLMSAAPTAIQNTHPSPTNRSKRNLEMEIILTLSQGLKKYYGKILKLLHLTLEEDTEGLLEWCKRNLGSNCDDDFFQKRIGEFFMTGEGYFNEVLQFKTLSTLSPTEPSHARLPTVEPFKSYFAKGFLSIDSGYFSAKCYPRSSTSGLQLINVTQHPARIAETPGPKTTSLKTINCINLRASVFKEHREIEINVLLPQIAVNLSNCHVVINSHVCDYSLDTDGPVRLPHIYHEGTFIPGTYKIVIDKKNKLNDRCTLVTNCVIKGREVRKGQSVLRQYKTEIKIGKASTGSRKLLSEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVGHGKTIETYQTREGFTSICLFMLGSILFLVSCLVKGLVDSVSDSFFPGLSVCKTCSIGSINGFEIESHKCYCSLFCCPYCRHCSADREIHQLHLSICKKRKTGSNVMLAVCKRMCFRATIEASRRALLIRSIINTTFVICILTLTICVVSTSAVEMENLPAGTWEREEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRINGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEEDTQKCVDTRLEQPQSILIEHKGTIIGKQNDTCTAKASCWLESVKSFFYGLKNMLGSVFGNFFIGILLFLAPFVLLVLFFMFGWKILFCFKCCRRTRGLLKYRHLKDDEETGYRRIIERLNNKKGKNRLLDGERLADRKIAELFSTKTHIG

SEQ ID NO: 1251 - protein, 1688 aa, Artificial Sequence
  derived and/or modified protein sequence (wt) from CCHFV(75-ST-2010)__KR814864.1__GP
MPTNIMHTLLVCFILYLQLLGPGGAHGQPNATEHNRTNTTTAPSTSQSPKPPVSTAPPHALESPTIKSTTPTSETEGSGETTPPPNTTQGPSLPETTPERPATTATSTPSTDNTNSTTHVTDNNPTSTISTSPSSSPSTPSTPRGIHHPARNLLSVSSPKTATTPTPTSPGEISSETSSLHSAMSRTSTLYTATQASTENANHSAPRQSESPAQPTTTSLMTSPAQSILVMSAAPTAIQNIHPSPTNRSKRNLEMEIILTLSQGLKKYYGKILKLLHLTLEEDTEGLLEWCKRNLGSNCDDDFFQKRIEEFFMTGEGYFNEVLQFKTLSTLSPTEPSHARPPTVEPFKSYFAKGFLSIDSGYFSAKCYPRSSTSGLQLINVTQHPARIAETPGPKTTSLKTINCINLRASVFKEHREIEINVLLPQIAVNLSNCHVVINSHVCDYSLDTDGPVRLPHIYHEGTFIPGTYKIVIDKKNKLNDRCTLVTNCVIKGREVRKGQSVLRQYKTEIKIGKVSTGSRKLLSEESGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCLFCKALFYSLIIIGTLGKKIKQYRELRPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVGHGKTIETYQTREGFTSICLFMLGSILFLVSCLVKGLVDSVSDSFFPGLSVCKTCSIGSINGFEIESHKCYCSLLCCPYCRHCSADREIHQLHLSICKKRKTGSNVMLAVCKRMCFRATIEASRRALLIRSIINTTFVICILTLTICVVSTSAVEMENLPSGTWEKEEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEEDTQKCVDTKLEQPQSILIEHKGTIIGKQNDTCTAKASCWLESVKSFFYGLKNMLGSVFGNFFIGILLFLAPFVLLVLFFMFGWKILFCFKCCRRARGLLKYRHLKDDEETGYRKIIERLNNKKGKNRLLDGERLADRKIAELFSTKTHIG

SEQ ID NO: 1252 - protein, 1688 aa, Artificial Sequence
  derived and/or modified protein sequence (wt) from CCHFV(75-R-2012)__KR814863.1__GP
MPTNIMHTLLVCFILYLQLLGLGGAHRQSNATGHNGTNTTTAPSTSQSPKPLVSTAPPHALESSIIKHTTPVSETEGSGETTPPPNTTQGPSPLETTPERPATTATSTPSTDNTNSTTHVTDNNPTSTISTSPSSSPSTPSTPQGIHHPARNLLSVSSLKTATTPTPTSPGEISSETSSLHSAMSRTSTLYTATQVSTENANHSAPRQSESSAQQTTTSPMTSPAQSILVMSAAPTAIQNTHPSPTNRSKRNLEMEIILTLSQGLKKYYGKILKLLHLTLEEDTEGLLEWCKRNLGSNCDDDFFQKRIEEFFMTGEGYFNEVLQFKTLSTQSPTEPSHARPPTVEPFKSYFAKGFLSIDSGYFSAKCYPRLSTSGLQLINVTQHPARIAETPGPKTTSLKTINCINLRASVFKEHREIEINVLLPQIAVNLSNCHVVINSHVCDYSLDTDGPVRLPHIYHEGTFIPGTYKIVIDKKNKLNDRCTLVTNCVIKGREVRKGQSVLRQYKTEIKIGKASTGSRKLLSEEPGDDCISRTQLLRTETAEIHDDNYGGPGDKITICNGSTIVDQRLGSELGCYTINRVKSFKLCENSATGKTCEIDSAPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVGHGKTIETYQTREGFTSICLFMLGSILFLVSCLVKGLVNSVSDSFFPGLSVCKTCSIGSINGFEIESHKCYCSLFCCPYCRHCSADREIHQLHLSICKKRKTGSNVMLAVCKRMCFRATIEASRRALLIRSIINTTFVICILTLTICVVSTSAVEMENLPSGTWEREEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEEDTQKCVDTKLEQPQSILIEHKGTIIGKQNDTCTAKASCWLESVKSFLYGLKNMLGSVFGNFFIGILLFLAPFVLLVLFFMFGWKILFCFKCCRRTRGLLKYRLLKDDEETGYRRIIERLNNKKGKNRLLDGERLADRKIAELFSTKTHIG

SEQ ID NO: 1253 - protein, 1688 aa, Artificial Sequence
  derived and/or modified protein sequence (wt) from CCHFV(52-R-2014)__KR814862.1__GP
MPTNIMHTLLVCFILYLQLLGLGGAHRQSNATEHNGTNTTTAPSTSQSPKPPVSTAPPHAPESSTIKPTTPASETEGSGETTPPPNTTQGPSPPEATPERPATTATSTPSTDNTNSTTHATDNNPTSTISTSPSSSPSTPSTPQGIHHPARNLLSVSSPKTATTPTPTSPGDISSETSSLHSAMSRTPTLHTATQASTENANHSAPRQSESSAQQTTTSPMTSPAQPILVMSAAPTAIQNIHPSPTNRSKRNLEMEIILTLSQGLKKYYGKILKLLHLTLEEDTEGLLEWCKRNLGSNCDDDFFQKRIEEFFMTGEGYFNEVLQFKTLSTLSPTEPSHARPPTVEPFKSYFAKGFLSIDSGYFSAKCYPRLSTSGLQLINVTQHPARIAETPGPKTTSLKTINCINLRASVFKEHREIEINVLLPQIAVNLSNCHVVINSHVCDYSLDTDGPVRLPHIYHEGTFIPGTYKIVIDKKNKLNDRCTLVTNCVIKGREVRKGQSVLRQYKTEIKIGKASTGSRKLLSEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDTSCEVMIPKGTGDILVDCSGGQQHFLKDNLIDLGCPHVPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVGHGKTIETYQTREGFTSVCLFMLGSILFLVSCLVKGLVDSVSDSFFPGLSVCKTCSIGSINGFEIESHKCYCSLFCCPYCRHCSADREIHQLHLSICKKRKMGSNVMLAVCKRMCFRATIEASRRALLIRSIINTTFVICILTLTICVVSTSAVEMENLPSGTWEREEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVDDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSNDPDVVAASTSLMARKLEFGTDSTFKAFSAMPKTSLCFYIVEREYCKSCSEEDTQKCVDTKLEQPQSILIEHKGTIIGKQNDTCTAKAGCWLESVKSFFYGLKNMLGSVFGNFFIGILLFLAPFVLLVLFFMFGWKILFCFKCCRRTRGLLKYRLLKDDEETGYRRIIERLNNKKGKNRLLDGERLADRKIAELFSTKTHIG

SEQ ID NO: 1254 - protein, 1688 aa, Artificial Sequence
  derived and/or modified protein sequence (wt) from CCHFV(47-ST-2013)__KR814861.1__GP
MPINIMHTLLACFILYLQLSGLGGAHGQSNATEHNGTNTTTVPGTSQSPKPPASTTLPHTPESSTVKLTTPTSETEGSGETTPPPNTTQGLPPPGTTPERSATTATSTSSTDNMNSTTQMTGNTPTPTVNMSPSSSPSMPSTSQGIHYPVRSLLSVPSPKTATTPTPVSPGEMSPETSSQHSATSRIPTLYTATQVSTENTNRSTPRQSKSSVQPATQSPITPPAQTILLMSAAPKAIQDMHPSPTNRSKRNLEVEIILTLSQGLKKYYGKILKLLHLTLEEDTEGLLEWCKRNLGSNCDDDFFQKRIEEFFITGEGYFNEVLQFKTLSTLSPTEPSHVRLPTAEPFKSYYAKGFLSLDSGYFSAKCYPRSSTSGLQLINVTQHPARIAETPGPKTTSLKTINCINLRASVFKEHREVEINVLLPQIAVNLSNCHVVINSHVCDYPLDTDGPVRLPRIHHEGTFIPGTYKIVIDKKNKLNDRCSLVTNCVIKGREVRKGQSVLRQYKTEIKIGKASTGSRKLLSEEPGDDCISRTQLLKTETAEIHDDNYGGPGDKITICNGSTIVDQRLGSELGCYTINRVKSFKLCKNSATGKTCEIDSTPVKCRQGFCLKITQEGRGHVKLSRGSEVVLDACDSSCEIMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLTVSLSPVQSAPVGHGKTIETYQTREGFTSICLFMLGSILFIVSCLVKGLVDSVSDSFFPGLSVCRTCSIGSINGFEIESHKCYCSLFCCPYCRHCSADREIHQLHLSICKKRKTGSNVMLAVCKRMCFKATIEASRRALFIRSIINTTFVTCILTLAICVVSTSAVEMEDLPAGTWEREEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGECPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEVSGLKFASLACTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGNFFVGILLFLAPFVLLVLFFMFGWKILFCFKCCRRTRGLFKYRHLKDDEETGYRRIIERLNSKKGKNRLLDGERLADRKIAELFSTKTHIG

SEQ ID NO: 1255 - protein, 1688 aa, Artificial Sequence
  derived and/or modified protein sequence (wt) from CCHFV(46-ST-2012)__KR814860.1__GP
MPTNIMHTLLVCFILYLQLLGLGGAHGQSNATEHNGTNTTTVPSTSQSPKPLVSTTPPHALESSTIKPTTPTSETEGSGETAPLPNTTQGPPPPETTPERPATTVTSTPSTDNTSSTIHVTDNNPTSTISTSPSSSPSTPSTPQGIHHPARSLLSVSSPKTATTPTPTSPGEINSETSSLHSAMSRTPTLHTATQVSTENANHSAPRQSESSAQPTTTSLMTSPAQSILLMSAAPTAIQNIHPSPTNRSKRNLEMEIILTLSQGLKKYYGKILKLLHLTLEEDTEGLLEWCKRNLGSNCDDDFFQKRIEEFFMTGEGYFNEVLQFKTLSTLSPTEPSHARLPTVEPFKSYFAKGFLSVDSGYFSAKCYPRSSTSGLQLINVTQHPARIAETPGPKTTSLKTINCINLRASVFKEHREIEINVLLPQIAVNLSNCHVVINSHVCDYSLDTDGPVRLPHIYHEGTFIPGTYKIVIDKKNKLNDRCTLVTNCVIKGREVRKGQSVLRQYKTEIKIGKASTGSRKLLSEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVGHGKTIETYQTREGFTSICLFMLGSILFLVSCLVKGLVDSVSDSFFPGLSVCKTCSIGSINGFEIESHKCYCSLFCCPYCRHCSADREIHQLHLSICKKRKTGSNVMLAVCKRMCFRATIEASRRALLIRSIINATFVICILTLTICVVSTSAVEMESLPAGTWEREEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRINGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEEDTQKCVDTRLEQPQSILIEHKGTIIGKQNDTCTAKASCWLESVKSFFYGLKNMLGSVFGNFFIGILLFLAPFVLLVLFFMFGWKILFCFKCCRRTRGLLKYRHLKDDEETGYRRIIERLNNKKGKNRLLDGERLADRKIAELFSTKTHIG

SEQ ID NO: 1256 - protein, 1688 aa, Artificial Sequence
  derived and/or modified protein sequence (wt) from CCHFV(44-ST-2010)__KR814859.1__GP
MPINIMHTLLVCFILYLQLSGLGGAHGQSNATEHNGTNTTTVPGTSQSPKPPASTTLPHTPESSTVKLTTPTSETEGSGETTPPPNTTQGLPPPGTTPERPATTATSMSSTDNMNSTTQVTDNTPTSTVSISPSSSPSMPSTSQGIHYPVRSLLSVSSPKTVTTPTPMSPGEMSPETSSQHSAMSRIPTLYTATQVSTENTNRSTPRQSESSAQPATQSPTTSPTQTILLMSAAPKAIQDMHPSPTNRSKRNLEVEIILTLSQGLKKYYGKILKLLHLTLEEDTEGLLEWCKRNLGSNCDDDFFQKRIEEFFITGEGYFNEVLQFKTLSTLSPTEPSHVRLPTAEPFKSYFAKGFLSIDSGYFSAKCYPRSSTSGLQLINVTQHPARIAETPGPKTTSLKTINCINLRASVFKEHREVEINVLLPQIAVNLSNCHVVINSHVCDYSLDTDGPVRLPRIHHEGTFIPGTYKIVIDKKNKLNDRCSLVTNCVIKGREVRKGQSVLRQYKTEIKIGKASTGSRKLLSEEPGDDCISRTQLLKTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEIMIPKGTGDILVDCSGGQQHFLKDNLIDLGCPHIPLLGKMAIYICRMSNHPRTTMAFLLWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLTVSLSPVQSAPVGHGKTIETYQTREGFTNICLFMLGSILFIVSCLVKGLVDSVSDSFFPGLSVCKTCSFGSINGFEIESHKCYCSLFCCPYCRHCSADREIHQLHLGICKKRKTGSNVMLAVCKRMCFKATIEASRRALLIRSIINTTFVICILTLAICVVSTSAVEMENLPAGTWEREEDLTNFCHQECQVSETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRLNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEDDTKKCVDTKLDQPQSILIEHKGTIIGKQNDTCTAKASCWLESVKSFFYGLKNMLGSVFGNFFVGILLFLAPFVLLVLFFMCGWKILFCFKCCRRTRGLFKYRHLKDDEETGYRRIIERLNSKKGKNRLLDGERLADRKIAELFSTKSHIG

SEQ ID NO: 1257 - protein, 1688 aa, Artificial Sequence
  derived and/or modified protein sequence (wt) from CCHFV(37-R-2013)__KR814858.1__GP
MPTNIMHTLLVCFILYLQLLGLGGAHRQSNATEHNGTNTTTAPSTSQSPKPPVSTAPPHAPETSTIKPTTPASETEGSGETTPPPNTTQGPSPPEATPERPATTVTSTPSTDNTNSTTHATDNNPTSTISTSPSSSPSTPSTPQGIHHPARNLLSVSSPKTATTPTPTSPGDISSETSSLHSAMSRTPTLHTATQASTENANHSAPRQSESSAQQTTTSPMTSPAQPILVMSAAPTAIQNIHPSPTNRSKRNLEMEIILTLSQGLKKYYGKILKLLHLTLEEDTEGLLEWCKRNLGSNCDDDFFQKRIEEFFMTGEGYFNEVLQFKTLSTLSPTEPSHARPPTVEPFKSYFAKGFLSIDSGYFSAKCYPRLTTSGLQLINVTQHPARIAETPGPKTTSLKTINCINLRASVFKEHREIEINVLLPQIAVNLSNCHVVINSHVCDYSLDTDGPVRLPHIYHEGTFIPGTYKIVIDKKNKLNDRCTLVTNCVIKGREVRKGQSVLRQYKTEIKIGKASTGSRKLLSEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDTSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVGHGKTIETYQTREGFTSVCLFMLGSILFLVSCLVKGLVDSVSDSFFPGLSVCKTCSIGSINGFEIESHKCYCSLFCCPYCRHCSADREIHQLHLSICKKRKMGSNVMLAVCKRMCFRATIEASRRALLIRSIINTTFVICILTLTICVVSTSAVEMENLPSGTWEREEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVDDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSNDPDVVAASTSLMARKLEFGTDSTFKAFSAMPKTSLCFYIVEREYCKSCSEEDTQKCVDTKLEQPQSILIEHKGTIIGKQNVTCTAKASCWLESVKSFFYGLKNMLGSVFGNFFIGILLFLAPFVLLVLFFMFGWKILFCFKCCRRTRGLLKYRLLKDDEETGYRRIIERLNNKKGKNRLLDGERLADRKIAELFSTKTHIG

SEQ ID NO: 1258 - protein, 1688 aa, Artificial Sequence
  derived and/or modified protein sequence (wt) from CCHFV(36-ST-2014)__KR814857.1__GP
MPINIMHTLLVCFILYLQLSGLGGAHGQSNATEHNGTNTTTVPGTSQSPKPPASTTLPHTPESSTVKLTTPTSETEGSGETTPPPNTTQGLPPPGTTPERPATTATSMSSTDNMNSTTQVTDNTPTSTVSISPSSSPSMPSTSQGIHYPVRSLLSVSSPKTVTTPTPMSPGEMSPETSSQHSAMSRIPTLYTATQVSTENTNRSTPRQSESSAQPATQSPTTSPTQTILLMSAAPKAIQDMHPSPTNRSKRNLEVEIILTLSQGLKKYYGKILKLLHLTLEEDTEGLLEWCKRNLGSNCDDDFFQKRIEEFFITGEGYFNEVLQFKTLSTLSPTEPSHVRLPTAEPFKSYFAKGFLSIDSGYFSAKCYPRSSTSGLQLINVTQHPARIAETPGPKTTSLKTINCINLRASVFKEHREVEINVLLPQIAVNLSNCHVVINSHVCDYSLDTDGPVRLPRIHHEGTFIPGTYKIVIDKKNKLNDRCSLVTNCVIKGREVRKGQSVLRQYKTEIKIGKASTGSRKLLSEEPGDDCISRTQLLKTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEIMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLTVSLSPVQSAPVGHGKTIETYQTREGFTNICLFMLGSILFIVSCLVKGLVDSVSDSFFPGLSVCKTCSIGSINGFEIESHKCYCSLFCCPYCRHCSADREIHQLHLGICKKRKTGSNVMLAVCKRMCFKATIEASRRALLIRSIINTTFVICILTLAICVVSTSAVEMENLPAGTWEREEDLTNFCHQECQVSETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRLNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEDDTKKCVDTKLDQPQSILIEHKGTIIGKQNDTCTAKASCWLESVKSFFYGLKNMLGSVFGNFFVGILLFLAPFVLLVLFFMCGWKFLFCFKCCRRTRGLFKYRHLKDDEETGYRRIIERLNSKKGKNRLLDGERLADRKIAELFSTKSHIG

SEQ ID NO: 1259 - protein, 1688 aa, Artificial Sequence
  derived and/or modified protein sequence (wt) from CCHFV(24-R-2012)__KR814856.1__GP
MPTNIMHTLLVCFILYLQLLGLGGAHRQSNATEHNGTNTTTAPSTSQSPKPPVSTAPPHAPESSTIKPTTPASETEGSGETTPPPNTTQGPSPPEATPERTATTATSTPSTDNTNSTTHATDNNPTSTISTSPSSSPSTPSTPQGIHHPARNLLSVSSPKTATTPTPTSPGDISSETSSLHSAMSRTPTLHTATQASTENANHSAPRQSESSAQQTTTSPMTSPAQPILVMSAAPTAIQNIHPSPTNRSKRNLEMEIILTLSQGLKKYYGKILKLLHLTLEEDTEGLLEWCKRNLGSNCDDDFFQKRIEEFFMTGEGYFNEVLQFKTLSTLSPTEPSHARPPTVEPFKSYFAKGFLSIDSGYFSAKCYPRLSTSGLQLINVTQHPARIAETPGPKTTSLKTINCINLRASVFKEHREIEINVLLPQIAVNLSNCHVVINSHVCDYSLDTDGPVRLPHIYHEGTFIPGTYKIVIDKKNKLNDRCTLVTNCVIKGREVRKGQSVLRQYKTEIKIGKASTGSRKLLSEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDTSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVGHGKTIETYQTREGFTSVCLFMLGSILFLVSCLVKGLVDSVSDSFFPGLSVCKTCSIGSINGFEIESHKCYCSLFCCPYCRHCSADREIHQLHLSICKKRKMGSNVMLAVCKRMCFRATIEASRRALLIRSIINTTFVICILTLTICVVSTSAVEMENLPSGTWEREEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSNDPDVVAASTSLMARKLEFGTDSTFKAFSAMPKTSLCFYIVEREYCKSCSEEDTQKCVDTKLEQPQSILIEHKGTIIGKQNDTCTAKASCWLESVKSFFYGLKNMLGSVFGNFFIGILLFLAPFVLLVLFFMFGWKILFCFKCCRRTRGLLKYRLLKDDEETGYRRIIERLNNKKGKNRLLDGERLADRKIAELFSTKTHIG

SEQ ID NO: 1260 - protein, 1687 aa, Artificial Sequence
  derived and/or modified protein sequence (wt) from CCHFV(Oman-199809166)__KR864901.1__GP
MPVNTMHTLLVYAVFCLQLWSPGGTRGLSNETQHNETGITRAPEGSQGPSLPVSTASPIMSDPSITTLSASTSGLEGSGDTTPPAITQGPTLPETTPEPSTTTGTNAFSTAIANVSTQTVKDTPTPTVQTSPPSTPDASTIPQGTHHTARGLLSVTVTKPEEVPTPTGPEQASIETNSSRLATSKTPSPSPTAQVTTENSNPNTSRQLVLSTQPATSSPVTSPAQLNFVQSATTIAVQDAHPSPTNRSKRNLEMEVILTLSQGLRKYYGRILKLLDLTLEEDTEGLLEWCKRNLGLTCDDNFFQKRIEEFFLTGEGHFNEVLQFKTPSTLSPTESASVGLPTVEPFKSYFAKGFLSIDSGYFSAKCYPRASNSGLQLINVTQHSARIADTPGPKITNLKTINCINLKALVFKEHREIEINVLLPQVAVNLSNCHVHIKSHVCDYSLDIDGTVRLPRIHHEGTFIPGTYKIVIDKKNKQNDRCNLVTNCVIKGREVRKGQSVLRQYRTEIRIGKASSGSRRLLSEESGEDCISRTQLLRTETAEIHGDNYGGPGDKITICNGSTIVDQRLGSELGCYTINRVKSFKLCENSATGKSCEIDNTPVKCKQGFCLKITQEGRGHVKLSRDSEVVLDACDSSCEIMIPKGTGDILVDCSGGQQHFLKDNLIDLGCPNIPLLGKMAIYICRMSNHPKTTMAFLFWFSFGYVITCILCKVIFYLLIVVGTLGKKFKQYRELKPQTCTICETTPVNAIDAEMHDLNCSYNICPYCASRLTSDGLARHVMQCPKRKEKIEETELYLNLERIPWVVRKLLQVSESTGVALKRSSWLIVLLVLLTVSLSPVQSAPIGHGKTIETYQTREGYTSICLFVLGSILFIVSHLMKGLVDSVGNSFFPGLSICKTCSIGSINGFEIESHKCYCSLFCCPYCRHCSADKEIHKLHLSICKKRKAGSNVMLAVCKRMCFRATMEVSNKALLIRSVINTTFVVCILILAVCVVSTSAVEMESLPAGTWEREEDLTNFCHQECQVTETECLCPYEALVLRKPLFLDSIAKGMKNLLNSTSLETSLSIEAPWGAINVQSTFKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIVTLHPRIEEGFFDLMHVQKVLSASTVCKLQSCTHGVPGDLQVYHIGNLLKGDKVNGHLIHKVEPHFNTSWMSWDGCDLDYYCNMGDWPSCTYTGVTQHNHAAFVNLLNIETDYTKNFHFHSKRVTAHGDTPQLDLKARPNYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSKEDTQKCVNAKLERPQSILIEHKGTIIGKQNDTCTAKASCWLESVKSFFYGLKNMLSGIFGNVFIGIFLFLAPFILLILFFMFGWRILFCFKCCRRTRGLFKYRHLKDDEETGYRKIIERLNNKKGKNKLLDGERLADRKIAELFSTKTHIG

SEQ ID NO: 1261 - protein, 1687 aa, Artificial Sequence
  derived and/or modified protein sequence (wt) from CCHFV(Oman_812956)__KY362518.1__GP
MPVNTMHTLLVYAVFCLQLWSPGGTRGLSNETQHNETGITRAPEGSQGPSLPVSTASPIMSDPSITTLSASTSGLEGSGDTTPPAITQGPTLPETTPEPSTTTGTNAFSTAIANVSTQTVKDTPTPTVQTSPPSTPDASTIPQGTHHTARGLLSVTVTKPEEVPTPTGPEQASIETNSPRLATSKTPSPSPTAQVTTENSNPNTSRQLVLSTQPATSSPVTSPAQLNFVQSATTIAVQDAHPSPTNRSKRNLEMEVILTLSQGLRKYYGRILKLLDLTLEEDTEGLLEWCKRNLGLTCDDNFFQKRIEEFFLTGEGHFNEVLQFKTPSTLSPTESASVGLPTVEPFKSYFAKGFLSIDSGYFSAKCYPRASNSGLQLINVTQHSARIADTPGPKITNLKTINCINLKALVFKEHREIEINVLLPQVAVNLSNCHVHIKSHVCDYSLDIDGTVRLPRIHHEGTFIPGTYKIVIDKKNKQNDRCNLVTNCVIKGREVRKGQSVLRQYRTEIRIGKASSGSRRLLSEESGEDCISRTQLLRTETAEIHGDNYGGPGDKITICNGSTIVDQRLGSELGCYTINRVKSFKLCENSATGKSCEIDNTPVKCKQGFCLKITQEGRGHVKLSRDSEVVLDACDSSCEIMIPKGTGDILVDCSGGQQHFLKDNLIDLGCPNIPLLGKMAIYICRMSNHPKTTMAFLFWFSFGYVITCILCKVIFYLLIVVGTLGKKFKQYRELKPQTCTICETTPVNAIDAEMHDLNCSYNICPYCASRLTSDGLARHVMQCPKRKEKIEETELYLNLERIPWVVRKLLQVSESTGVALKRSSWLIVLLVLLTVSLSPVQSAPIGHGKTIETYQTREGYTSICLFVLGSILFIVSHLMKGLVDSVGNSFFPGLSICKTCSIGSINGFEIESHKCYCSLFCCPYCRHCSADKEIHKLHLSICKKRKAGSNVMLAVCKRMCFRATMEVSNKALLIRSVINTTFVVCILILAVCVVSTSAVEMESLPAGTWEREEDLTNFCHQECQVTETECLCPYEALVLRKPLFFDSIAKGMKNLLNSTSLETSLSIEAPWGAINVQSTFKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIVTLHPRIEEGFFDLMHVQKVLSASTVCKLQSCTHGVPGDLQVYHIGNLLKGDKVNGHLIHKVEPHFNTSWMSWDGCDLDYYCNMGDWPSCTYTGVTQHNHAAFVNLLNIETDYTKNFHFHSKRVTAHGDTPQLDLKARPNYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSKEDTQKCVNAKLERPQSILIEHKGTIIGKQNDTCTAKASCWLESVKSFFYGLKNMLSGIFGNVFIGIFLFLAPFILLILFFMFGWRILFCFKCCRRTRGLFKYRHLKDDEETGYRKIIERLNNKKGKNKLLDGERLADRKIAELFSTKTHIG

SEQ ID NO: 1262 - protein, 1687 aa, Artificial Sequence
  derived and/or modified protein sequence (wt) from CCHFV(Oman)__DQ211632.1__GP
MPVNTMHTLLVYAVFCLQLWSPGGTRGLSNETQHNETGITRAPEGSQGPSLPVSTASPIMSDPSITTPSASTSGLEGSGDTTPPAITQGPTPPETTPEPSTTTGTNAFSTAIANVSTQTVKDTPTPTVQTSPPSTPDASTIPQGTHHTARGLLSVTVTKPEEVPTPTGPEQASIETNSPRLATSKTPSPSPTAQVTTENSNPNTSRQLVLSTQPATSSPVTSPAQLIFVQSATTVAVQDAHPSPTNRSKRNLEMEVILTLSQGLRKYYGRILKLLDLTLEEDTEGLLEWCKRNLGLTCDDNFFQKRIEEFFLTGEGHFNEVLQFKTPSTLSSTESASVGLPTVEPFKSYFAKGFLSIDSGYFSAKCYPRASNSGLQLINVTQHSARIADTPGPKITNLKTINCINLKALVFKEHREIEINVLLPQVAVNLSNCHVHIKSHVCDYSLDIDGTVRLPRIHHEGTFIPGTYKIVIDKKNKQNDRCNLVTNCVIKGREVRKGQSVLRQYRTEIRIGKASSGSRRLLSEESGEDCISRTQLLRTETAEIHGDNYGGPGDKITICNGSTIVDQRLGSELGCYTINRVKSFKLCENSATGKSCEIDNTPVKCKQGFCLKITQEGRGHVKLSRDSEVVLDACDSSCEIMIPKGTGDILVDCSGGQQHFLKDNLIDLGCPNIPLLGKMAIYICRMSNHPKTTMAFLFWFSFGYVITCILCKVIFYLLIVVGTLGKKFKQYRELKPQTCTICETTPVNAIDAEMHDLNCSYNICPYCASRLTSDGLARHVMQCPKRKEKIEETELYLNLERIPWVVRKLLQVSESTGVALKRSSWLIVLLVLLTVSLSPVQSAPIGHGKTIETYQTREGYTSICLFVLGSILFIVSHLMKGLVDSVGNSFFPGLSICKTCSIGSINGFEIESHKCFCSLFCCPYCRHCSADKEIHKLHLSICKKRKAGSNVMLAVCKRMCFRATMEVSNKALLIRSVINTTFVVCILILAVCVVSTSAVEMESLPAGTWEREEDLTNFCHQECQVTETECLCPYEALVLRKPLFLDSIAKGMKNLLNSTSLETSLSIEAPWGAINVQSTFKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIVTLHPRIEEGFFDLMHVQKVLSASTVCKLQSCTHGVPGDLQVYHIGNLLKGDKVNGHLIHKVEPHFNTSWMSWDGCDLDYYCNMGDWPSCTYTGVTQHNHAAFVNLLNIETDYTKNFHFHSKRVTAHGDTPQLDLKARPNYGAGEVTVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSKEDTQKCVNAKLERPQSILIEHKGTIIGKQNDTCTAKASCWLESVKSFFYGLKNMLSGIFGNVFIGIFLFLAPFILLILFFMFGWRILFCFKCCRRTRGLFKYRHLKDDEETGYRKIIERLNNKKGKNKLLDGERLADRKIAELFSTKTHIG

SEQ ID NO: 1263 - protein, 1687 aa, Artificial Sequence
  derived and/or modified protein sequence (wt) from CCHFV(3820-ST-2007)__KR814868.1__GP
MPINIMHTLLVCFILYLQLSGLGGAHGQSNATEHNGTNTTTVPGTSQSPKPPASTTLPHTPESSTVKLTTPTSETEGSGETTPPNTTQGLPLPGTTPERSATTATSTSSTDNMNSTTQVTDNTPTSTVSISPSSSSSMPSTSQGIHHPVRSLLSVSSPKTVTTPTPMSPGEMSPETSSQHSAMSRVPTLYTATQISTENTDRSTPRQSESSVQPATQSPITSPAQTILLMSAAPKAIQDMHPSPTNRSKRNLEVEIILTLSQGLKKYYGKILKLLHLTLEEDTEGLLEWCKRNLGSNCDDDFFQKRIEEFFITGEGYFNEVLQFKTLSTLSPTEPSHVRLPTAEPFKSYFAKGFLSIDSGYFSAKCYPRSSTSGLQLINVTQHPARIAETPGPKTTSLKTINCINLRASVFKEHREVEINVLLPQIAVNLSNCHVVINSHVCDYSLDTDGPVRLPRIHHEGTFIPGTYKIVIDRKNKLNDRCSLVTNCVIKGREVRKGQSVLRQYKTEIKIGKTSTGSRKLLSEEPGDDCISRTQLLKTETAEIHDDNYGSPGDKITICNGSTIVDQRLGSELGCYTINRVKSFKLCENSATGKTCEIDSTPVKCRQGFCLKITQEGRGHVKLSRGSEVVLDACDSSCEIMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLAVSLSPVQSAPVGHGKTIETYQTREGFTSICLFMLGSILFIVSCLVKGLVDSVSDSFFPGLSVCKTCSIGSINGFEIESHKCYCSLFCCPYCRHCSADREIHQLHLSICKKRKTGSNVMLAVCKRMCFKATIEASRRALLIRSIINTTFVMCILTLAICVVSTSAVEMEDLPAGTWEREEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLTCTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGSFFVGILLFLAPFVLLVLFFMFGWKILFCFKCCRRTRGLFKYRHLKDDEETGYRRIIERLNSKKGKNRLLDGERLADRKIAELFSTKTHIG

SEQ ID NO: 1264 - protein, 1685 aa, Artificial Sequence
  derived and/or modified protein sequence (wt) from CCHFV(SR3)__AJ538199.1__GP
MHISLMYAVFCLQLCGLGKTNGPHNGTEHNNTHVMTTPDDSQSPEPPVSTALPVTPDPSTVTPSTPASGLEGSGEVYTSSPITTKGLSLPEATSEPPATTSVVTSSASDTDSSTQAAGDTPTPTVRTSLPSSPSTPSTSQGTHYPVRSLLSVTSPKPEETPTPSKSGKDDLATNSPHPATSRPTTPPTTAQKPTENNSHNTTEQLESLTHLATLGLMISPTQTVLPQSVTSIAIQDIHNSPTNRSKRNLDMEIILTLSQGLKKYYGKILKLLHLTLEEDTEGLLEWCKRNLGLDCDDTFFQKRIEEFFITGEGHFNEVLQFRTLGTLSTTESTHAGSPTVEPFKSYFAKGFLSIDSGYFSAKCYSRTSNSGLQLINVTRHSTRIADTPGPKITNLKTINCMNLKASVFKEHREVEINVLLPQVAVNLSNCHVAIKSHICDYSLDTDGAIRLPQIHHEGTFIPGTYKIVIDKKSRLNDRCTLFTNCVIKGREVRKGQSVLRQYKTEIRIGRASTGSRRLLSEESGDDCISRTQLLRTETAEVHGDNYGGPGDKITICNGSTVVDQRLGSELGCYTINRVRSFKLCENSATGKSCEIDSIPVKCKQGYCLKITQEGRGHVKLSRGSEVVLDVCDSSCEVMIPKGTGDILVDCSGGQQHFLKDNLVDLGCPKIPLLGKMAIYICRMSNHPKTTMAFLFWFSFGYVITCILCKAIFFLLIIFGTLGKRFKQYRELKPQTCTICETTPVNAIDAEMHDLNCSYNICPYCASRLTSDGLARHVTQCPRRKEKVEETELYLNLERIPWVVRKLLQVSESTGTVLKRSSWLIVLLVLFTVSLSPVQSAPIGHGKTIETYRVREEYTSICLFVLGSILFIVSFLMKGLVDGVGNIFFPGLSVCKTCSIGSINGFEIESHKCYCSLFCCPYCRHCSADGEIHQLHLSICKKRKTGSNVMLAVCKRMCFRATMEVSNKALFIRSIINTTFVMCILKGEFAAVKSIHPIEMESLPAGTWEREEDLTNFCHQECQVTETECLCPYEALVLRRPLFLDSIVKGMKNLLNSTSLETSLSIEAPWGAINVQSTYKPTVSTANIALSWSSVEHRGNKVLVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGSVTITLSEPRNIQQKLPPEIITLHPKIEEGFFDLMHVQKVLSASTVCKLQSCTHGVPGDLQVYHIGNLLKGDRVNGHLIHKIEQHFNTSWMSWDGCDLDYYCNMGDWPSCTYTGVTQHNHASFVNLLNIETDYTKTFHFHSKRVTAHGDTPQLDLKARPTYGAGEITVLVEVADMELHTKKIEISGLKFAGLTCTGCYACSSGISCKVRIHVDEPDELTVHVKSDDPDVVAASSSLMARKLEFGTDSTFKAFSAMPKTSLCFYIVEREYCKSCNKEDTQKCVNTKLEQPQSILIEHKGTIIGKQNNTCTAKASCWLESVKSFFYGLKNMLGGIFGNVFIGIFTFLTPFILLILFFMFGWRILFCFKCCRRTRGLFKYRHLKDDEETGYRKIIERLNNKKGKNRLLDGERLADRKIAELFSTKTHIG

SEQ ID NO: 1265 - protein, 1684 aa, Artificial Sequence
  derived and/or modified protein sequence (wt) from CCHFV(SPU 187/90)__KJ682814.1__GP
MHISLMYAVLCLQLCSLGETHRSHNEIGHNKTDVMTTPGDNLSSEQPVSTALSITPDPSTVTPTTPASGSEGSGEVYTSSPITTESLSLPETTPELPATTGIDSSSASGVDSSTQAAGGTSALTVRTSLPNSPSTPSTPQDTYHPVRILLSVTGPGPEETSTPSGSGKESSATSSLHPISDRLPTPPATAQGPTENNSHNATEHPKPLTQSATPGLMTSPTQIVHPQSATSITVQDTYPSPKNRSKRNLEMEIILTLSQGLKKYYGKILRLLRLTLEEDTEGLLEWCKRNLGLDCDDTFFQKRIEEFFITGEGHFNEVLQFKTPGTLSTTESTPAELPTAEPFKSYFAKGFLSIDSGYYSAKCYSGTSNSGLQLINITRHSTRIVDTPGPKITNLKTINCINLKASIFKEHREVEINVLLPQIAVNLSNCHVVIKSHVCDYSLDIDGTVRLPHIYHEGVFIPGTYKIVIDKKNKLNDRCTLFTNCVIKGREVRKGQSVLRQYKTEIRIGKASTGSRRLLSEEPSDDCISRTQLLRTETAEIHGDNYGGPGDKITICNGSTIVDQRLGSELGCYTINRVKSFKLCENSATGKSCEIDSVPVKCRQGYCLRITQEGRGHVKLSRGSEVVLDACDTSCEIMIPKGTGDILVDCSGGQQHFLKDNLIDLGCPKIPLLGKMAIYICRMSNHPKTTMAFLFWFSFGYVITCILCKAIFYLLIIIGTLGKRFKQYRELKPQTCTICETTPVNAIDAEMHDLNCSYNICPYCASRLTSDGLARHVTQCPKRKEKVEETELYLNLERIPWVVRKLLQVSESTGVALKRSSWLIVLLVLFTVSLSPVQSAPIGHGKTIEAYRAREGYTSICLFVLGSILFVVSCLMKGLVDSVGNSFFPGLSICKTCSIGSINGFEIESHKCYCSLFCCPYCRHCSADKEIHKLHLSICKKRKTGSNVMLAVCKRMCFRATMEVSNRALFIRSIINTTFVLCILILAVCVVSTSAVEMENLPAGTWEREEDLTNFCHQECQVTETECLCPYEALVLRRPLFLDSIVKGMKNLLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFVNLLNIETDYTKNFHFHSKRVTAHGDTPQLDLKARPTYGAGEITVLVEVADMELHTKKIEISGLKFASLTCTGCYACSSGISCKVRIHVDEPDELTVHVKSDDPDVVAASSSLMARKLEFGTDSIFKAFSAMPKTSLCFYIVEREHCKSCSEEDTKKCVNTKLEQPQSILIEHKGTIIGKQNSTCTAKTSCWLESVKSFFYGLKNMLSGIFGNVFIGIFLFLAPFILLILFFMFGWRILFCFKCCRRTRGLFKYRHLKDDEETGYRRIIERLNNKKGKNKLLDGERLADRRIAELFSTKTHIG

SEQ ID NO: 1266 - protein, 1684 aa, Artificial Sequence
  derived and/or modified protein sequence (wt) from CCHFV(SPU 48/90)__KJ682813.1__GP
MHISLMYAVLCLQLCGLGETHRSHNETGHNKTDVATTPGDNLSSEQLVSTALSITPDPSTVTPTTSASGLEGSGEVYTSSLITTESLSLLETTPKLPTTTGIDTSSASDVDSSTQAAGDTSALTVRTSPPSNPSTPSTPQDTHHPMRNLLSVTSPGPEETSTPSGSGKESPATSSPHPVSNRSQTPPATAQGPTEDNSYNATEHPEHLTQSATSGLMTSPTQIVHPQSATSITVQDTYPSPTNRSKRNLEMEIILTLSQGLKKYYGKILRLLRLTLEEDTEGLLEWCKRNLGLDCDDTFFQKRIEEFFITGEGHFNEVLQFKTPGTLSTTESTPAEPPTAEPFKSYFAKGFLSIDSGYYSAKCYSGTSNSGLQLINITRHSTKIADTPGPKITNLKTINCINLKASIFKEHREVEINVLLPQVAVNLSNCHVVIKSHVCDYPLDIDGTVRLPHIYHEGVFIPGTYKIVIDKKTKLNDRCTLFTDCVIKGREVRKGQSVLRQYKTEIRIGKTSTGSRRLLSEEPSDDCISRTQLLRTETAEIHGDNYGGPGDKITICNGSTIVDQRLGSELGCYTINRVKSFKLCENSATGKSCVIDSVPVKCRQGYCLRITQEGRGHVKLSRGSEVVLDACDTSCEIMIPKGTGDILVDCSGGQQHFLKDNLIDLGCPKIPLLGKMAIYICRMSNHPTTTMAFLFWFSFGYVITCILCKAIFYLLIIIGTLGKRFRQYRELKPQTCTICETTPVNAIDAEMHDLNCSYNICPYCASRLTSDGLARHVTQCPKRKEKVEETELYLNLERIPWVVRKLLQVSESTGVALKRSSWLIVLLVLFTVSLSPVQSAPIGHGKTIEAYRAREGYTSICLFVLGSILFVVSCLMKRLVDSVGNSFFPGLSICKTCSISSINGFEIESHKCYCSLFCCPYCRHCSADKEIHKLHLSICKKRKTGSNVMLAVCKRMCFRATMEVSDRALFIRSIINTTFVLCILILAVCVVSTSAVEMENLPAGTWEREEDLTNFCHQECQVTETECLCPYEALVLRKPLFRDSIVKGMKNLLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNRASFVNLLNIETDYTKNFHFHSKRVTAHGDTPQLDLKARPTYGAGEITVLVEVADMELHTKKIEISGLKFASLTCTGCYACSSGISCKVRIHVDEPDELTVHVKSDDPDVVAASSSLMARKLEFGTDSTFKAFSAMPKTSLCFYIVEKEYCKSCSEEDTKKCVNTKLEQPQSILIEHKGTIIGKQNSTCTAKVSCWLESAKSFFYGLKDMLSGIFGNVFIGIFLFLAPFILLILFFMFGWRILLCFKCCRRTRGLFKYRHLKDDEETGYRRIIERLNNKKGKNKLLDGERLADRRIAELFSTKTHIG

SEQ ID NO: 1267 - protein, 1684 aa, Artificial Sequence
  derived and/or modified protein sequence (wt) from CCHFV(Sudan AB1-2009)__HQ378187.1__GP
MHISLIYAILCLQLCGLGETHGSHNETRHNKTDTITTPGDNLSSEPSVSTALSITPDPSTVTPTTPASGLEGSGEVYTSPPITTGSLPLPGTTPELPATTGTDTSSASDVDSSTQTAGGTFTLTVRTSLPRSPSTPSTPQDTHHPVRNLLSVTSPGPDETSTPSGTGKESPATSSPHPVSNRPPTPPATAQGPTENDSHNATEHPESLTQSATTGPMTSPTQIVHPQSATPITVQDTHPSPTNRSKRNLEMEIILTLSQGLKKYYGKILRLLHLTLEEDTEGLLEWCKRNLGLDCDDTFFQKRIEEFFITGEGHFNEVLQFRTPGTLSTTESTPAGLPTAEPFKSYFAKGFLSIDSGYYSAKCYSGTSNSGLQLINITRHSTRIVDTPGPKITNLKTINCINLKASIFKEHREVEINVLLPQVAVNLSNCHVVIKSHVCDYSLDIDGAVRLPHIYHEGVFIPGTYKIVIDKKNKLNDRCTLFTNCVIKGREVRKGQSVLRQYKTEVRIGKASTGSRRLLSEEPSDDCISRTQLLRTETAEIHGDNYGGPGDKITICNGSTIVDQRLGSELGCYTINRVKSFKLCENSATGKNCEIDSVPVKCRQGYCLRITQEGRGHVKLSRGSEVVLDACDTSCEIMIPKGTGDILVDCSGGQQHFLKDNLIDLGCPKIPLLGKMAIYICRMSNHPKTTMAFLFWFSFGYLITCILCKAIFYLLIIIGTLGKRLKQYRELKPQTCTICETTPVNAIDAEMHDLNCSYNICPYCASRLTSDGLARHVIQCPKRKEKVEETELYLNLERIPWVVRKLLQVSESTGVALKRSSWLIVLLVLFTVSLSPVQSAPIGQGKTIEAYRAREGYTSICLFVLGSILFIVSCLMKGLVDSVGNSFFPGLSICKTCSISSINGFEIESHKCYCSLFCCPYCRHCSTDKEIHKLHLSICKKRKTGSNVMLAVCKRMCFRATMEVSNRALFIRSIINTTFVLCILILAVCVVSTSAVEMENLPAGTWEREEDLTNFCHQECQVTETECLCPYEALVLRKPLFLDSIAKGMKNLLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFVNLLNIETDYTKNFHFHSKRVTAHGDTPQLDLKARPTYGAGEITVLVEVADMELHTKKIEISGLKFASLTCTGCYACSSGISCKVRIHVDEPDELTVHVKSDDPDVVAASSSLMARKLEFGTDSTFKAFSAMPKTSLCFYIVEREHCKSCNEEDTKKCVNTKLEQPQSILIEHKGTIIGKQNSTCTARASCWLESVKSFFYGLKNMLSGIFGNVFMGIFLFLAPFILLILFFMFGWRILFCFKCCRRTRGLFKYRHLKDDEETGYRRIIERLNNKKGKNKLLDGERLADRRIAELFSTKTHIG

SEQ ID NO: 1268 - protein, 1684 aa, Artificial Sequence
  derived and/or modified protein sequence (wt) from CCHFV(Sudan Al-Fulah 9-2008)__HQ378185.1__GP
MHISLMYAVLCLQLCGLGETHRSHNETVHNKTDIVTTPSDDLSSEQLVSTALSITPDPSTVTPTTSASGLEGSGEVYTSSPITTESLSQPETTPKLPATTGIDTSSASDVDSSTQAAGDTSTLTVRTSPPNSPSTPSTPQDTHHPMRNLLSVTSPGPEETSTPSGSGKESSATSSPHPVSNRPQTPPATAQGPTEDNSHNATEHPEHLTQSATSGPMTSPTQIVHPQSATTITVQDTYPSPTNRSKRNLEMEIILTLSQGLKKYYGKILRLLRLTLEEDTEGLLEWCKRNLGLDCDDTFFQKRIEEFFITGEGHFNDVLQFKTPGTLSTTESTPAKPPTAEPFKSYFAKGFLTIDSGYYSAKCYSGTSNSGLQLINITRHSTRIVDTPGPKITNLKTINCINLKASIFKEHREVEINVLLPQVAVNLSNCHVVIKSHVCDYPLDIDGTVRLPHIYHEGVFIPGTYKIVIDKKNKLNDRCTLFTDCVIKGREVRKGQSVLRQYKTEIRIGKASTGSRRLLSEEPSDDCISRTQLLRTETAEIHGDNYGGPGDKITICNGSTIVDQRLGSELGCYTINRVKSFKLCENSATGKSCVIDSVPVKCRQGYCLRITQEGRGHVKLSRGSEVVLDACDTSCEIMIPKGTGDILVDCSGGQQHFLKDNLVDLGCPKIPLLGKMAIYICRMSNHPKTTMAFLFWFSFGYVITCILCKAIFYLLIIIGTLGKRFRQYRELKPQTCTICETTPVNAIDAEMHDLNCSYNICPYCASRLTSDGLARHVTQCPKRKEKVEETELYLNLERIPWVVRKLLQVSESTGVALKRSSWLIVLLVLFTVSLSPVQSAPIGHGKTIEAYRAREGYTSICLFVLGSILFIVSCLMKGLVDSVGNSFFPGLSICKTCSISSINGFEIESHKCYCSLFCCPYCRHCSADKEIHKLHLSICKKRKTGSNVMLAVCKRMCFRATMEVSNRALFIRSIINTTFVLCILILAVCVVSTSAVEMENLPAGTWEREEDLTNFCHQECQVTETECLCPYEALVLRRPLFLDSIVKGMKNLLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFVNLLNIETDYTKNFHFHSKRVTAHGDTPQLDLKARPTYGAGEITVLVEVADMELHTKKIEISGLKFASLTCTGCYACSSGISCKVRIHVDEPDELTVHVKSDDPDVVAASSSLMARKLEFGTDSTFKAFSAMPKTSLCFYIVEKEYCKSCSEEDTKKCVNTKLEQPQSILIEHKGTIIGKQNSTCTAKVSCWLESAKSFFYGLKDMLSGIFGNVFIGIFLFLAPFVLLVLFFMFGWRILLCFRCCRRTRGLFKYRHLKDDEETGYRRIIERLNNKKGKNKLLDGERLADRKIAELFSTKTHIG

SEQ ID NO: 1269 - protein, 1684 aa, Artificial Sequence
  derived and/or modified protein sequence (wt) from CCHFV(SPU4/81)__DQ157175.1__GP
MHISLMYAVLCLQLCGLGETHGSYNETGHNKTDVMTTPGDNLSSEQPVSTALSITPDPSTVTPTTPANGLEGSGEVYTSSPITTESLSLPETTPELPATAGIDTSSASDVDSSTQAAGGTSAPTVRTSLPNSPSTPSTPQETHHPVRNLLSVTSLGPEETSTPSGPGKESSATSSPHPVSNKPPTPPARAQGPTENNSHNATEHPEPLTQSATPGLMTSPTQVVHPQSATSITVQDTYPSPTNRSKRNLETEIILTLSQGLKKYYGKILRLLRLTLEEDTEGLLEWCKRNLGLDCDDTFFQKRIEEFFITGEGHFNEVLQFKTPGTLSTTESTPAELPTAEPFKSYFAKGFLSIDSGYYSAKCYSGTSNSGLQLINITRHSTRIVDTPGPKITNLKTINCINLKASIFKEHREVEINVLLPQAAVNLSNCHVVIKSHVCDYSLDIDGTVRLPHIYHEGVFIPGTYKIVIDKKDKLNDRCTLFTDCVIKGREVRKGQSVLRQYKTEIRIGKASIGSRRLLSEEPSDDCISRTQLLRTETAEIHGDNYGGPGDKITICNGSTIVDQRLGSELGCYTINRVKSFKLCENSATGKSCEIESVPVKCRQGYCLRITQEGRGHVKLSRGSEVVLDACDTSCEIMIPKGTGDILVDCSGGQQHFLKDNLIDLGCPKIPLLGKMAIYICRMSNHPKTTMAFLFWFSFGYVITCILCKAIFYLLIIIGTLGKRFKQYRELKPQTCTICETTPVNAIDAEMHDLNCSYNICPYCASRLTSDGLARHVTQCPKRKEKVEETELYLNLERIPWVVRKLLQVSESTGVALKRSSWLIVLLVLFTVSLSPVQSAPIGHGKTIEAYRAREGYTSICLFVLGSILFIVSCLMKGLVDSVGNSFFPGLSICKTCSISSINGFEIESHKCYCSLFCCPYCRHCSADKEIHKLHLSICKKRKTGSNVMLAVCKRMCFRATMEVSNRALFIRSIINTTFVLCILILAVCVVSTSAVEMENLPAGTWEREEDLTNFCHQECQVTETECLCPYEALVLRKPLFLDSIVKGMKNLLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFVNLLNIETDYTKNFHFHSKRVTAHGDTPQLDLKARPTYGAGEITVLVEVADMELHTKKIEISGLKFASLTCTGCYACSSGISCKVRIHVDEPDELTVHVKSDDPDVVAASSSLMARKLEFGTDSTFKAFSAMPKTSLCFYIVEREHCKSCSEEDTKKCVNTKLEQPQSILIEHKGTIIGKQNSTCTAKASCWLESVKSFFYGLKNMLSGIFGNVFIGIFLFLGPFILLILFFMFGWRILFCFKCCRRTRGLLKYRHLKEDEETGYRRIIERLNNKKGKNKLLDGERLADRRIAELFSTKTHIG

SEQ ID NO: 1270 - protein, 1684 aa, Artificial Sequence
  derived and/or modified protein sequence (wt) from CCHFV(NIV 11703)__JN572086.1__GP
MHTSLIYVVLCLQLCSLGKTHGSHNGTEHNKTDVMTTPGDNQSPEPLVSTALPVTPDPSTVTPTAPASGLEGSGEVYTSSSITTKGLSLPKATSELLATTGMVTSSASDIDPSTQAAGDTPTPTVRTSLPNSPSTPSTSQDTHHPVRNLLSVTSPKPEETPTPSKSDKDSSATNSPHPAASRLSTPPTTDQGPTENNNHNSTEQLESLTRSATSSSMVSLTQTVLPQSATSIATQDTHPSPTNRSKRNLEMEIILTLPQGLKKYYGKILKLLHLTLEEDTEGLLEWCKRNLGLDCDDTFFQKRIEEFFITGEGHFNEVLQFRAPGTLSTTEPTHAGSPTAEPFKSYFAKGFLSIDSGYFSAKCYSRTSNSGLQLINVTRHSTRIADTPGPKITNLKTINCINLKASVFKEHREVEINVLLPQVAVNLSNCHVAIKSHVCDYSLDTDGAIRLPHIHYEGTFIPGTYKIVIDKKNKLNDRCTLFTNCVIKGREVRKGQSVLRQYKTEIRIGRASTGSRRLLSEESGDDCISRTQLLRTETAEVHGDNYGGPGDKITICNGSTVVDQRLGSELGCYTINRVKSFKLCENSATGKSCEIDSIPVKCRQGYCLKITQEGRGHVKLSRGSEVVLDACDSSCEVMIPKGTGDILVDCSGGQQHFLKDNLIDLGCPKIPLLGKMAIYICRMSNHPKTTMAFLFWFSFGYVITCILCKVIFYLLIIFGTLGKRFKQYRELKPQTCTICETTPVNAIDAEMHDLNCSYNICPYCASRLTSDGLARHVTQCPKRKEKVEETELYLNLERIPWVVRKLLQVSESTGIALKRSSWLIVLLVLFTVSITPVQSAPIGHGKTIEAYRAREEYTSICLFVLGSVLFVVSCLMKGLVDSVGNIFFPGLFICKTCSIGSINGFEIESHKCYCSLFCCPYCRHCSADREIHQLHLSICKKRKTGSNVMLAVCKRMCFRTTMEVSNKALFVRSIINTTFVVCILILAVCVVSTSAVEMESLPAGTWEREEDLTNFCHQECQVTETECLCPYEALVLRRPLFLDSIVKGMKNLLNSTSLETSLSIEAPWGAINVQSTYKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGSVTITLSEPRNIQQKLPPEIITLHPRIEEGFFDLMHVQKVLSASTVCKLQSCTHGVPGDLQVYHIGNLLKGDRVNGHLIHKIEQHLNTSWMSWDGCDLDYYCNMGDWPSCTYTGVTQHNHASFVNLLNIETDYTKTFHFHSKRVTAHGDTPQLDLKARPTYGAGEITVLVEVADMELHTKKIEISGLKFASLSCTGCYACSSGISCKVRIHVDEPDELTVHVKSDDPDVVAASSSLMARKLESGTDSTFKAFSAMPKTSLCFYIVEREYCKGCSKEDTQKCVNTKLEQPQSILIEHKGTIIGKQNNTCTAKASCWLESVKSFFYGLKNMLSGIFGNVFLGIFSFLAPFVLLILFFMFGWRILFCFKCCRRTRGLFKYRHLKDDEETGYRKIIERLNNKKGKNKLLDGERLADRKIAELFSTKTHIG

SEQ ID NO: 1271 - protein, 1684 aa, Artificial Sequence
  derived and/or modified protein sequence (wt) from CCHFV(NIV 112143)__JN572085.1__GP
MHTSLIYVVLCLQLCSLGKTHGSHNGTEHNKTDVMTTPGDNQSPEPLVSTALPVTPDPSTITPTAPASGLEGSGEVYTSSSITTKGLSLPKATSELLATTGMVTSSASDIDPSTQAAGDTPTPTVRTSLPNSPSTPSTSQDTHHPVRNLLSVTSPKPEETPTPSKSDKDSSATNSPHPAASRLSTPPTTDQGPTENNNHNSTEQLESLTRSATSSSMVSLTQTVLPQSATSIATQDTHPSPTNRSKRNLEMEIILTLPQGLKKYYGKILKLLHLTLEEDTEGLLEWCKRNLGLDCDDTFFQKRIEEFFITGEGHFNEVLQFRAPGTLSTTEPTHAGSPTAEPFKSYFAKGFLSIDSGYFSAKCYSRTSNSGLQLINVTRHSTRIADTPGPKITNLKTINCINLKASVFKEHREVEINVLLPQVAVNLSNCHVAIKSHVCDYSLDTDGAIRLPHIHYEGTFIPGTYKIVIDKKNKLNDRCTLFTNCVIKGREVRKGQSVLRQYKTEIRIGRASTGSRRLLSEESGDDCISRTQLLRTETAEVHGDNYGGPGDKITICNGSTVVDQRLGSELGCYTINRVKSFKLCENSATGKSCEIDSIPVKCRQGYCLKITQEGRGHVKLSRGSEVVLDACDSSCEVMIPKGTGDILVDCSGGQQHFLKDNLIDLGCPKIPLLGKMAIYICRMSNHPKTTMAFLFWFSFGYVITCILCKVIFYLLIIFGTLGKRFKQYRELKPQTCTICETTPVNAIDAEMHDLNCSYNICPYCASRLTSDGLARHVTQCPKRKEKVEETELYLNLERIPWVVRKLLQVSESTGIALKRSSWLIVLLVLFTVSITPVQSAPIGHGKTIEAYRAREEYTSICLFVLGSVLFVVSCLMKGLVDSVGNIFFPGLFICKTCSIGSINGFEIESHKCYCSLFCCPYCRHCSADREIHQLHLSICKKRKTGSNVMLAVCKRMCFRATMEVSNKALFVRSIINTTFVVCILILAICVVSTSAVEMESLPAGTWEREEDLTNFCHQECQVTETECLCPYEALVLRRPLFLDSIVKGMKNLLNSTSLETSLSIEAPWGAINVQSTYKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGSVTITLSEPRNIQQKLPPEIITLHPRIEEGFFDLMHVQKVLSASTVCKLQSCTHGVPGDLQVYHIGNLLKGDRVNGHLIHKIEQHLNTSWMSWDGCDLDYYCNMGDWPSCTYTGVTQHNHASFVNLLNIETDYTKTFHFHSKRVTAHGDTPQLDLKARPTYGAGEITVLVEVADMELHTKKIEISGLKFASLSCTGCYACSSGISCKVRIHVDEPDELTVHVKSDDPDVVAASSSLMARKLEFGTDSTFKAFSAMPKTSLCFYIVEREYCKGCSKEDTQKCVNTKLEQPQSILIEHKGTIIGKQNNTCTAKASCWLESVKSFFYGLKNMLSGIFGNVFLGIFSFLAPFVLLILFFMFGWRILFCFKCCRRTRGLFKYRHLKDDEETGYRKIIERLNNKKGKNKLLDGERLADRKIAELFSTKTHIG

SEQ ID NO: 1272 - protein, 1684 aa, Artificial Sequence
  derived and/or modified protein sequence (wt) from CCHFV(NIVA 118594)__JN572084.1__GP
MHTSLIYVVLCLQLCSLGKTHGSHNGTEHNKTDVMTTPGDNQSPEPLVSTALPVTPDPSTVTPTAPASGLEGSGEVYTSSSITTKGLSLPKATSELLATTGMVTSSASDIDPSTQAAGDTPTPTVRTSLPNSPSTPSTSQDTHHPVRNLLSVTSPKPEETPTPSKSDKDSSATNSPHPAASRLSTPPTTDQGPTENNNHNSTEQLESLTRSATSSSMVSLTQTVLPQSATSIATQDTHPSPTNRSKRNLEMEIILTLPQGLKKYYGKILKLLHLTLEEDTEGLLEWCKRNLGLDCDDTFFQKRIEEFFITGEGHFNEVLQFRAPGTLSTTEPTHAGSPTAEPFKSYFAKGFLSIDSGYFSAKCYSRTSNSGLQLINVTRHSTRIADTPGPKITNLKTINCINLKASVFKEHREFEINVLLPQVAVNLSNCHVAIKSHVCDYSLDTDGAIRLPHIHYEGTFIPGTYKIVIDKKNKLNDRCTLFTNCVIKGREVRKGQSVLRQYKTEIRIGRASTGSRRLLSEESGDDCISRTQLLRTETAEVHGDNYGGPGDKITICNGSTVVDQRLGSELGCYTINRVKSFKLCENSATGKSCEIDSIPVKCRQGYCLKITQEGRGHVKLSRGSEVVLDACDSSCEVMIPKGTGDILVDCSGGQQHFLKDNLIDLGCPKIPLLGKMAIYICRMSNHPKTTMAFLFWFSFGYVITCILCKVIFYLLIIFGTLGKRFKQYRELKPQTCTICETTPVNAIDAEMHDLNCSYNICPYCASRLTSDGLARHVTQCPKRKEKVEETELYLNLERIPWVVRKLLQVSESTGIALKRSSWLIVLLVLFTVSITPVQSAPIGHGKTIEAYRAREEYTSICLFVLGSVLFVVSCLMKGLVDSVGNIFFPGLFICKTCSIGSINGFEIESHKCYCSLFCCPYCRHCSADREIHQLHLSICKKRKTGSNVMLAVCKRMCFRTTMEVSNKALFVRSIINTTFVVCILILAVCVVSTSAVEMESLPAGTWEREEDLTNFCHQECQVTETECLCPYEALVLRRPLFLDSIVKGMKNLLNSTSLETSLSIEAPWGAINVQSTYKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGSVTITLSEPRNIQQKLPPEIITLHPRIEEGFFDLMHVQKVLSASTVCKLQSCTHGVPGDLQVYHIGNLLKGDRVNGHLIHKIEQHLNTSWMSWDGCDLDYYCNMGDWPSCTYTGVTQHNHASFVNLLNIETDYTKTFHFHSKRVTAHGDTPQLDLKARPTYGAGEITVLVEVADMELHTKKIEISGLKFASLSCTGCYACSSGISCKVRIHVDEPDELTVHVKSDDPDVVAASSSLMARKLESGTDSTFKAFSAMPKTSLCFYIVEREYCKGCSKEDTQKCVNTKLEQPQSILIEHKGTIIGKQNNTCTAKASCWLESVKSFFYGLKNMLSGIFGNVFLGIFSFLAPFVLLILFFMFGWRILFCFKCCRRTRGLFKYRHLKDDEETGYRKIIERLNNKKGKNKLLDGERLADRKIAELFSTKTHIG

SEQ ID NO: 1273 - protein, 1684 aa, Artificial Sequence
  derived and/or modified protein sequence (wt) from CCHFV(UCCR4448)__KY484042.1__GP
MHISLMYAVLCLQLCGLGETHGSHNETGHNKTDVMTTPGDNLSSEQPVSTALSITPDPSTVTPTTPASGLEGSGEVYTSPPIITESLSLPETTPELSATAGIDTSSASDVDSSTQAARGTSALTVRTSLPNSPSTPSTPQETHHPVRNLLSVTSPRPEETSTPSGSGKESSATSGPHPVSNKPPTPPAKTQGPTENNSHNATEHPEPLTQSATLGLMTSPTQIVHPQSATSITVQDTYPSPTNRSKRNLEMEIILTLSQGLKKYYGKILRLLRLTLEEDTEGLLEWCKRNLGLDCDDTFFQKRIEEFFITGEGHFNEVLQFKTPGTLSTTESTPAELPTAEPFKSYFAKGFLSIDSGYYSAKCYSGTSNSGLQLINITRHSARIVDTPGPKVTNLKTINCINLKASIFKEHREVEINVLLPQVAVNLSNCHVIIKSHVCDYSLDIDGTVRLPHIYHEGVFIPGTYKIVIDKKDKLNDRCTLFTDCVIKGREVRKGQSVLRQYKTEIRIGKASTGSRRLLSEETSDDCISRTQLLRTETAEIHGDNYGGPGDKITICNGSTIVDQRLGSELGCYTINRVKSFKLCENSATGKSCEIDSVPVKCRQGYCLRITQEGRGHVKLSRGSEVVLDACDTSCEIMIPKGTGDILVDCSGGQQHFLKDNLIDLGCPKIPLLGKMAIYICRMSNHPKTTMAFLFWFSFGYVITCILCKAIFYLLIIIGTLGKRFKQYRELKPQTCTICETTPVNAIDAEMHDLNCSYNICPYCASRLTSDGLARHVTQCPKRKEKVEETELYLNLERIPWVVRKLLQVSESTGVALKRSSWLIVLLVLFTISLSPVQSAPISHGKTIEAYRAREGYTSICLFVLGSILFIVSYLMKGLVDSVGNSFFPGLSICKTCSTSSINGFEIESHKCYCSLFCCPYCRHCSADKEIHKLHLSICKKRKTGSNVMLAVCKRMCFRATMEVSNRALFIRSIINTTFVLCILILAVCVVSTSAVEMENLPAGTWEREEDLTNFCHQECQVTETECLCPYEALVLRKPLFLDSIVKGMKNLLNSTSLETSLSIEAPWGAINVQSTYKPTVSTANIALSWSSVEHRGNKILVSGRSESIMKLEEKTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFVNLLNIETDYTKNFHFHSKRVTAHGDTPQLDLKARPTYGAGEITVLVEVADMELHTKKIEISGLKFASLTCTGCYACSSGISCKVRIHVDEPDELTVHVKSDDPDVVAASSSLMARKLEFGTDSTFKAFSAMPKTSLCFYIVEREHCKSCSEEDTKKCVNTKLEQPQSILIEHKGTIIGKQNSTCTAKASCWLESVKSFFYGLKNMLSGIFGNVFIGIFLFLAPFILLILFFMFGWKILFCFKCCRRTRGLFKYRHLKDDEETGYRRIIERLNNKKGKNKLLDGEILADRRIAELFSTKTHIG

SEQ ID NO: 1274 - protein, 1684 aa, Artificial Sequence
  derived and/or modified protein sequence (wt) from CCHFV(UCCR4401)__KY484035.1__GP
MHISLMYAILCLQLCGLGETHGSHNETRHNKTDTMTTPGDNPSSEPPVSTALSITLDPSTVTPTTPASGLEGSGEVYTSPPITTGSLPLSETTPELPVTTGTDTLSAGDVDPSTQTAGGTSAPTVRTSLPNSPSTPSTPQDTHHPVRNLLSVTSPGPDETSTPSGTGKESSATSSPHPVSNRPPTPPATAQGPTENDSHNSTEHPESLTQSATPGLMTSPTQIVHPQSATPITVQDTHPSPTNRSKRNLKMEIILTLSQGLKKYYGKILRLLQLTLEEDTEGLLEWCKRNLGLDCDDTFFQKRIEEFFITGEGHFNEVLQFRTPGTLSTTESTPAGLPTAEPFKSYFAKGFLSIDSGYYSAKCYSGTSNSGLQLINITRHSTRIVDTPGPKITNLKTINCINLKASIFKEHREVEINVLLPQVAVNLSNCHVVIKSHVCDYSLDIDGAVRLPHIYHEGVFIPGTYKIVIDKKNKLNDRCTLFTDCVIKGREVRKGQSVLRQYKTEIRIGKASTGSRRLLSEEPSDDCISRTQLLRTETAEIHGDNYGGPGDKITICNGSTIVDQRLGSELGCYTINRVRSFKLCENSATGKNCEIDSVPVKCRQGYCLRITQEGRGHVKLSRGSEVVLDACDTSCEIMIPKGTGDILVDCSGGQQHFLKDNLIDLGCPKIPLLGKMAIYICRMSNHPKTTMAFLFWFSFGYVITCILCKAIFYLLIIVGTLGKRLKQYRELKPQTCTICETTPVNAIDAEMHDLNCSYNICPYCASRLTSDGLARHVIQCPKRKEKVEETELYLNLERIPWVVRKLLQVSESTGVALKRSSWLIVLLVLFTVSLSPVQSAPIGQGKTIEAYRAREGYTSICLFVLGSILFIVSCLMKGLVDSVGNSFFPGLSICKTCSISSINGFEIESHKCYCSLFCCPYCRHCSTDKEIHKLHLSICKKRKTGSNVMLAVCKLMCFRATMEVSNRALFIRSIINTTFVLCILILAVCVVSTSAVEMENLPAGTWEREEDLTNFCHQECQVTETECLCPYEALVLRKPLFLDSTAKGMKNLLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFVNLLNIETDYTKNFHFHSKRVTAHGDTPQLDLKARPTYGAGEITVLVEVADMELHTKKIEISGLKFASLACTGCYACSSGISCKVRIHVDEPDELTVHVKSDDPDVVAASSSLMARKLEFGTDSTFKAFSAMPKTSLCFYIVEREHCKSCSEEDTKKCVNTKLEQPQSILIEHKGTIIGKQNSTCTAKASCWLESVKSFFYGLKNMLSGIFGNVFMGIFLFLAPFILLILFFMFGWRILFCFKCCRRTRGLFKYRHLKDDEETGYRRIIEKLNNKKGKNKLLDGERLADRRIAELFSTKTHIG

SEQ ID NO: 1275 - protein, 1684 aa, Artificial Sequence
  derived and/or modified protein sequence (wt) from CCHFV(IbAn7620)__KX013451.1__GP
MHISLIYAILCLQLCGLGETYGSHNETRHNKTDTMTTPGDNLSSEPPVSTALFITPDPSTVTPTTPASGLEGSGEVYTSPPITTGSLPLPETTPELPATTGTDTSSASDVDFSTQTAGGTSALTVRTGLPDSPSTPSTPQDTHHPMRNLLSVTSPGPDETSTPSGTGRESSATSSPHPVSNRPPTPPATAQGPTENDSHNATEHPESLTQSATPGLMTSPTQTIHPQSATPITVQDKQPSPTNRSKRNLEMEIILTLSQGLKKYYGKILRLLHLTLEEDTEGLLEWCKRNLGLDCDDNFFQKRIEEFFITGEGHFNEVLQFRTPGTLSTTESTPAGLPTAEPFKSYFAKGFLSIDSGYYSAKCYSGTSNSGLQLINITRHSTRIVDTPGPKITNLKTINCINLKASIFKEHREVEINVLLPQVAVNLSNCHVVIKSHVCDYSLDIDGAVRLPHIYHEGVFIPGTYKIVIDKKNKLNDRCTLFTDCVIKGREVRKGQSVLRQYKTEIRIGKASTGSRRLLSEEPSDDCISRTQLLRTETAEIHGDNYGGPGDKITICNGSTIVDQRLGSELGCYTINRVKSFKLCENSATGKNCEIDSVPVKCRQGYCLRITQEGRGHVKLSRGSEIVLDACDTSCEIMIPKGTGDILVDCSGGQQHFLKDNLIDLGCPKIPLLGKMAIYICRMSNHPKTTMAFLFWFSFGYVITCILCKAIFYLLIIIGTLGKRLKQYRELKPQTCTICETTPVNAIDAEMHDLNCSYNICPYCASRLTSDGLARHVIQCPKRKEKVEETELYLNLERIPWVVRKLLQVSESTGVALKRSSWLIVLLVLFTVSLSPVQSAPIGQGKTTEAYRAREGYTSICLFVLGSILFIVSCLMKGLVDSVGNSFFPGLSICKTCSISSINGFEIESHKCYCSLFCCPYCRHCSTDKEIHKLHLSICKKRKTGSNVMLAVCKRMCFRATMEVSNRALFIRSIINTTFVLCILILAVCVVSTSAVEMENLPAGTWEREEDLTNFCHQECQVTETECLCPYEALVLRKPLFLDSIAKGMKNPLNSTSLETSLSIEAPWGAIDVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFVNLLNIETDYTKNFHFHSKRVTAHGDTPQLDLKARPTYGAGEITVLVEVANMELHTKKIEISGLKFASLTCTGCYACSSGISCKVRIHVDEPDELTVHVKSDDPDVVAASSSLMARKLEFGTDSTFKAFSAMPKTSLCFYIVEREHCKSCSEEDTKKCVNTKLEQPQSILIEHKGTIIGKQNSTCTAKASCWLESVKSFFYGLKNMLSGIFGNVFMGIFLFLAPFILLILFFMFGWRILFCFKCCRRTRGLFKYRHLKDDEETGYRRIIERLNNKKGKNKLLDGERLADRRIAELFSTKTHIG

SEQ ID NO: 1276 - protein, 1684 aa, Artificial Sequence
  derived and/or modified protein sequence (wt) from CCHFV(Zahedan 2007)__KC867273.1__GP
MHISLMYAVFCLQLCGLGKTNGPHNGTEHNNTHVMTTPDDSQSPEPPVSTALPVTPDPSTVTPSTPASGLEGSGEVHTSSPITTKGLSLPEATSEPPSTTSVVTSSASDTDSSTQAAGDTPTPTVRTSLPSSPSTPSTSQGTHYPVRSLLSVTGPKPEETPTPSKSGKDNLATNSPHPATSRPTTPSTIAQKPTENNSHNTTEQLESLTHLATLGSKISPTQTVLPQSVTSIAIQDIHTSPTNRSKRNLDMEIILTLSQGLKKYYGKILKLLRLTLEEDTEGLLEWCKRNLGLDCDDTFFQKRIEEFFITGEGHFNEVLQFRTLGTLSTTESTHAGSPTVEPFKSYFAKGFLSIDSGYFSAKCYSRTSNSGLQLINVTRHSTRIADTPGPKITNLKTINCINLKASVFKEHREVEINVLLPQVAVNLSNCHVAIKSHICDYSLDTDGAIRLPQIHHEGTFIPGTYKIVIDKKSKLNDRCTLFTNCVIKGREVRKGQSVLRQYKTEIRIGRASTGSRRLLSEESGDDCISRTQLLRTETAEVHGDNYGGPGDKITICNGSTVVDQRLGSELGCYTINRVRSFKLCENSATGKSCEIDSIPVKCKQGFCLKITQEGRGHVKLSRGSEVVLDVCDSSCEVMIPKGTGDILVDCSGGQQHFLKDNLVDLGCPKIPLLGKMAIYICRMSNHPKTTMAFLFWFSFGYVITCILCKAIFFLLIIFGTLGKRFKQYRELKPQTCTICETTPVNAIDAEMHDLNCSYNICPYCASRLTSDGLARHVTQCPRRKEKVEETELYLNLERIPWVVRKLLQVSESTGTVLKRSSWLIVLLVLFTVSLSPVQSAPIGHGKTIETYRVREEYTSICLFVLGSILFIVSFLMKGLVDGVGNIFFPGLSVCKTCSIGSINGFEIESHRCYCSLFCCPYCRHCSADGEIHQLHLSICKKRKTGSNVMLAVCKRMCFRATMEVSNKVLFIRSIINTTFVVCILILAVCVVSTSAVEMESLPAGTWEREEDLTNFCHQECQVTETECLCPYEALVLRRPLFLDSIVKDMKNLLNSTSLETSLSIEAPWGAINVQSTYKPTVSTANIALSWSSVEHRGNKVLVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGSVTITLSEPRNIQQKLPPEIITLHPKIEEGFFDLMHVQKVLSASTVCKLQSCTHGVPGDLQVYHIGNLLKGDRVNGHLIHKIEQHFNTSWMSWDGCDLDYYCNMGDWPSCTYTGVTQHNHASFVNLLNIETDYTKTFHFHSKRVTAHGDTPQLDLKARPTYGAGEITVLVEVADMELHTKKIEISGLKFAGLTCTGCYACSSGISCKVRIHVDEPDELTVHVKSDDPDVVAASSSLMARKLEFGTDSTFKAFSAMPKTSLCFYIVEREYCKSCSKEDTQKCVNTKLEQPQSILIEHKGTIIGKQNNTCTAKASCWLESVKSFFYGLKNMLGGIFGNVFIGIFTFLTPFILLIFFFMFGWRILFCFKCCRRTRGLFKYRHLKDDEETGYRKIIERLNNKKGKNRLLDGERLADRKIAELFSTKTHIG

SEQ ID NO: 1277 - protein, 1684 aa, Artificial Sequence
  derived and/or modified protein sequence (wt) from CCHFV(Afg09-2990)__HM452306.1__GP
MHISLMYAVFCLQLCGLGKTNGPHNGTEHNNTHVMTTPDDSQSPEPPVSTALPVTPDPSTVTPSTPASGLEGSGEVYTSSPITTKGLSLPEATSEPPATTSVVTSSASDTDSSTQAAGDTPTPTVRTSLPSSPSTPSTSQGTHYPVRSLLSVTSPKPEETPTPSKSGKDNLATNSPHPATSRPTTPPTTAQKPTENNSHNTTEQLESLTHLATLGSMISPTQTVLPQSVTSIAIQDIHNSPTNRSKRNLDMEIILTLSQGLKKYYGKILKLLHLTLEEDTEGLLEWCKRNLGLDCDDTFFQKRIEEFFITGEGHFNEVLQFRTLGTLSTTESTHAGSPTVEPFKSYFAKGFLSIDSGYFSAKCYSRTSNSGLQLINVTRHSTRIADTPGPKITNLKTINCMNLKASVFKEHREVEINVLLPQVAVNLSNCHVAIKSHICDYSLDTDGAIRLPQIHHEGTFIPGTYKIVIDKKSKLNDRCTLFTNCVIKGREVRKGQSVLRQYKTEIRIGRASAGSRRLLSEESGDDCISRTQLLRTETAEVHGDNYGGPGDKITICNGSTVVDQRLGSELGCYTINRVRSFKLCENSATGKSCEIDSIPVKCKQGYCLKITQEGRGHVKLSRGSEVVLDVCDSSCEVMIPKGTGDILVDCSGGQQHYLKDNLVDLGCPKIPLLGKMAIYICRMSNHPKTTMAFLFWFSFGYVITCILCKAIFFLLIIFGTLGKRFKQYRELKPQTCTICETTPVNAIDAEMHDLNCSYNICPYCASRLTSDGLARHVTQCPRRKEKVEETELYLNLERIPWVVRKLLQVSESTGTVLKRSSWLIVLLVLFTVSLSPVQSAPIGHGKTIETYRVREEYTSICLFVLGSILFIVSFLMKGLVDGVGNIFFPGLSVCKTCSIGSINGFEIESHKCYCSLFCCPYCRHCSADGEIHQLHLSICKKRKTGSNVMLAVCKRMCFRATMEVSNKALFIRSIINTTFVVCILILAVCVVSTSAVEMESLPAGTWEREEDLTNFCHQECQVTETECLCPYEALVLRRPLFLDSIVKGMKNLLNSTSLETSLSIEAPWGAINVQSTYKPTVSTANIALSWSSVEHRGNKVLVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGSVTITLSEPRNIQQKLPPEIITLHPKIEEGFFDLMHVQKVLSASTVCKLQSCTHGVPGDLQVYHIGNLLKGDRVNGHLIHKIEQHFNTSWMSWDGCDLDYYCNMGDWPSCTYTGVTQHNHASFVNLLNIETDYTKTFHFHSKRVTAHGDTPQLDLKARPTYGAGEITVLVEVADMELHTKKIEISGLKFAGLTCTGCYACSSGISCKVRIHVDEPDELTVHVKSDDPDVVAASSSLMARKLEFGTDSTFKAFSAMPKTSLCFYIVEREYCKSCSKEDTQKCVNTKLEQPQSILIEHKGTIIGKQNNTCTAKASCWLESVKSFFYGLKNMLGGIFGNVFIGIFTFLTPFILLILFFMFGWRILFCFKCCRRTRGLFKYRHLKDDEETGYRKIIERLNNKKGKNRLLDGERLADRKIAELFSTKTHIG

SEQ ID NO: 1278 - protein, 1684 aa, Artificial Sequence
  derived and/or modified protein sequence (wt) from CCHFV(SPU41/84)__AY900142.1__GP
MHISLMYAVLCLQLCGLGETHGSHNGTRYNNTDATTTPGDSQSPEPPVSTASSITHNPSTVTSTTPTSGSEGSGEVYTSSPITTEGLSPPGTTPELPATTGIDTSGASDANPSTQAARGTSALTVHTSLPSSPSTPPISQDTHHPVRNLLSVTSPMPEETTAPSGSGKESSATSSPHPASDRPPTPPATAQGLTESNSHNATEHLESLTQSATPGLVTSPAQTVHPHSATSIAAPDTHPNPTNRSKRNLEMEIILTLSQGLKKYYGKILRLLHLTLEEDTEGLLEWCKRNLGLDCDDTFFQKRIEEFFITGEGHFNEVLQFRTPGTVSTTESTHAGPPTAEPFKSYFAKGSLSIDSGYYSAKCYSGTSNSGLQLINITRHSTKIADTPGPKITNLKTINCINLKALTFKEHREVEINVLLPQVAVNLSNCHVVIKSHVCDYSLDIDGTVRLPHIHHEGIFIPGTYKIVIDKKNKMNDRCTLFTNCVIKGREVRKGQSVLKQYKTEIRIGKASTGSRRLLSEESSDDCISRTQLLRTETAEIHGDNYGGPGDKITICNGSTVVDQRLGSELGCYTINRVKTFKLCENSATGKSCEIDSVPVKCRQGYCLKITQEGRGHVKLSRGSEVVLDACDTSCEVMIPKGTGDILVDCSGGQQHFLKDNLIDLGCPKIPLLGKMAIYICRMSNHPKTTMAFLFWFSFGYVITCIICKVIFYLLIIVGTLGKRFKQYRELKPQTCTICETTPVNAIDAEMHDLNCSYNICPYCASRLTSDGLARHVTQCPKRKEKVEETELYLNLERIPWVVRKLLQVSESTGVALKRSSWLVVLLVLLTVSLSPVQSAPISHGKTVEAYRAREGYTSMCLFVLGSVLFLVSCLMKGLVDSVGNTFFPGLSICKTCSISSINGFEIESHRCYCSLFCCPYCRHCSANKEIHQLHLSICKKRKAGSNVMLAVCKRMCFRATMEVSNRALFIRSIINTTFVLCILILAACVVSTSAVEMESLPAGTWEREEDLTNFCHQECQVADTECLCPYEALVLRRPLFLDSIVKGMKNLLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLVHKIEPHFNTSWMSWDGCDLDYYCNMGDWPSCTYTGVTQHNHASFVNMLNIETDYTKNFHFHSKRVTAHGDTPQLDLKARPTYGAGEITVLVEVADMELHTKKIEISGLKFTSLTCTGCYACSSGISCKVRIHVDEPDELTVHVKSEDPDVVAASSSLMARKLEFGTDSTFKAFSAMPKTSLCFYIVEREYCKSCSEEDTQKCVNTKLEQPQSILIERKGTIIGKQNNTCKAKAGCWLESVKSFFYGLKNMLSGIFGNVFIGIFLFLAPFILLILFFMFGWRILFCFKCCRRTRGLFKYRHLKDDEETGYRKIIERLNNKKGKNKLLDGERLADRRIAELFSTKTHIG

SEQ ID NO: 1279 - protein, 1684 aa, Artificial Sequence
  derived and/or modified protein sequence (wt) from CCHFV(SPU103/87)__DQ211634.1__GP
MHISLMYAVLCLQLCGLGGAHGSHNGTRYNNTGALTTLGDGQSSEPPVSTAPSTTHNPSTVTSTTPASGSEGSGEVYTASPVTTEGLSPPGTTPELPATTGIDTSGASDADPSTQAAGDTSALTVRTSLPSSPSTLPTSQDTHHPVRNLLSVTSPRPEETTAPSGSGIESSATSSPHPASDRPPTPPAAAQGPTESNSHNATEHLESLTQSATPDLVTSPAQTVHPQSATSIAAPDTHPSPTNRSKRNLEVEIILTLSQGLKKYYGKILRLLHLTLEEDTEGLLEWCKRNLGLDCDDTFFQKRIEEFFITGEGHFNEVLQFRTPGTVSTTESTHAGPPTAEPFKSYFAKGFLSIDSGYYSAKCYSGTSNSGLQLINITRHSTRIADTPGPKITNLKTINCINLKALTFKEHREVEINVLLPQVAVNLSNCHVVIKSHVCDYSLDIDGTVRLPHIHHEGIFIPGTYKIVIDKKNKLNDRCTLFTDCVIKGREVRKGQSVLKQYKTEIRIGKASTGSRRLLSEESSDDCISRTQLLRTETAEIHGDNYGGPGDKITICNGSTIVDQRLGSELGCYTINRVKTFKLCENSATGKSCEIDSVPVKCRQGYCLKITQEGRGHVKLSRGSEVVLDACDTSCEVMIPKGTGDILVDCSGGQQHFLKDNLIDLGCPKIPLLGKMAIYICRMSNHPKTTMAFLFWFSFGYVITCVLCKAIFYLLIIVGTLGKRLKQYRELKPQTCTICETTPVNAIDAEMHDLNCSYNICPYCASRLTSDGLARHVTQCPKRKEKVEETELYLNLERIPWVVRRLLQVSESTGVALKRSSWLIVLLVLFTVSLSPVQSAPISHGKTVEAYQAREGYTGMCLFVLGSILFLVSCLMKGLVDSVGNTFFPGLSICKTCSISSINGFEIESHRCYCSLFCCPYCRHCSANKEIHQLHLSICKKRKTGSNVMLAVCKRMCFRATMEVSNRALFIRSIINTTFVLCILILAVCVVSTSAVEMESLPAGTWEREEDLTNFCHQECQVTDTECLCPYEALVLRRPLFLDNIVKGMKNLLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKIEYIKTEAIVCVELTSQERQCSLIEAGTRFNLGPVTITLSEPRNIQQKLPSEIITLHPRIEEGFFDLMHVQKVLSASTVCKLQSCTHGVPGDLQVYHIGNLLKGDKVNGHLVHKIEPHFNTSWMSWDGCDLDYYCNMGDWPSCTYTGVTQHNHASFVNLLNIETDYTKNFHFHSKRVTAHGDTPQLDLKARPTYGAGEITVLVEVADMELHTKKIEISGLKFTSLTCTGCYACSSGISCKVRIHVDEPDELTVHVKSDDPDVVAASSSLMARKLEFGTDSTFKAFSAMPKTSLCFYIVEREYCKSCSEEDTQKCVNTKLEQPQSILIEHKGTIIGKQNNTCKARAGCWLESVKSFFYGLKNMLSGIFGNVFIGIFLFLAPFILLILFFMFGWRILFCFKCCRRTRGLFKYRHLKDDEETGYRKIIERLNNKKGKNKLLDGERLADRRIAELFSTKTHIG

SEQ ID NO: 1280 - protein, 1684 aa, Artificial Sequence
  derived and/or modified protein sequence (wt) from CCHFV(Iran-53)__DQ446216.1__GP
MHISLMYAVFCLQLCGLGKTNGPHNGTEHNNTHVMTTPDDSQSPEPPVSTALPVTPDPSTVTPSTPASGLEGSGEVYTSSPITTKGLSLPEATSEPPATTSVVTSSASDTDSSTQAAGGTPTPTVRTSLPSSPSTPSTSQGTHYPVRSLLSVTSPKPEETPTPSKSGKDNLATNSPHPATSRPTAPPTTAQKPTENNSHNTTEQLESLTHLATLGSMISPTQTVLPQSVTSIAIQDIHTSPTNRSKRNLDVEIILTLSQGLKKYYGKILKLLHLTLEEDTEGLLEWCKRNLGLDCDDTFFQKRIEEFFITGEGHFNEVLQFRTLGTLSTTESTHAGSPTVEPFKSYFAKGFLSIDSGYFSAKCYSRTSNSGLQLINVTRHSTRIADTPGPKITNLKTINCINLKASVFKEHREVEINVLLPQVAVNLSNCHVAIKSHICDYSLDTDGAIRLPQIHHEGTFIPGTYKIVIDKKSKLNDRCTLFTNCVIKGREVRKGQSVLRQYKTEIRIGRASTGSRRLLSEESGDDCISRTQLLRTETAEVHGDNYGGPGDKITICNGSTVVDQRLGSELGCYTINRVRSFKLCENSATGKSCEIDSIPVKCKQGYCLKITQEGRGHVKLSRGSEVVLDVCDSSCEVMIPKGTGDILVDCSGGQQHFLKDNLVDLGCPKIPLLGKMAIYICRMSNHPKTTMAFLFWFSFGYVITCILCKAIFFLLIIFGTLGKRFKQYRELKPQTCTICETTPVNAIDAEMHDLNCSYNICPYCASRLTSDGLARHVTQCPRRKEKVEETELYLNLERIPWVVRKLLQVSESTGTVLKRSSWLIVLLVLFTVSLSPVQSAPIGHGKTIETYRVREEYTSICLFVLGSILFIVSFLMKGLVDGVGNIFFPGLSVCKTCSIGSINGFEIESHKCYCSLFCCPYCRHCSADGEIHQLHLSICKKRKTGSNVMLAVCKRMCFRATMEVSNKALFIRSIINTTFVVCILILAVCVVSTSAVEMESLPAGTWEREEDLTNFCHQECQVTETECLCPYEALVLRRPLFLDSIVKGMKNLLNSTSLETSLSIEAPWGAINVQSTYKPTVSTANIALSWSSVEHRGNKVLVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGSVTITLSEPRNIQQKLPPEIITLHPKIEEGFFDLMHVQKVLSASTVCKLQSCTHGVPGDLQVYHIGNLLKGDRVNGHLIHKIEQHFNTSWMSWDGCDLDYYCNMGDWPSCTYTGVTQHNHASFVNLLNIETDYTKTFHFHSKRVTAHGDTPQLDLKARPTYGAGEVTVLVEVADMELHTKKIEISGLKFAGLTCTGCYACSSGISCKVRIHVDEPDELTVHVKSDDPDVVAASSSLMARKLEFGTDSTFKAFSAMPKTSLCFYIVEREYCKSCSKEDTQKCVNTKLEQPQSILIEHKGTIIGKQNNTCTAKASCWLESVKSFFYGLKNMLGGIFGNVFIGIFTFLTPFILLILFFMFGWRILFCFKCCRRTRGLFKYRHLKDDEETGYRKIIERLNNKKGKNRLLDGERLADRKIAELFSTKTHIG

SEQ ID NO: 1281 - protein, 1684 aa, Artificial Sequence
  derived and/or modified protein sequence (wt) from CCHFV(Iran-52)__DQ446215.1__GP
MHISLMYAVFCLQLCGLGKTNGPHNGTEHNNTHVMTTPDDSQSPEPPVSTALPVTPDPSTVTPSTPASGLEGSGEVYTSSPITTKGLSLPEATSEPPATTSVVTSSASDTDSSTQAAGDTPTPTVRTSLPSSPSTPSTSQGTHYPVRSLLSVTSPKPEETPTPSKSGKDDLATNSPHPATSRPTTPPTTAQKPTENNSHNTTEQLESLTHLATLGLMISPTQTVLPQSVTSIAIQDIHNSPTNRSKRNLDMEIILTLSQGLKKYYGKILKLLHLTLEEDTEGLLEWCKRNLGLDCDDTFFQKRIEEFFITGEGHFNEVLQFRTLGTLSTTESTHAGSPTVEPFKSYFAKGFLSIDSGYFSAKCYSRTSNSGLQLINVTRHSTRIADTPGPKITNLKTINCMNLKASVFKEHREVEINVLLPQVAVNLSNCHVAIKSHICDYSLDTDGAIRLPQIHHEGTFIPGTYKIVIDKKSKLNDRCTLFTNCVIKGREVRKGQSVLRQYKTEIRIGRASTGSRRLLSEESGDDCISRTQLLRTETAEVHGDNYGGPGDKITICNGSTVVDQRLGSELGCYTINRVRSFKLCENSATGKSCEIDSIPVKCKQGYCLKITQEGRGHVKLSRGSEVVLDVCDSSCEVMIPKGTGDILVDCSGGQQHFLKDNLVDLGCPKIPLLGKMAIYICRMSNHPKTTMAFLFWFSFGYVITCILCKAIFFLLIIFGTLGKRFKQYRELKPQTCTICETTPVNAIDAEMHDLNCSYNICPYCASRLTSDGLARHVTQCPRRKEKVEETELYLNLERIPWVVRKLLQVSESTGTVLKRSSWLIVLLVLFTVSLSPVQSAPIGHGKTIETYRVREEYTSICLFVLGSILFIVSFLMKGLVDGVGNIFFPGLSVCKTCSIGSINGFEIESHKCYCSLFCCPYCRHCSADGEIHQLHLSICKKRKTGSNVMLAVCKRMCFRATMEVSNKALFIRSIINTTFVVCILILAVCVVSTSAVEMESLPAGTWEREEDLTNFCHQECQVTETECLCPYEALVLRRPLFLDSIVKGMKNLLNSTSLETSLSIEAPWGAINVQSTYKPTVSTANIALSWSSVEHRGNKVLVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGSVTITLSEPRNIQQKLPPEIITLHPKIEEGFFDLMHVQKVLSASTVCKLQSCTHGVPGDLQVYHIGNLLKGDRVNGHLIHKIEQHFNTSWMSWDGCDLDYYCNMGDWPSCTYTGVTQHNHASFVNLLNIETDYTKTFHFHSKRVTAHGDTPQLDLKARPTYGAGEITVLVEVADMELHTKKIEISGLKFAGLTCTGCYACSSGISCKVRIHVEEPDELTVHVKSDDPDVVAASSSLMARKLEFGTDSTFKAFSAMPKTSLCFYIVEREYCKSCSKEDTQKCVNTKLEQPQSILIEHKGTIIGKQNNTCTAKASCWLESVKSFFYGLKNMLGGIFGNVFIGIFTFLTPFILLILFFMFGWRILFCFKCCRRTRGLFKYRHLKDDEETGYRKIIERLNNKKGKNRLLDGERLADRKIAELFSTKTHIG

SEQ ID NO: 1282 - protein, 1684 aa, Artificial Sequence
  derived and/or modified protein sequence (wt) from CCHFV(75024)__AB069671.1__GP
MHISLMCAVLCLQLYGLGETHGSSNETEHNKTNVVTTPGDSQSPEPLVSTTLPVTLDSSTVTPTTPASGPEGSGEVYTSPPITTEGLSPSEATSELPATTGIGISSASDVDSSTQAAGDTSTPTVRTSPPNSSSTPPTSQDTHHPMRNLLSVTSLKPEETSAPSKSGKESPAASSPHPVASRPPTPPTTAQGPIENNSHNTTGQLESVTQSATLGPMASPTQTVLSQNVTSIAIQDTHPSPTNRSKRNLEMEIILTLPQGLKKYYGKVLRLLQLTLEEDTEGLLEWCKRNLGLDCDDTFFQKRIEEFFITGEGHFNEVLQFRTPGTLSTTESTHAESPTAEPFKSYFAKGFLSIDSGYFSAKCYSRTSNSGLQLINVTRHSTRIADTPGPKITNLKTISCINLKASVFKEHREVEINVLLPQVAVNLSNCHVTIKSHVCDYSLDIDGTVRLPHIHHEGTFIPGTYKIVIDKKNKLNDRCTLFTNCVIKGREVRKGQSVLRQYKTEIRIGKASTGSRRLLSEESGDDCISRTQLLRTETAEIHGDNYGGPGDKITICNGSTIVDQRLGSEMGCYTINRVKSFKLCENSATGKSCEIDSIPVKCRQGYCLKITQEGRGHVKLSRGSEVVLDACDSSCEVMIPKGTGDILVDCSGGQQHFLKDNLIDLGCPSIPLLGKMAIYICRMSNHPKTTMAFLFWFSFGYVITCILCKAIFYLLIIVGTLGKRFKQYRELKPQTCTICETTPANAIDAEMHDLNCSYNICPYCASRLTSDGLARHVTQCPKRKEKVEETELYLNLERIPWVVRKLLQVSESTGVALKRSSWLIVLLVLFAISLSPVQSAPIGHGKTIETYQAREEYTSICLFVLGSILFIVSCLMKGLVDSIGNIFFPGLSICKTCSIGSINGFEIESHKCYCSLLCCPYCRHCSADREIHQLHLSICKKRKTGSNVMLAVCKRMCFRATMEVSNKALLIRSIINTTFVVCILILAVCVVSTSAVEMESLPAGTWEREEDLTNFCHQECQVTETECLCPYEALVLRRPLFLDSIVRGMKNQLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTTSTCLHKEWPHSRNWRCNPTWCWGVGTGCTCCGLDVKDLFTDYMIVKWKVEYIKTEAIVCVELTSQERQCSLIEAGTRFNLGSVTITLSEPRNIQQKLPPEIITLHPRIEEGFFDLMHVQKVLSASTVCKLQSCTHGVPGDLQVYHVGNLLKGDKVNGHLIHKIEPHLNTSWMSWDGCDLDYYCNMGDWPSCTYTGVTQHNHASFVNLLNIETDYTKSFHFHSKRVTAHGDTPQLDLKARPTYGAGEITVLVEVADMEFTPKKIEISGLKFASLTCTGCYACSSGISCKVRIHVDEPDELTVHVKSDDPDVVAASSSLMARKLEFGTDSTFKAFSAMPKTSLCFYIVEREYCKSCSKEDTQKCVNTKLEQPQSILIEHKGTIIGKQNNTCTAKASCWLESVKSFFYGLKNMLSGIFGNLFMGIFLFLAPFILLILFFMFGWRILFCFKCCRRTRGLFKYRHLKDDEETGYRRIIERLNNKKGKNKLLDGERLADRRIAELFSTKTHIG

SEQ ID NO: 1283 - protein, 1684 aa, Artificial Sequence
  derived and/or modified protein sequence (wt) from CCHFV(7803)__AB069672.1__GP
MHISLMCAVLCLQLYGLGETHGSSNETEHNKTNVVTTPGDSQSPEPLVSTTLPVTLDSSTVTPTTPASEPEGSGEVYTSPPITTEGLSPSEATSELPVTTGIGISSASDVDSSTQAAGDTSTPTVRTSPPNSPSTPPTSQDTHHPMRNLLSVTSLKSEETSAPSKSGKESPAASSPHPVASRPPTHPITAQGPTENNSHNTTGQLESVTQSATLGPMASPTQTVLSQNVTSIAIQDTHPSPTNRSKRNLEMEIILTLPQGLKKYYGKVLRLLQLTLEEDTEGLLEWCKRNLGLDCDDTFFQKRIEEFFITGEGHFNEVLQFRTPGTLSTTESTHAESPTAEPFKSYFAKGFLSIDSGYFSAKCYSRTSDSGLQLINVTRHSTRIADTPGPKITNLKTISCINLKASVFKEHREVEINVLLPQVAVNLSNCHVTIKSHVCDYSLDIDGTVRLPHIHHEGTFIPGTYKIVIDKKNKLNDRCTLFTNCVIKGREVRKGQSVLRQYKTEIRIGKASTGSRRLLSEESGDDCISRTQLLRTETAEIHGDNYGGPGDKITICNGSTIVDQRLGSEMGCYTINRVKSFKLCENSATGKSCEIDSIPVKCRQGYCLKITQEGRGHVKLSRGSEVILDACDSSCEVMIPKGTGDILVDCSGGQQHFLKDNLIDLGCPSIPLLGKMAIYICRMSNHPKTTMAFLFWFSFGYVITCILCKAIFYLLIIVGTLGKRFKQYRELKPQTCTICETTPANAIDAEMHDLNCSYNICPYCASRLTSDGLARHVTQCPKRKEKVEETELYLNLERIPWVVRKLLQVSESTGVALKRSSWLIVLLVLFAISLSPVQSAPISHGKTIETYQAREEYTSICLFVLGSILFIVSCLMKGLVDSIGNIFFPGLSICKTCSIGSINGFEIESHKCYCSLLCCPYCRHCSADREIHQLHLSICKKRKTGSNVMLAACKRMCFRATMEVSNKALLIRSIINTTFVVYILILAVCVVSTSAVEMESLPAGTWEREEDLTNFCHQECQVTETECLCPYEALVLRRPLFLDSIVRGMKNPLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTTSTCLHKEWPHSRNWRCNPTWCWGVGTGCTCCGLDVKDLFTDYMIVKWKVEYIKTRGIVCVELTSQERQCSLIEAGTRFNLGSVTITLSEPRNIQQKLPPEIITLHPRIEEGFFDLMHVQKVLSASTVCKLQSCTHGVPGDLQVYHVGNLLKGDKVNGHLIHKIEPHLNTSWMSWDGCDLDYYCNMGDWPSCTYTGVTQHNHASFVNLLNIETDYTKSFHFHSKRVTAHGDTPQLDLKARPTYGAGEITVLVEVADMEFTPKKIEISGLKFASLTCTGCYACSSGISCKVRIHVDEPDELTVHVKSDDPDVVAASSSLMARKLEFGTDSTFKAFSAMPKTSLCFYIVEREYCKSCSKEDTQKCVNTKLEQPQSILIEHKGTIIGKQNNTCTAKASCWLESVKSFFYGLKNMLSGIFGNFFMGIFLFLAPFILLILFFMFGWRILFCFKCCRRTRGLFKYRHLKDDEETGYRRIIERLNNKKGKNKLLDGERLADRRIAELFSTKTHIG

SEQ ID NO: 1284 - protein, 1684 aa, Artificial Sequence
  derived and/or modified protein sequence (wt) from CCHFV(Hodzha)__AY223476.1__GP
MHILLMCAVLCLQQYGLGETHRPNNGTEHNKTNVLTTPGDKLSPELPVSTALSVTPDSSTVTPTTPVSGLEGSGDVYTSPPVTTKGLSPSKATSELPASSGIDTSSASDVDSSTQAARDTSTLTVRTSPPSSPSTPPTSQDTYHLVRNLLSVTSPWPEETTAPSKSGKESPVANSPHPVTSRPSSPPITVQGPTENSSHNTTGQLESMAQSTTLVPMASPTQTVLSQSVTSLAVQDAHPSPTNRSKRNLEMVIILTLPQGLKKYYGKVLRLLQLTLEEDTEGLLEWCKRNLGLDCDDTFFQKRIEEFFITGEGHFNEVLQFKTPSTLSTTESTHAVSPTAEPFKSYFAKGFLSIDSGYFSAKCYSKTSNSGLQLINVTRHSTRIADTPGPKITNLKTISCINLKASVFKEHREVEINVLLPQVAVNLSNCHVTIKSHVCDYSLDVDGTVRLPHIHHGGTFIPGTYKIVIDKKNKLNDRCTLYTNCVIKGREVRKGQSILRQYKTEIRIGKASTGSRRLLSEESGDDCISRTQLLRTETAEIHGDDYGGPGDKITICNGSTIVDQRLGSELGCYTINRVKSFKLCKNSATGKSCEIDSTPVKCRQGYCLKITQEGRGHVKLSRGSEVVLDACDSSCEVMIPKGTGDILVDCSGGQQHFLKDNLIDLGCPRIPLLGKMAIYICRMSNHPKTTMAFLFWFSFGYVITCILCKAIFYLLIIVGTLGKRFKQYRELKPQTCTICETTPANAIDAEMHDLNCSYNICPYCASRLTSDGLARHVTQCPKRKEKVEETELYLNLERIPWIVRKLLQVSESTGVALKRSSWLIVLLVLFAVSLSPVQSAPIGHGKTIETYQAREDYTSICLFVLGSILFIVSCLMKGLVDSIGNIFFPGLTICKTCSIGSINGFEIESHKCYCSLLCCPYCRHCSADREIHQLHLSICKKRKTGSNVMLAVCKRMCFRATMEVSNKALLIRSIINTTFVVCILILAVCVVSTSAVEMESLPAGTWEREEDLTNFCHQECQVTETECLCPYEALVLRRPLFLDSIVKGTKNLLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVDYIKTEAIVCVELTSQERQCSLVEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFVNLLNIETDYTKSFHFHSKRVTAHGDTPQLDLKARPTYGAGEITVLVEVADMELHTKKIEITGLKFASLTCTGCYACSSGISCKVRIHVDEPDELTVHVKSDDPDVVAASSSLMARKLEFGTDSTFKAFSAMPKTSLCFYIVEREYCKSCSKEDTQKCVNTKLEQPQSILIERKGTIIGKQNNTCTAKASCWLESVKSFFYGLKNMLSGIFGNVFVGIFLFLAPFILLILFFMFGWRILFCFKCCRRTRGLFKYKHLKDDEETGYRRIIERLNNKKGKNKLLDGERLADRRIAELFSTKTHIG

SEQ ID NO: 1285 - protein, 1684 aa, Artificial Sequence
  derived and/or modified protein sequence (wt) from CCHFV(Hodzha)__KX013448.1__GP
MHILLMCAVLCLQQYGLGETHRPNNGTEHNKTNVLTTPSDKLSPEPPVSTALSVTPDSSTVTPTTPVSGLEGSGEVYTSPPVTTKGLSPSKATSELPATTGIDTSSASDVDSSTQAARDTSTLTVRTSPPSSPSTPPTSQDTYHLVRNLLSVTSPRPEETTAPSKSGKESPVANSPHPVTSRPSSPPITVQGPTENSSHNTTGQLESMAQSTTLVPMASPTQTVLSQSVTSLAVQDAHPSPTNRSKRNLEMEIILTLPQGLKKYYGKVLRLLQLTLEEDTEGLLEWCKRNLGLDCDDTFFQKRIEEFFITGEGHFNEVLQFKTPSTLSTTESTHAVSPTAEPFKSYFAKGFLSIDSGYFSAKCYSKTSNSGLQLINVTRHSTRIADTPGPKITNLKTISCINLKASVFKEHREVEINVLLPQVAVNLSNCHVTIKSHVCDYSLDVDGTVRLPHIHHGGTFIPGTYKIVIDKKNKLNDRCTLYTNCVIKGREVRKGQSILRQYKTEIRIGKASTGSRRLLSEESGDDCISRTQLLRTETAEIHGDDYGGPGDKITICNGSTIVDQRLGSELGCYTINRVKSFKLCENSATGKSCEIDSTPVKCRQGYCLKITQEGRGHVKLSRGSEVVLDACDSSCEVMIPKGTGDILVDCSGGQQHFLKDNLIDLGCPRIPLLGKMAIYICRMSNHPETTMAFLFWFSFGYVITCILCKAIFYLLIIVGTLGKRFKQYRELKPQTCTICETTPANAIDAEMHDLNCSYNICPYCASRLTSDGLARHVTQCPKRKEKVEETELYLNLERIPWIVRKLLQVSESTGVALKRSSWLIVLLVLFAVSLSPVQSAPIGHGKTIETYQAREEYTSICLFVLGSILFIVSCLMKGLVDSIGNIFFPGLTICKTCSIGSINGFEIESHKCYCSLLCCPYCRHCPADREIHQLHLSICKKRKTGSNVMLAVCKRMCFRATMEVSNKALLIRSIINTTFVVCILILAVCVVSTSAVEMESLPAGTWEREEDLTNFCHQECQVTETECLCPYEALVLRRPLFLDSIVKGKKNLLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCSERCGCTSSTCLHKEWPHSRNWRCNPTWCWGVGTGCTCCGLDVKDLFTDYMFVKWKVDYIKTEAIVCVELTSQERQCSLVEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFVNLLNIETDYTKSFHFHSKRVTAHGDTPQLDLKARPTYGAGEITVLVEVADMELHTKKIEITGLKFASLTCTGCYACSSGISCKVRIHVDEPDELTVHVKSDDPDVVAASSSLMARKLEFGTDSTFKAFSAMPKTSLCFYIVEREYCKSCSKEDTQKCVNTKLEQPQSILIEQKGTIIGKQNNTCTAKASCWLESVKSFFYGLKNMLSGIFGNVFVGIFLFLAPFILLILFFMFGWRILFCFKCCRRTRGLFKYKHLKDDEETGYRRIIERLNNKKGKNKLLDGERLADRRIAELFSTKTHIG

SEQ ID NO: 1286 - protein, 1684 aa, Artificial Sequence
  derived and/or modified protein sequence (wt) from CCHFV(Baghdad 12)__AJ538197.2__GP
MHISLIYAVLCLQLYGLGETHGSSSGTEHNRTNVVATPGGSQSPEPLVSTTLPVTLDSSTVTPATQASGPEGSGEVYTSPPTTTEGLSPSDATSELPTTTGIGISSSSDVNSSTQAAGDTSTPTARTSLPDSPSTPPTSQDTHHPMRNLLSVTSLKPEETPAPSKSGKESPAASSPHPVASRPPTPSTTAQGPTENNSRNTTVQLKSVTQSATLGPMASPTQTVLLQSVTSIAIQDTHPSPTNRSRRNLEMEIILTLPQGLKKYYGKVLRLLQLTLEEDTEGLLEWCKRNLGLDCDDTFFQKRIEEFFITGEGHFNEVLQFRTPGTLSTTESTHAGSPTVEPFKSYFAKGFLLIDSGYFSAKCYSRTSNSGLQLINVTRHSTKIADTPGPKITNLKTISCINLKASIFKEHREIEINVLLPQVAVNLSNCHVTIKSHVCDYSLNIDGTVKLPHIHHEGIFIPGTYKIVIDKKNKLNDRCTLFTNCVIKGREVRKGQSVLRQYKTEIRIGKASTGSRRLLSEESGDDCISRTRLLRTETAEIHGDSYGGPGDKITICNGSTIVDQRLGSEMGCYTINRVKSFKLCENSATGKSCKIDSIPVKCRQGYCLKITQEGRGHVKLSRGSEVVLDACDSSCEVMIPKGTGDILVDCSGGQQHFLKDNLIDLGCPNIPLLGKMAIYICRMSNHPKTTMAFLFWFSFGYVITCILCKAIFYLLIIVGTLGKRFKQYRELKPQTCTICETTPVNAIDAEMHDLNCSYNICPYCASRLTSDGLARHVTQCPKRKEKVEETELYLNLERIPWVVRKLLQVSESTGVALKRSSWLIVLLVLLAVSSSPVQSAPIGYGKTIETYQAREGYTSICLFVLGSILFIVSCLTKGLVDSIGNIFFPGLSICKTCSIGSINGFEVESHKCYCSLLCCPYCRHCSADREIHQLHLSICKKRKTGSSVMLAVCKRMCFRATMEVSNKALLIRSIINTTFVVCILTLAVCVVSTSAVEMESLPAGTWEREEDLTNFCHQECQVTETECLCPYEALVLRKPLFLDSIVKGTKNLLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTTSTCLHKEWPHSRNWRCNPTWCWGVGTGCTCCGLDVKDLFTDYMFVKWKVEYIKTDAIVCVELTSQERQCSLIEAGTRFNLGSVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFVNLLNIETDYTKSFHFHSKRVTAHGDTPQLDLKVRPTYGAGEITVLVEVADMELHTKKIEISGLKFASLTCTGCYACSSGISCKVRIHVDEPDELTVHVKSDDPDVVAASSSLMARKLEFGTDSTFKAFSAMPKTSLCFYIVEREYCKSCSKEDTQKCVNTKLEQPQSILIEHKGTIIGKQNNTCTAKTSCWLESVKSFFYGLKNMLSGIFGNFFMGIFLFLAPFILLILFFMFGWRILFCFKCCRRTRGLFKYRHLKDDEETGYRRIIERLNNKKGKNKLLDGERLADRRIAELFSTKTHIG

SEQ ID NO: 1287 - protein, 1684 aa, Artificial Sequence
  derived and/or modified protein sequence (wt) from CCHFV(TADJ/HU8966 )__AY179962.1__GP
MHMLLMCAVLCLQLYGLGGTLRSNNGTEHNKTNVLTTPGDKLSPEPPVSTALPVTPDSSTVTPTTPASGLEGSGEVYTSPPITTKGLSPSEATSEPPATTGMGISSASGVDFSTQAARDTSTLTVLTSPPNSPNTPPTSQDTHHPVRSLLSVTSPRPEETTAPSKSGKESPAANSSHPVTSRPSSPLITVRGPTENSSHNTTGQLESMTQSTTLVPMASPTQTVLSQSVTSIAVQDAHPSSTNRSKRNLEMEIILTLPQGLKKYYGKVLRLLQLTLEEDTEGLLEWCKRNLGLDCDDTFFQKRIEEFFITGEGHFNEVLQFRTPGTLSTTESTHAGSPTAEPFKSYFAKGFLSIDSGYFSAKCYSRTSNSGLRLINVTRHSTRIADTPGPKITNLKTISCINLRASIFKEHREVEINVLLPQVAVNLSNCHVAIKSHVCDYSLDVDGTVRLPHIHHGGTFIPGTYKIVIDKKNKLNDRCTLFTNCVIKGREVRKGQSILRQYKTEIRIGKASTGSRRLLSEESGDDCISRTQLLRTETAEIHGDDYGGPGDKITICNGSTIVDQRLGSELGCYTINRVKSFKLCENSATGKNCEIDSVPVKCRQGYCLKITQEGRGHVKLSRGSEVVLDACDSSCEVMIPKGTGDISVDCSGGQQHFLKDNLIDLGCPKIPLLGKMAIYICRMSNHPKTTMAFLFWFSFGYVITRILCKAIFYLLIIVGTLGKRFKQYRELKPQTCTICETTPANAIDAEMHDLNCSYNICPYCASRLTSDGLARHVTQCPKRKERVEETELYLNLERIPWIVRKLLQVSESTGVALKRSSWLIVLLVLFTVSLSPVQSAPIGYGNTIETYQAREEYTSICLFVLGSILFIVSCLMKGLVDSIGNIFFPGLTICKTCSIGSINGFEIESHKCYCSLLCCPYCRHCSADREIHQLHLSICKKRKTGSNVMLAVCKRMCFRATMEVSNKALLIRSIINTTFVVCILILAVCIVSTSAVEMESLPAGTWEREEDLTNFCHQECQVTETECLCPYEALVLRRPLFLDSIVKGMKNPLNSTSLETSLSIEAPWGAINVQSTYKPTVSTANIALSWSSIEHRGNNILVSGRSESIMKLEERTGISGDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFIDYMFVKWKVDYIKTEAIVCVELTSQERQCSLVEAGTRFNLGPVTITLSEPRNIQQKLPPEIITLHPRIEEGFFDLMHVQKVLSASTVCKLQSCTHGVPGDLQVYHIGNLLKGDKENGHLIHKIEPHFNTSWMSWDGCDLDYYCNMGDWPSCTYTGVTQHNHASFVNLLNIETDYTKSFHFHSKRVTAHGDTPQLDLKARPTYGAGEITVLVEVADMELHTKKIEITGLKFASLTCTGCYACSSGISCKVRIHVDEPDELTVHVKSDDPDVVAASSSLMARKLEFGTDSTFKAFSAMPKTSLCFYIVEREYRKSCSKEDTQKCVNTKLEQPQSILIEHKGTIIGKQNNTCTAKASCWLESVKSFFYGLKNMLSGIFGNVFVGIFLFLAPFILLILFFMFGWRILSCFKCCRRTRGLLKHRHLKDDEETGYRRIIERLNNKKGKNKLLDGERLADRRIAELFSTKTHIG

SEQ ID NO: 1288 - protein, 1684 aa, Artificial Sequence
  derived and/or modified protein sequence (wt) from CCHFV(K168_40)__KX013457.1__GP
MHISLMCAVLCLQLYGLGGTHGLHNGTEHNKTNAVTTSSNSQSSESPARTAPPVTPDSPTVTPTTPASAPEGSGEAHSSPPNNTEGPSLPESTSEPPAATSTGIPSASDVNSSTQAARDTSTPTVRTSPPNSPSTPPTPQETHHPVRNLLSVTSHKPEETSAPSESGKESPAANSPHPVASRPPTPSTTAQGPTENNNYNTTGQLESLTQSTTLGPMTSLTQTDLPQSVTSIAVQDTHPSPTNRSKRNLEMEIILTLPQGLKKYYGKVLRLLQLTLEEDTEGLLEWCKRNLGLDCDDTFFQKRIEEFFITGEGHFNEVLQFRTPGTLSTTESTHAGLPTAEPFKSYFAKGFLSIDSGYFSAKCYSRTSNSGLQLINVTRHSTRIADTPGPKITNLKTISCINLKASVFKEHREVEINVLLPQVAVNLSNCHVTIKSHVCDYSLDIDGTVRLPHIHHDGTFIPGTYKIVIDRKNKLNDRCTLFTNCVIKGREVRKGQSVLRQYKTEIRIGKASTGSRRLLSDESGDDCISRTQLLRTETAEIHGDNYGGPGDKITICNGSTIVDQRLGSELGCYTINRVKSFKLCENSATGKSCEVDSIPVKCRQGYCLKITQEGRGHVKLSRGSEVVLDACDSSCEVMIPKGTGDILVDCSGGQQHFLKDNLIDLGCPKIPLLGKMAIYICRMSNHPKTTMAFLFWFSFGYVITCIVCKAIFYLLIIVGTLGKRFKQYRELKPQTCTICETTPTNAIDAEMHDLNCSYNICPYCASRLTSDGLARHVTHCPKRKEKVEETELYLNLERIPWVVRKLLQVSESTGVALKRSSWLIVLLVLFAVSLSPVQSAPIGHGKTIETYQVREEYTSICLFVLGSILFIVSCLMKGLVNSVGNIFFPGLSICKTCSIGSINGFEIESHKCYCSLLCCPYCRHCSADREIHQLHLSICKKRKTGSNVMLAVCKRMCFRATVEVSNKALSIRSIINTTFVVCILILAVCVVSTSAVEMESLPAGTWEREEDLTNFCHQECQVTETECLCPYEALVLRRPLFLDGIVKGMKNLLNSTSLETSLSIEAPWGAINVQSTYKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFINLLNIETDYTKSFHFHSKRVTAHGDTPQLDLKARPNYGAGEITVLVEVADMELHTKKIEISGLKFASLTCTGCYACSSGISCKVRIHVDEPDELTVHVKSDDPDVVAASSSLMARKLEFGTDSTFKAFSAMPKTSLCFYIVEREYCKSCSKEDTQKCVNTKLEHPQSILIEHKGTIIGKQNNTCTAKTSCWLESVKSFFYGLKNMLSGIFGNVFVGIFLFLAPFILLILFFMFGWRILFCFKCCRRTRGLFRYKHLEDDEETGYRRIIERLNNKKGKNKLLDGERLADRRIAELFSTKTHIG

SEQ ID NO: 1289 - protein, 1684 aa, Artificial Sequence
  derived and/or modified protein sequence (wt) from CCHFV(K128_76)__KX013454.1__GP
MHISLMCAVLCLQLYGLGGTHGSHNETEHNKTNAVTTSSDSQSPEPPTRTTLPVTPDSPTVTPTTPASAPEGSGEVHTSPPNTTEGPSLPESTPEPPTATSTGIPSASDVNSSTQAARDTSTPTVHTSPPNSPSTPPTLQETHHPMRNLLSVTSHKPEETSAPSESGKESPAANSPHPVADRPSTSSTTAQGPTENNSYNTTEQLESLTQSTTLGPMTSLTQTVLSQSVTSIAVQDTHLSPTNRSKRNLEMEIILTLPQGLKKYYGKVLRLLQLTLEEDTEGLLEWCKRNLDLDCDDTFFQKRIEEFFITGEGYFNEVLQFRTPGTLSTTESTHAGLPTAEPFKSYFAKGFLSIDSGYFSAKCYSRTSNSGLQLINVTRHSTRIADTPGPKITNLKTISCINLKASVFKEHREVEINVLLPQVAVNLSNCHVTIKSHVCDYSLDIDGTVKLPHIHHDGTFIPGTYKIVIDRKNKLNDRCTLFTNCVIKGREVRKGQSVLRQYKTEIRIGKASTGSRRLLSDESGDDCISRTQLLRTETAEIHGDNYGGPGDKITICNGSTIVDQRLGSELGCYTINRVKSFKLCENSATGKSCEIDSIPVKCRQGYCLKITQEGRGHVKLSRGSEVVLDACDSSCEVMIPKGTGDILVDCSGGQQHFLKDNLIDLGCPKIPLLGKMAIYICRMSNHPKTTMAFLFWFSFGYVITCIVCKAIFYLLIIVGTLGKRFKQYRELKPQTCTICETTPTNAIDAEMHDLNCSYNICPYCASRLTSDGLARHVTHCPKRKEKVEETELYLNLERIPWVVRKLLQVSESTGVALKRSSWLIVLLVLFAVSLSPVQSAPISHGKTIETYQVREEYTSICLFVLGSILFIVSCLMKGLVNSVGNIFFPGLSICKTCSIGSINGFEIESHKCYCSLLCCPYCRHCSADREIHQLHLSICKKRKTGSNVMLAVCKRMCFRATMEVSNKALFIRSIINTTFVVCILILAVCVVSTSAVEMESLPAGTWEREEDLTNFCHQECQVTETECLCPYEALVLRRPLFQDSIVKGMKNLLNSTSLETSLSIEAPWGAINVQSTYKPAVSAANIALSWSSVEHRGSKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDRVNGHLIHKIEPHFNTSWMSWDGCDLDYYCNMGDWPSCTYTGVTQHNHASFVNLLNIETDYTKSFHFHSKRVTAHGDTPQLDLKARPNYGAGEITVLVEVADMELHTKKIEISGLKFASLTCTGCYACSSGISCKVRIHVDEPDELTVHVKSDDPDVVAASSSLMARKLEFGTDSTFKAFSAMPKTSLCFYIVEREYCKSCSKEDTQKCVNTKLEQPQSILIEHKGTIIGKQNNTCTAKTSCWLESVKSFFYGLKNMLSGIFGNVFVGIFLFLAPFILLILFFMFGWRILFCFKCCRRTRGLFRYKHLENDEETGYRRIIERLNNKKGKNKLLDGERLADRRIAELFSTKTHIG

SEQ ID NO: 1290 - protein, 1684 aa, Artificial Sequence
  derived and/or modified protein sequence (wt) from CCHFV(K168_125)__KX013460.1__GP
MHISLMCAVLCLQLYGLGGTHGLHNGTEHNKTNAVTTSSNSQSSESPARTAPPVTPDSPTVTPTTPASAPEGSGEAHSSPPNNTEGPSLPESTSEPPAATSTGIPSASDVNSSTQAARDTSTPTVRTSPPNSPSTPPTPQETHHPVRNLLSVTSHKPEETSAPSESGKESPAANSPHPVASRPPTPSTTAQGPTENNNYNTTGQLESLTQSTTLGPMTSLTQTDLPQSVTSIAVQDTHPSPTNRSKRNLEMEIILTLPQGLKKYYGKVLRLLQLTLEEDTEGLLEWCKRNLGLDCDDTFFQKRIEEFFITGEGHFNEVLQFRTPGTLSTTESTHAGLPTAEPFKSYFAKGFLSIDSGYFSAKCYSRTSNSGLQLINVTRHSTRIADTPGLKITNLKTISCINLKASVFKEHREVEINVLLPQVAVNLSNCHVTIKSHVCDYSLDIDGTVRLPHIHHDGTFIPGTYKIVIDRKNKLNDRCTLFTNCVIKGREVRKGQSVLRQYKTEIRIGKASTGSRRLLSDESGDDCISRTQLLRTETAEIHGDNYGGPGDKITICNGSTIVDQRLGSELGCYTINRVKSFKLCENSATGKSCEVDSIPVKCRQGYCLKITQEGRGHVKLSRGSEVVLDACDSSCEVMIPKGTGDILVDCSGGQQHFLKDNLIDLGCPKVPLLGKMAIYICRMSNHPKTTMAFLFWFSFGYVITCIVCKAIFYLLIIVGTLGKRFKQYRELKPQTCTICETTPTNAIDAEMHDLNCSYNICPYCASRLTSDGLARHVTHCPKRKEKVEETELYLNLERIPWVVRKLLQVSESTGVALKRSSWLIVLLVLFAVSLSPVQSAPIGHGKTIETYQVREEYTSICLFVLGSILFIVSCLMKGLVNSVGNIFFPGLSICKTCSIGSINGFEIESHKCYCSLLCCPYCRHCSADREIHQLHLSICKKRKTGSNVMLAVCKRMCFRATVEVSNKALSIRSIINTTFVVCILILAVCVVSTSAVEMESLPAGTWEREEDLTNFCHQECQVTETECLCPYEALVLRRPLFLDSIVKGKKNLLNSTSLETSLSIEAPWGAINVQSTYKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFINLLNIETDYTKSFHFHSKRVTAHGDTPQLDLKARPNYGAGEITVLVEVADMELHTKKIEISGLKFASLTCTGCYACSSGISCKVRIHVDEPDELTVHVKSDDPDVVAASSSLMARKLEFGTDSTFKAFSAMPKTSLCFYIVEREYCKSCSKEDTQKCVNTKLEHPQSILIEHKGTIIGKQNNTCTAKTSCWLESVKSFFYGLKNMLSGIFGNVFVGIFLFLAPFILLILFFMFGWRILFCFKCCRRTRGLFRYKHLEDDEETGYRRIIERLNNKKGKNKLLDGERLADRRIAELFSTKTHIG

SEQ ID NO: 1291 - protein, 1683 aa, Artificial Sequence
  derived and/or modified protein sequence (wt) from CCHFV(Kosova Hoti)__EU037902.1__GP
MHTLLVCFILYLQLLGLGGAHGQSNATEHNGTNTTTAPGTSQSPKPPASTTPSHAPEPSTIKLTTPTSETEGSGETTPPTNTTQDSPPLETTPERSATTATSTSGTDNMNSTTQMTDNTPTSTVSTSLSSSPSTPSTSQGMHHPVRSLLSVSSPKTATTPTPMSPGEMSSETSSQHSAMSRTPTPHTATQVSTENANRSTSRQSESSAQPATQSPVTSPAQSILLMSATPTTIQNIHPSPTNRSKRNLEMEIILTLSQGLKKYYGKILKLLHLTLEEDTEGLLEWCKRNLGSNCDDDFFQKRIEEFFITGEGYFNEVLQFKTLSTPSSTEPSHARLPTAEPFKSYFAKGFLSIDSGYFSAKCYPRSSTSGLQLINVTQHPARIAETPGPKTTSLKTINCINLRASVFKEHREVEINVLLPQIAVNLSNCHVVINSHVCDYSLDTDGPVRLPRIYHEGTFMPGTYKIVIDRKNKLNDRCTLVTNCVIKGREVRKGQSVLRQYKTEIKIGKAPTGSRKLLSEEPGDDCISRTQLLRTETAEIHDDNYGGPGDKITICNGSTIVDQRLGSELGCYTINRVKSFKLCENSATGKTCEIDSTPVKCRQGFCLKITQKGRGHVKLSRGSEVVLDACDSNCEVMIPKGTGDILVDCSGGQQHFLKDNLIDLGCPHIPLLGKMAIYICRMSNHPKTTMAFLFWFSFGYVITCIFCKALFYSLIIIGTLGKKIKQYRELKPQTCTICETAPVNAIDAEMHDLNCSYNICPYCASRLTSDGLARHVKQCPKRKEKVEETELYLNLERIPWVVRKLLQVSESTGVALKRSSWLIVLLVLLTVSLSPVQSAPVGHGKTIETYQTREGFTSICLFMLGSILFIVSCLVKGLVDSVSDSFFPGLSVCKTCSIGSINGFEIESHKCYCSLFCCPYCRHCSADREIHQLHLNICKKRKTGSNVMLAVCKRMCFRATIEASRRALLIRSIINTTFVICILTLTICVVSTSAVEMENLPAGTWEREEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGISWDLGVEDASESKLLTVSIMDLSQMYSPVFEYLSGDRQVEEWPKATCTGDCPQRCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAAGTSLMARKLEFGTDSTFKAFSAMPKTSLCFYIVEKEYCKSCSEDDTKKCVDTKLEQPQSILIEHRGTIIGKQNDTCTAKASCWLESVKSFFYGLKNMLGSVFGNFFIGILLFLAPFVLLVLFFMFGWKILFCFKCCRRTRGLFKYRHLKDDEETGYRRIIERLNNKKGKNRLLDGERLADRKIAELFSTKTHIG

SEQ ID NO: 1292 - protein, 1682 aa, Artificial Sequence
  derived and/or modified protein sequence (wt) from CCHFV(Oman)__DQ211632.1__GP
MHTLLVYAVFCLQLWSPGGTRGLSNETQHNETGITRAPEGSQGPSLPVSTASPIMSDPSITTPSASTSGLEGSGDTTPPAITQGPTPPETTPEPSTTTGTNAFSTAIANVSTQTVKDTPTPTVQTSPPSTPDASTIPQGTHHTARGLLSVTVTKPEEVPTPTGPEQASIETNSPRLATSKTPSPSPTAQVTTENSNPNTSRQLVLSTQPATSSPVTSPAQLIFVQSATTVAVQDAHPSPTNRSKRNLEMEVILTLSQGLRKYYGRILKLLDLTLEEDTEGLLEWCKRNLGLTCDDNFFQKRIEEFFLTGEGHFNEVLQFKTPSTLSSTESASVGLPTVEPFKSYFAKGFLSIDSGYFSAKCYPRASNSGLQLINVTQHSARIADTPGPKITNLKTINCINLKALVFKEHREIEINVLLPQVAVNLSNCHVHIKSHVCDYSLDIDGTVRLPRIHHEGTFIPGTYKIVIDKKNKQNDRCNLVTNCVIKGREVRKGQSVLRQYRTEIRIGKASSGSRRLLSEESGEDCISRTQLLRTETAEIHGDNYGGPGDKITICNGSTIVDQRLGSELGCYTINRVKSFKLCENSATGKSCEIDNTPVKCKQGFCLKITQEGRGHVKLSRDSEVVLDACDSSCEIMIPKGTGDILVDCSGGQQHFLKDNLIDLGCPNIPLLGKMAIYICRMSNHPKTTMAFLFWFSFGYVITCILCKVIFYLLIVVGTLGKKFKQYRELKPQTCTICETTPVNAIDAEMHDLNCSYNICPYCASRLTSDGLARHVMQCPKRKEKIEETELYLNLERIPWVVRKLLQVSESTGVALKRSSWLIVLLVLLTVSLSPVQSAPIGHGKTIETYQTREGYTSICLFVLGSILFIVSHLMKGLVDSVGNSFFPGLSICKTCSIGSINGFEIESHKCFCSLFCCPYCRHCSADKEIHKLHLSICKKRKAGSNVMLAVCKRMCFRATMEVSNKALLIRSVINTTFVVCILILAVCVVSTSAVEMESLPAGTWEREEDLTNFCHQECQVTETECLCPYEALVLRKPLFLDSIAKGMKNLLNSTSLETSLSIEAPWGAINVQSTFKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIVTLHPRIEEGFFDLMHVQKVLSASTVCKLQSCTHGVPGDLQVYHIGNLLKGDKVNGHLIHKVEPHFNTSWMSWDGCDLDYYCNMGDWPSCTYTGVTQHNHAAFVNLLNIETDYTKNFHFHSKRVTAHGDTPQLDLKARPNYGAGEVTVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSKEDTQKCVNAKLERPQSILIEHKGTIIGKQNDTCTAKASCWLESVKSFFYGLKNMLSGIFGNVFIGIFLFLAPFILLILFFMFGWRILFCFKCCRRTRGLFKYRHLKDDEETGYRKIIERLNNKKGKNKLLDGERLADRKIAELFSTKTHIG

SEQ ID NO: 1293 - protein, 1682 aa, Artificial Sequence
  derived and/or modified protein sequence (wt) from CCHFV(Oman_812956)__KY362518.1__GP
MHTLLVYAVFCLQLWSPGGTRGLSNETQHNETGITRAPEGSQGPSLPVSTASPIMSDPSITTLSASTSGLEGSGDTTPPAITQGPTLPETTPEPSTTTGTNAFSTAIANVSTQTVKDTPTPTVQTSPPSTPDASTIPQGTHHTARGLLSVTVTKPEEVPTPTGPEQASIETNSPRLATSKTPSPSPTAQVTTENSNPNTSRQLVLSTQPATSSPVTSPAQLNFVQSATTIAVQDAHPSPTNRSKRNLEMEVILTLSQGLRKYYGRILKLLDLTLEEDTEGLLEWCKRNLGLTCDDNFFQKRIEEFFLTGEGHFNEVLQFKTPSTLSPTESASVGLPTVEPFKSYFAKGFLSIDSGYFSAKCYPRASNSGLQLINVTQHSARIADTPGPKITNLKTINCINLKALVFKEHREIEINVLLPQVAVNLSNCHVHIKSHVCDYSLDIDGTVRLPRIHHEGTFIPGTYKIVIDKKNKQNDRCNLVTNCVIKGREVRKGQSVLRQYRTEIRIGKASSGSRRLLSEESGEDCISRTQLLRTETAEIHGDNYGGPGDKITICNGSTIVDQRLGSELGCYTINRVKSFKLCENSATGKSCEIDNTPVKCKQGFCLKITQEGRGHVKLSRDSEVVLDACDSSCEIMIPKGTGDILVDCSGGQQHFLKDNLIDLGCPNIPLLGKMAIYICRMSNHPKTTMAFLFWFSFGYVITCILCKVIFYLLIVVGTLGKKFKQYRELKPQTCTICETTPVNAIDAEMHDLNCSYNICPYCASRLTSDGLARHVMQCPKRKEKIEETELYLNLERIPWVVRKLLQVSESTGVALKRSSWLIVLLVLLTVSLSPVQSAPIGHGKTIETYQTREGYTSICLFVLGSILFIVSHLMKGLVDSVGNSFFPGLSICKTCSIGSINGFEIESHKCYCSLFCCPYCRHCSADKEIHKLHLSICKKRKAGSNVMLAVCKRMCFRATMEVSNKALLIRSVINTTFVVCILILAVCVVSTSAVEMESLPAGTWEREEDLTNFCHQECQVTETECLCPYEALVLRKPLFFDSIAKGMKNLLNSTSLETSLSIEAPWGAINVQSTFKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIVTLHPRIEEGFFDLMHVQKVLSASTVCKLQSCTHGVPGDLQVYHIGNLLKGDKVNGHLIHKVEPHFNTSWMSWDGCDLDYYCNMGDWPSCTYTGVTQHNHAAFVNLLNIETDYTKNFHFHSKRVTAHGDTPQLDLKARPNYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSKEDTQKCVNAKLERPQSILIEHKGTIIGKQNDTCTAKASCWLESVKSFFYGLKNMLSGIFGNVFIGIFLFLAPFILLILFFMFGWRILFCFKCCRRTRGLFKYRHLKDDEETGYRKIIERLNNKKGKNKLLDGERLADRKIAELFSTKTHIG

SEQ ID NO: 1294 - protein, 1682 aa, Artificial Sequence
  derived and/or modified protein sequence (wt) from CCHFV(Oman-199809166)__KR864901.1__GP
MHTLLVYAVFCLQLWSPGGTRGLSNETQHNETGITRAPEGSQGPSLPVSTASPIMSDPSITTLSASTSGLEGSGDTTPPAITQGPTLPETTPEPSTTTGTNAFSTAIANVSTQTVKDTPTPTVQTSPPSTPDASTIPQGTHHTARGLLSVTVTKPEEVPTPTGPEQASIETNSSRLATSKTPSPSPTAQVTTENSNPNTSRQLVLSTQPATSSPVTSPAQLNFVQSATTIAVQDAHPSPTNRSKRNLEMEVILTLSQGLRKYYGRILKLLDLTLEEDTEGLLEWCKRNLGLTCDDNFFQKRIEEFFLTGEGHFNEVLQFKTPSTLSPTESASVGLPTVEPFKSYFAKGFLSIDSGYFSAKCYPRASNSGLQLINVTQHSARIADTPGPKITNLKTINCINLKALVFKEHREIEINVLLPQVAVNLSNCHVHIKSHVCDYSLDIDGTVRLPRIHHEGTFIPGTYKIVIDKKNKQNDRCNLVTNCVIKGREVRKGQSVLRQYRTEIRIGKASSGSRRLLSEESGEDCISRTQLLRTETAEIHGDNYGGPGDKITICNGSTIVDQRLGSELGCYTINRVKSFKLCENSATGKSCEIDNTPVKCKQGFCLKITQEGRGHVKLSRDSEVVLDACDSSCEIMIPKGTGDILVDCSGGQQHFLKDNLIDLGCPNIPLLGKMAIYICRMSNHPKTTMAFLFWFSFGYVITCILCKVIFYLLIVVGTLGKKFKQYRELKPQTCTICETTPVNAIDAEMHDLNCSYNICPYCASRLTSDGLARHVMQCPKRKEKIEETELYLNLERIPWVVRKLLQVSESTGVALKRSSWLIVLLVLLTVSLSPVQSAPIGHGKTIETYQTREGYTSICLFVLGSILFIVSHLMKGLVDSVGNSFFPGLSICKTCSIGSINGFEIESHKCYCSLFCCPYCRHCSADKEIHKLHLSICKKRKAGSNVMLAVCKRMCFRATMEVSNKALLIRSVINTTFVVCILILAVCVVSTSAVEMESLPAGTWEREEDLTNFCHQECQVTETECLCPYEALVLRKPLFLDSIAKGMKNLLNSTSLETSLSIEAPWGAINVQSTFKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIVTLHPRIEEGFFDLMHVQKVLSASTVCKLQSCTHGVPGDLQVYHIGNLLKGDKVNGHLIHKVEPHFNTSWMSWDGCDLDYYCNMGDWPSCTYTGVTQHNHAAFVNLLNIETDYTKNFHFHSKRVTAHGDTPQLDLKARPNYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSKEDTQKCVNAKLERPQSILIEHKGTIIGKQNDTCTAKASCWLESVKSFFYGLKNMLSGIFGNVFIGIFLFLAPFILLILFFMFGWRILFCFKCCRRTRGLFKYRHLKDDEETGYRKIIERLNNKKGKNKLLDGERLADRKIAELFSTKTHIG

SEQ ID NO: 1295 - protein, 1684 aa, Artificial Sequence
  derived and/or modified protein sequence (wt) from CCHFV(BA66019)__AF350448.1__GP
MYTLLVCAVLCPQLWSLEGTHVPHNETKHNGTGITAAPGESQGPMSPASTAVPLTPEPPNTKPAASASELESSGEGHTSLLATTQGLTSPEATPELPTTTDTGVSSTSVVDIGTQMAKDTPTSTAHTSLPSNPSAPSTAQGTHHTIRGLLSVTSTKPEEASTPTDPGKAGAETGSPRPAISRKPTLSPTAEAPTEINNSSTPKQPEPSIQPATPSLVISPAQPAFPQSATSTAAQDIYSSPTNRSKRNLKMEIILTLSQGLKKYYGKIQKTLGLTLEEDTEGLLEWCKRNLGLTCDDNFFQKRIEEFFLTGEGYFNEVLQFKTPSTPGSTEPTHAEAPTVKPFKSYFARGFLTINSGYFSAKCYSWTSNSGLQLINVTQHPARIADTPGPKITNLKTINCINLKASVFKEHREIEINVLLPQVAVNLSNCHVLIKSHVCDYSLDIDGTIRLPRIYHEGTFIPGTYKIVIDKRDKQNDRCTLVTNCVIKGREVRKGQSALRQYRTEIRIGKASAGSRRLLSEESGDDCISRTQLLRTETAEVHGDNYGGPGDKITICNGSTIVDQRLGSELGCYTINRVKSFKLCENSGTGKSCKIDKHPVKCRQGFCLKITQEGRGHVKLSRGSEVVLDACDSSCEIMIPKGTGDILVDCSGGQQHFLKDNLVDLGCPNIPLLGKMAIYICRMSNHPKTTMAFLFWFSFGYVITCIFCKIIFYLLIVVGTLGKKFKQYRELKPQTCTICETTPTNAIDAEMHDLKCSYNICPYCASRLTSDGLARHVTQCPKRKEKVEETELYLNLERIPWIVRKLLQVSESTGVALKRSSWLIVLLVLLTVSLSPVQSAPIGHGKTIEAYQTREGYTSVCLFMLGGILFVVSCLMKGLVDSVSNSFFPGLSICKTCSIGSVNGFEIESHKCYCSLLCCLYCRHCSADREIHQLHLSICKKRRAGGNVMLAVCKRMCLRATMEVSNKVLFIRSIINTTFVICILVLAVCIVSTSAVEMESLPAGTWEREEDLTNFCHQECQVTETECLCPYEALVLRKPLFSDSIVKGMKNLLNSTSLETSLSIEAPWGAINVQSTFKPTVSTANIALSWSSVEHRGNKILVSGRSESIMKLEERTGISWDLGVEDASESKLLTVSVMDLSQMYSPVFEYLSGDRQVEEWPKATCTGDCPDRCGCTSSTCLHKEWPHSRNWRCNPTWCWGVGTGCTCCGLDVKDLFTDYMFVKWKVEYIKTEAIVCVELNSQERQCSLIEAGTRFNLGPVTITLSEPRNIQQKLPPEIITLHPRIEEGFFDLMHVQKVLSASTVCKLQSCTHGVPGDLQIYHIGNLLKGDRVNGHLIHKIEPHFNTSWMSWDGCDLDYYCNMGDWPSCTYTGVTQHNHAAFVNLLNIETDYTKNFHFHSKRVTAHGDTPQLDLKARPTYGAGEITVLVEVADMELHTKKIAISGLKFASLTCTGCYACSSGISCKVRIHVDEPDELTVHVKSEDPDIVAASSSLMARKLEFGTDSTFKAFSAMPKTSLCFYIVEREYCESCSKEDTQKCVNTKLEQPQSILIEHKGTIIGKQNDTCTAKASCWLESVKSFFYGLKNMLSGIFGNVFIGIFLFLAPFILLILFFMFGWRILFCFKCCRRTRGLFKYRYLKDDEESGYRRIIERLNNKKGKNKLLDGERLADRRIAELFSTKTHIG

SEQ ID NO: 1296 - protein, 1684 aa, Artificial Sequence
  derived and/or modified protein sequence (wt) from CCHFV(SPU 18/88)__KJ682810.1__GP
MYTPLLCAILCLQLWSLEGIYGLSNKTQHNDTSTIKVPEESQKTSLPANTASPITSDPSSATSTALASGPEGSGDTSTSPSVTTQGPTLLETTPEPHTTIDIDESSTAIADISTQTVKDIPTPTTHTSLPSTPSAPTIPQEAHHTARGLLSVTSTKPGETSTPTSPGEASTEASSPQPTISETPSPPPTTQAPTEINNPNTSRQPMPSTQPAAPNSVTPPVQPTFSQSDVSTVAQDIHPSPTNRSKRNLEMEIILTLSQGLKKYYGKVLKLLDLTLEEDTEGLLEWCKRNLGLTCDDNFFQKRIEEFFLTGEGHFNEVLQFKTPSTLSPTEPARVESPTVEPFKSYFAKGFLSMDSGYFSAKCYPKSSNSGLQLINVTQHSIRITDTPGPKITSLKTINCINLKALVFKEHREIEINVLLPQVAVNLSNCHVLIKSHACDYSLDIDGPVRLPRIHHEGTFIPGTYKIVIDKKNKQNDRCTLVTNCVIKGREIRKGQSVLRQYRTEIKIGKASSGSRRLLSEESNDDCLSRTQLLRTENAEIHSDNYGGPGDKITICNGSTIVDQRLGSELGCYTINRVKSFKLCENSATGKSCEIDSTPVRCRQGFCLKITQEGRGHVKLSRGSEVVLDACDSSCEIMIPKGTGDILVDCSGGQQHFLKDNLVDLGCPNIPLLGKMAIYICRMSNHPKTTMGFLFWFSFGYVITCILCKVIFYLLIVVGTLGKKFKQYRELKPQTCTICETNPVNAIDAEMHDLNCSYNICPYCASRLTSDGLARHVMQCPKRKEKIEETELYLNLERIPWVVRKLLQVSESTGVALKRSSWLVILLVLLTVSLSPVQSAPISHGETVEVYQTREGYTSICLFVLGSILFLVSCLMKGLVDSVGNSFSPGLSICKTCSIGSINGFEIESHKCYCSLFCCPYCRHCSADIEIHKLHLSICKKRKTGSNVMLAVCKRMCFRATVEVSNKALLIRNIINTTFVVCILILAVCVVSTSAVEMENLPAGTWEKEEDLTNFCHQECQVTETECLCPYEALVLRKPLFLDSIVKGKKNLLNSTSLETSLSIEAPWGAINVQSTFKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVDYIKTEAIVCVELTSQERQCSLIEAGTRFNLGPVTITLSEPRNIQQKLPPEIVTLHPRIEEGFFDLMHIQKVLSASTVCKLQSCTHGVPGDLQIYHIGNLLKGDKVNGHLIHKIEPHFNTSWMSWDGCDLDYYCNMGDWPSCSYTGVTQHNHAAFVNMLNIETDYTKNFHFHSKRVTAHGDTPQLDLKARPTYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSKEDTQKCVNTKLEQPQSILIEHKGTIIGKQNDTCTGKAGCWLESIKSFFYGLKNMLSGIFGNVFIGIFLFLAPFIMLILFFMFGWRILFCFKCCRRTRGLFKYRHLKDDEEIGYRKIIERLKNKKGKNKLLDGERLADRKIAELFSTKTHIG

SEQ ID NO: 1297 - protein, 1684 aa, Artificial Sequence
  derived and/or modified protein sequence (wt) from CCHFV(66019)__AB069669.1__GP
MYTLLVCAVLCPQLWSLEGTHVPHNETKHNGTGITAAPGESQGPMSPASTAVPLTPEPPNTKPAASASELESSGEGHTSLLATTQGLTSPEATPELPTTTDTGVSSTSVVDIGTQMAKDTPTSTAHTSLPSNPSAPSTAQGTHHTIRGLLSVTSTKPEEASTPTDPGKAGAETGSPRPAISRKPTLSPTAEAPTEINNSSTPKQPEPSIQPATPSLVISPAQPAFPQSATSTAAQDIYSSPTNRSKRNLKMEIILTLSQGLKKYYGKIQKTLGLTLEEDTEGLLEWCKRNLGLTCDDNFFQKRIEEFFLTGEGYFNEVLQFKTPSTPGSTEPTHTEAPTVKPFKSYFARGFLTIDSGYFSAKCYSRTSNSGLQLINVTQHPARIADTPGPKITNLKTINCINLKASVFKEHREIEINVLLPQVAVNLSNCHVLIKSHVCDYSLDIDGTIRLPRIYHEGTFIPGTYKIVIDKRDKQNDRCTLVTNCVIKGREVRRGQSALRQYRTEIRIGKASAGSRRLLSEESGDDCISRTQLLRTETAEVHGDNYGGPGDKITICNGSTIVDQRLGSELGCYTINRVKSFKLCENSGTGKSCKIDNTPVKCRQGFCLKITQEGRGHVKLSRGSEVVLDACDSSCEIMIPKGTGDILVDCSGGQQHFLKDNLVDLGCPNIPLLGKMAIYICRMSNHPKTTMAFLFWFSFGYVITCIFCKIIFYLLIVVGTLGKKFKQYRELKPQTCTICETTPTNAIDAEMHDLKCSYNICPYCASRLTSDGLARHVTQCPKRKEKVEETELYLNLERIPWIVRKLLQVSESTGVALKRSSWLIVLLVLLTVSLSPVQSAPIGHGKTIEAYQTREGYTSVCLFMLGGILFVVSCLMKGLVDSVSNSFFPGLSICKTCSIGSVNGFEIESHKCYCSLLCCLYCRHCSADREIHQLHLSICKKRRAGGNVMLAVCKRMCLRATMEVSNKVLFIRSIINTTFVICILVLAVCIVSTSAVEMESLPAGTWEREEDLTNFCHQECQVTETECLCPYEALVLRKPLFSDSIVKGMKNLLNSTSLETSLSIEAPWGAINVQSTFKPTVSTANIALSWSSVEHRGNKILVSGRSESIMKLEERTGISWDLGVEDASESKLLTVSVMDLSQMYSPVFEYLSGDRQVEEWPKATCTGNCPDRCGCTSSTCLHKEWPHSRNWRCNPTWCWGVGTGCTCCGLDVKDLFTDYMFVKWKVEYIKTEAIVCVELNSQERQCSLIEAGTRFNLGPVTITLSEPRNIQQKLPSEIITLHPRIEEGFFDLMHVQKVLSASTVCKLQSCTHGVPGDLQIYHIGNLLKGDRVNGHLIHKIEPHFNTSWMSWDGCDLDYYCNMGDWPSCTYTGVTQHNHAAFVNLLNIETDYTKNFHFHSKRVTAHGDTPQLDLKARPTYGAGEITVLVEVADMELHTKKIAISGLKFASLTCTGCYACSSGISCKVRIHVDEPDELTVHVKSEDPDIVAASSSLMARKLEFGTDSTFKAFSAMPKTSLCFYIVEREYCESCSKEDTQKCVNTKLEQPQSILIEHKGTIIGKQNDTCTAKASCWLESVKSFFYGLKNMLSGIFGNVFIGIFLFLAPFILLILFFMFGWRILFCFKCCRRTRGLFKYRYLKDDEESGYRRIIERLNNKKGKNKLLDGERLADRRIAELFSTKTHIG

SEQ ID NO: 1298 - protein, 1683 aa, Artificial Sequence
  derived and/or modified protein sequence (wt) from CCHFV(Gaib)__KX013445.1__GP
MYIPLVYAVIYLQLYGLGGAHGLLNKTEQNETGITATHGRVQGPPSASITLPVTPDPLSATSAASTSGPEGSGEVPTSPSTITQGLTSSENTPQLPTATDTGISSTSIIDVSTQTAGDTSTPTAHTSLPNSPSAPFTSQDTRHTVRGLLTVTSTKSDEASTLTDPKEASTEARSPSPSISRTPTPSPTVQASTENNTPSTPRQPEPTTRPALPSPTTSPTQPSLSQSATSAAIQDMHPSPTNRSRRNLEMEIILTLSQGLKKYYGKILKLLDLTLEEDTEGLLEWCKRNLDLTCDENFFLKRIEEFFLSGEGHFNEVLQFKAPSTMSSTEPTHAGPPTVEPFKSYFAKGFLSIDSGYFSAKCYPRTSNSGLQLINVTQHTARIADTPGPKITNVKTINCINLKASVFKKHREVEINVLLPQIAVNLSNCHVLIKSHVCDYSLNFDGMVRLPRIHHEGTFIPGTYKIVIDRKNKQNDRCTLVTNCVIKGREVRKGQSALRQYRTEIKIGEASIGSRRLLSEESSDDCISRTQLLRTETAEIHNDNYGGPGDKITICNGSTIVDQRLGSELGCYTINRVKSFKLCENSATGKSCEIDSIPVKCRQGFCLKITQEGRGHVKLSRGSEVVLDACDSSCEIMIPKGTGDILVDCSGGQQHFLKDNLIDLGCPNIPLLGKMAIYICRMSNHPKTTMAFLFWFSFGYVITCIFCKAIFYLLIIVGTLGKKFKQYRELKPQTCTICETTPVNAIDAEMHDLNCSYNICPYCASRLTSDGLARHVVHCPKRKEKIEETELYLNLERVPWVVRKLLQVSESTGVALKRSSWLIVLLVLLTVSLSPVQSAPIGHGKTIETYQTREGYTSICLFVLGGILFIVSCLMKGLVDSVGNNFFPGLTICKTCSISSINGFEIESHKCYCSLLCCPYCRHCSADREIHQLHLSICKKRKTGSNVMLAVCKRMCLRVTTEVSNRALFIRSIINTTFVICILILAVCVISTSAVEMENLPAGTWEREEDLTNFCHQECQVTETECLCPYEALVLRKPLFSDSIVKGMKNLLNSTSLETSLSIEAPWGAINVQSTFKPTVSTANIALSWSSIEHRGNKILVSGRSESIMKLEERTGISWDLGVEDASESRLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHAAFVNLLNIETDYTKNFHFHSKRVTAHGDTPQLDLKARPTYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSREDTQKCVSTKLEQPQSILIEHKGTIIGKQNNTCTTKTTCWLESVKSFFYGLKNMLSSIFGNVFVGIFSFLAPFILLILFFMFGWRILFCFKCCRRTRGLFKYRHLKDDEETGYRRIIERLNNKKGKSKLLDGERLADRKIAELFSTKTHIG

SEQ ID NO: 1299 - protein, 1684 aa, Artificial Sequence
  derived and/or modified protein sequence (wt) from CCHFV(SPU415/85)__DQ211635.1__GP
MYTPLVCAVICLQLWNLGGTLVFINRTQHNETGTVATPEGTLRPRLPVSTALPTKSDRPSVGPAASSSGLEGSGEPNTSPSITTKGLTPPETTPALPTATDTDASSTGVVDVSTQMTKDIPMSTAYTNPPSTPSAPSTPQGTHHTARGLLSVASTKSEEVSMSTSPAKTSTETSSPPPATSETPTPSPTTQVPTGNNNPNTSRQPTPSAQPAMSNPATSPAQPNLSQSAPPTADQGVHPSPTNRSKRNLEIEIILTLSQGLRKYYGKILKLLDLTLEEDTEGLLEWCKRNLGLTCDDNFFQKRIEEFFLTGEGYFNEVLQFKVPSTLSSTEPTHTRPPTVEPFKSYFAKGFLSMNSGYFSAKCYPRTSNSGLQLINVTKHSAKIADTPGPKITNLKTINCINLRASVFKEHREVEINVLLPQVAVNLSNCHAQIKSHVCDYSLATDGMVRLPHIHHEGTFIPGTYKIVIDKKNKQNDRCTLVTNCVIKGREVRKGQSALRQYKTEIRIGKASSGSRRLLSEESDGDCISRTQLLRTETTEIHSDNYGGPGDKITICNGSTIVDQRLGSELGCYTINRVKSFKLCENSATGKSCEIDSTPVKCRQGFCLKITQEGRGHVKLSRGSEIVLDACDSNCEIMIPKGTGDILVDCSGGQQHFLKDNLIDLGCPNIPLLGKMAIYICRMSNHPKTTMAFLFWFSFGYVITCILCKVIFYLLIVAGTVGKKFKQYRELRPQTCTICETIPVNAIDAEMHDLNCSYNICPYCASRLTSDGLARHVMQCPKRKEKVEETELYLNLERIPWVVRKLLQVSESTGVALKRSSWLTVLLVLLIVSLSPVQSAPIGHGKTIETYQAREGYTSFCLFILGSILFVVSCLVKGLIDSVGNSFFPGLSICKTCSIGSINGFEIESHKCYCSLFCCPYCRHCSADREIHKLHLSICKKRKTGSNVMLAVCKRMCFRATIEVSNRALLIRNIINTTFVVCILTLAVCVVSTSAVEMESLPAGTWEKEEDLTNFCHQECQVTETECLCPYEALVLRKPLFLDSIVKGMKNLLNSTSLETSLSIEAPWGAINVQSTFKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQRVLSASTVCKLQSCTHGVPGDLQVYHIGNLLKGDKVNGHLIHKIEPHFNTSWMSWDGCDLDYYCNMGDWPSCTYTGVTQHNHAAFVNLLNIETDYTKNFHFHSKRVTAHGDTPQLDLKARPTYGAGEVTVLVEVADMELHTKKIEISGLKFASLTCTGCYACSSGISCKVKIHVDEPDELTVHVKSEDPDIVAAGSSLMARKLEFGADSTFKAFSAMPKTSLCFYIVEREYCKSCSREDTRKCVNTKLDRPQSILIEHKGTIIGKQNNTCTAKASCWLESVKSFFYGLKNMLSGIFGNVFIGIFLFIAPFVLLILFFMFGWRILFCFKCCRRTRGLFKYRHLKDDEETGYRKIIERLNNKKGKNKLLDGERLADRKIAELFSTKSHIG

SEQ ID NO: 1300 - protein, 1684 aa, Artificial Sequence
  derived and/or modified protein sequence (wt) from CCHFV(SPU 431/85)__KJ682812.1__GP
MYTPLVCAVICLQLWNLGGTLVSTNRTQHNETGTVATPEGTLRPRLPVSTALPTKSDRPSVGPAASSSGLEGSGEPNTSPSITTKGLTPPETTPALPTATDTDASSTGVVDVSTQMTKDIPMSTAYTNPPSTPSAPSTPQGTHHTARGLLSVASTKSEEVSMSTSPAKTSTETSSPPPATSETPTPSPTTQVPTGNNNPNTSRQPTPSAQPAMSNPATSPAQPNLSQSAPPTADQGVHPSPTNRSKRNLEIEIILTLSQGLRKYYGKILKLLDLTLEEDTEGLLEWCKRNLGLTCDDNFFQKRIEEFFLTGEGYFNEVLQFKVPSTLSSTEPTHTRPPTVEPFKSYFAKGFLSMNSGYFSAKCYPRTSNSGLQLINVTKHSAKIADTPGPKITNLKTINCINLRASVFKEHREVEINVLLPQVAVNLSNCHAQIKSHVCDYSLATDGMVRLPHIHHEGTFIPGTYKIVIDKKNKQNDRCTLVTNCVIKGREVRKGQSALRQYKTEIRIGKASSGSRRLLSEESDGDCISRTQLLRTETTEIHSDNYGGPGDKITICNGSTIVDQRLGSELGCYTINRVKSFKLCENSATGKSCEIDSTPVKCRQGFCLKITQEGRGHVKLSRGSEIVLDACDSNCEIMIPKGTGDILVDCSGGQQHFLKDNLIDLGCPNIPLLGKMAIYICRMSNHPKTTMAFLFWFSFGYVITCILCKVIFYLLIVAGTVGKKFKQYRELRPQTCTICETIPVNAIDAEMHDLNCSYNICPYCASRLTSDGLARHVMQCPKRKEKVEETELYLNLERIPWVVRKLLQVSESTGVALKRSSWLTVLLVLLIVSLSPVQSAPIGHGKTIETYQAREGYTSFCLFILGSILFVVSCLVKGLIDSVGNSFFPGLSICKTCSIGSINGFEIESHKCYCSLFCCPYCRHCPADREIHKLHLSICKKRKTGSNVMLAVCKRMCFRATIEVSNRALLIRNIINTTFVVCILTLAVCVVSTSAVEMESLPAGTWEKEEDLTNFCHQECQVTETECLCPYEALVLRKPLFLDSIVKGRKNLLNSTSLETSLSIEAPWGAINVQSTFKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQRVLSASTVCKLQSCTHGVPGDLQVYHIGNLLKGDKVNGHLIHKIEPHFNTSWMSWDGCDLDYYCNMGDWPSCTYTGVTQHNHAAFVNLLNIETDYTKNFHFHSKRVTAHGDTPQLDLKARPTYGAGEVTVLVEVADMELHTKKIEISGLKFASLTCTGCYACSSGISCKVKIHVDEPDELTVHVKSEDPDIVAAGSSLMARKLEFGADSTFKAFSAMPKTSLCFYIVEREYCKSCSREDTRKCVNTKLDRPQSILIEHKGTIIGKQNNTCTAKASCWLESVKSFFYGLKNMLSGIFGNVFIGIFLFIAPFVLLILFFMFGWRILFCFKCCRRTRGLFKYRHLKDDEETGYRKIIERLNNKKGKNKLLDGERLADRKIAELFSTKSHIG

SEQ ID NO: 1301 - protein, 1684 aa, Artificial Sequence
  derived and/or modified protein sequence (wt) from CCHFV(8402)__AB069674.1__GP
MYTPLLCAVLCLQLWSLEGSHGLSNKTQHSNTSTTKAPEVSQELGLPVSTVSTITSDPPSITSAVSVSGSEGSGDTNTSPSVTTQGPTLPETTLEPLTTTDTDASSTVVVDVSTQTVKDTPISTTYTSLPSTPSEPTTPQGTHHTARGLLSVTSTKPEEASTQANPGKISMETNGPRLAISETPSFSPTTQAPTENSNPITSKQLMLSAQPVTPNPMTSPVQPALSQSDTSTAIQDVHPSPTGRSKRNLEMEIILTLSQGLKKYYGKILKLLDLTLEEDTEGLLEWCKRNLGLVCDDNFFQKRIEEFFLTGKGHFNEVLQFKTPSTLSPTGPARTGSPTVEPFKSYFAKGFLSMDSGYFSAKCYPRASNSGLQLINVTQHSTRITDTPGPKITNLKTINCINLKASVFKEHREIEINVLLPQVAVNLSSCHVLIKSHVCDYSLDIDGPVRLPRIHHEGTFIPGTYKIVIDKKNKQNDRCTLVTNCVIKGREIRKGQSVLRQYRTEIKIGKASSGSRRLLSEESGDDCISRTQLLRTETAEIHNDNYGGPGDKITICNGSTVVDQRLGSELGCYTINRVKSFKLCENSATGKSCEIDSTPVKCRQGFCLKITQEGRGHVKLSRGSEVVLDACDSSCEIMIPKGTGDILVDCSGGQQHFLKDNLIDLGCPNIPLLGKMAIYICRMSNHPKTTMAFLFWFSFGYVVTCILCKVIFYLLIVVGTLGKKFKQYRELKPQTCTICETTPVNAIDAEMHDLNCSYNICPYCASRLTSDGLARHVMQCPKRKEKIEETELYLNLERIPWVVRKLLQVSESTGVALKRSSWLVVLLVLLTVSLSPVQSAPIGHGKTVETYQTREGYTSICLFVLGSILFIVSCLMKGLVDSVGNSFFPGLSICKTCSIGSVNGFEIESHKCYCSLFCCPYCRHCSADREIHRLHLSICKKRKTGSNVMLAVCKRMCFRATVEVSNKALLIRNIINTTFVLCILILAVCVVSTSAVEMESLPAGTWEREEDLTNFCHQECQVTETECLCPYEALVLRKPLFSDSIVKGMKNLLNSTSLETSLSIEAPWGAINVQSTFKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFIKWKVEYIKTEAIVCVELTSQERQCTLIEAGTRFNLGPVTITLSEPRNIQQKLPPEIVTLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHAAFVNMLNIETDYTKNFHFHSKRVTAHGDTPQLDLKARPTYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSKEDTQKCVNTKLEQPQSILIEHKGTIIGKQSNTCTAKASCWLESVKSFFYGLKNMLSGIFGNVFIGVFLFFAPFILLILFFMFGWRILFCFKCCRRTRGLFKYRHLKDDEETGYRKIIERLNNKKGKNKLLDGERLADRKIAELFSTKTHIG

SEQ ID NO: 1302 - protein, 1684 aa, Artificial Sequence
  derived and/or modified protein sequence (wt) from CCHFV(SPU 383/87)__KJ682806.1__GP
MYTPLLCAILCLQLWSLEGIYGLSNRTQHNDTSTIKVPEESQKTSLPANTASPITSDPPSTTSTASASGPEGSGDTSTSPPVTTQGPTPPETTPEPHTTIDIDKSSTAIADISTQTVKDIPTPTTHTSLPSTLSAPTIPQEAHHTARGLLSITSTKPGEASTPISPGEASTEASSPQPTISETPSPPPTAQAPTEINSPNTSRQPMPSTQPAAPNSVTHPAQPTPSQSDVPTAAQDIHPNPINRSKRNLEMEIILTLSQGLKKYYGKVLKLLDLTLEEDTEGLLESCKRNLGLTCDDNFFQKRIEEFFLTGEGHFNEVLQFKTPSTLSPTEPARVESPTVEPFKSYFAKGFLSMDSGYFSAKCYSKSSNSGLQLINVTQHLIRITDTPGPKITNLKTINCINLKALVFKEHREIEINVLLPQVAVNLSNCHVLIKSHVCDYSLDIDGPVRLPRIHHEGTFIPGTYKIVIDKNNKQNDRCTLVTNCVIKGREIRKGQSVLRQYRTEIKIGKASSGSRRLLSEESNDDCLSRTQLLRTENAEIHSDNYGGPGDKITICNGSTIVDQRLGSELGCYTINRVKSFKLCENSATGKSCEIDSTPVRCRQGFCLKITQEGRGHVKLSRGSEVVLDACDSSCEIMIPKGTGDILVDCSGGQQHFLKDNLVDLGCPNIPLLGKMAIYICRMSNHPKTTMAFLFWFSFGYVITCILCKVIFYLLVVVGTLGKKFKQYRELKPQTCTICETNPVNAIDAEMHDLNCSYNICPYCASRLTSDGLARHVIQCPKRKEKIEETELYLNLERIPWVVRKLLQVSESTGVALKRSSWLVILLVLLTVSLSPVQSAPISHGETVEVYQTREGYTSICLFVLGSILFLVSCLMKGLVDSVGNSFFPGLSICKTCSIGSINGFEIESHKCYCSLFCCPYCRHCSADIEIHRLHLSICKKRKTGSNVMLAVCKRMCFRATVEVSNKALLIRNIINTTFVVCILILAVCVVSTSAVEMENLPAGTWEKEEDLTNFCHQECQVTETECLCPYEALVLRKPLFLDSIVKGMKNLLNSTSLETSLSIEAPWGAINVQSTFKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVDYIKTEAIVCVELTSQERQCSLIEAGTRFNLGPVTITLSEPRNIQQKLPPEIVTLHPRIEEGFFDLMHIQKVLSASTVCKLQSCTHGVPGDLQIYHIGNLLKGDKVNGHLIHKIEPHFNTSWMSWDGCDLDYYCNMGDWPSCSYTGVTQHNHAAFVNMLNIETDYTKNFHFHSKRVTAHGDTPQLDLKARPTYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSKEDTQKCVNTKLEQPQSILIEHKGTIFGKQNDTCTAKASCWLESVKSFFYGLKNMLSGIFGNVFIGVFLFLAPFIMLILFFMFGWRILFCFKCCRRTRGLFKYRHLKDDEEIGYRKIIERLNNKKGKNKLLDGERLADRKIAELFSTKTHIG

SEQ ID NO: 1303 - protein, 1684 aa, Artificial Sequence
  derived and/or modified protein sequence (wt) from CCHFV(SPU 497/88)__KJ682808.1__GP
MYTPLLCAILCLQLWSLEGIYGLSNKTQHNDTSTIKVPEESQKTSLPANIASPTTSDPPSATSTASASGPEGSGDTSTSPSVTTQGPTPLEITPEPHTTIDIDKSSTSIADISTRTVKDIPTPTTHTSLPSTPSAPTIPQEVHHTARGLLSVTSTKPEEASTLTSPGEASTEASSPQPTISETPSPPPTTQAPTEINNPNTSRQPMPSTQPAAPNSVTPPVQPTFSQSDVSTAAQDIHPSPTNRSKRNLEMEIILTLSQGLKKYYGKVLKLLDLTLEEDTEGLLEWCKRNLGLTCDDNFFQKRIEEFFLTGEGHFNEVLQFKTPSTLSPTEPARVESPTVEPFKSYFAKGFLSMDSGYFSAKCYPKSSNSGLQLINVTQHLIRITDTPGPKITNLKTINCINLKALVFKEHREIEINVLLPQVAVNLSNCHVLIKSHVCDYSLDIDGPVRLPRIHHEGTFIPGTYKIVIDKKTKQNDRCTLVTNCVIKGREIRKGQSVLRQYRTEIKIGKASSGSRRLLSEESNDDCLSRTQLLRTENAEIHSDNYGGPGDKITICNGSTIVDQRLGSELGCYTINRVKSFKLCENSATGKSCEIDSTPVRCRQGFCLKITQEGKGHVKLSRGSEVVLDACDSSCEIMIPKGTGDILVDCSGGQQHFLKDNLVDLGCPNIPLLGKMAIYICRMSNHPKTTMVFLFWFSFGYVITCILCKVIFYLLIVVGTLGKKFKQYRELKPQTCTICETNPVNAIDAEMHDLNCSYNICPYCASRLTSDGLARHVMQCPKRKEKIEETELYLNLERIPWVVRKLLQVSESTGVALKRSSWLVILLVLLTVSLSPVQSAPISHGETVEVYQTREGYTSICLFVLGGILFLVSCLMKGLVDSVGNSFFPGLSICKTCSIGSINGFEIESHKCYCSLFCCPYCRHCSADIEIHKLHLSICKKRKTWSNVMLAVCKRMCFRATVEVSNKALLIRNIINTTFVVCILILAICVVSTSAVEMENLPAGTWEKEEDLTNFCHQECQVTETECLCPYEALVLRKPLFLDSIVKGMRNLLNSTSLETSLSIEAPWGAINVQSTFKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVDYIKTEAIVCVELTSQERQCSLIEAGTRFNLGPVTITLSEPRNIQQKLPPEIVTLHPRIEEGFFDLMHIQKVLSASTVCKLQSCTHGVPGDLQIYHIGNLLKGDKVNGHLIHKIEPHFNTSWMSWDGCDLDYYCNMGDWPSCSYTGVTQHNHAAFVNMLNIETDYTKNFHFHSKRVTAHGDTPQLDLKARPTYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSKEDTQKCVNTKLEQPQSILIEHKGTIIGKQNDTCTARASCWLESIKSFFYGLKNMLSGIFGNVFIGIFLFFAPFIMLILFFMFGWRILFCFKCCRRTRGLFKYRHLKDDEEVGYRKIIERLNNKKGKNKLLDGERLADRKIAELFSTKTHIG

SEQ ID NO: 1304 - protein, 1684 aa, Artificial Sequence
  derived and/or modified protein sequence (wt) from CCHFV(88166)__AB069675.1__GP
MYTPLLCAVLCLQLWSLEGSHGLSNKTQHSNTSTTKAPEVSQELGLPVSTVSTITSDPPSITSAVSVSGSEGSGDTNTSPSVTTQGPTLPETTLEPLTTTDTDASSTVVVDVSTQTVKDTPISTTYTSLPSTPSEPTTPQGTHHTARGLLSVTSTKPEEASTQANPGKISMETNSPRLAISETPSFSPTTQAPTENSNPITSKQLMLSAQPVTPNPMTSPVQPALSQSDTSTAIQDIHPSPTGRSKRNLEMEIILTLSQGLKKYYGKILKLLDLTLEEDTEGLLEWCKRNLGLVCDDNFFQKRIEEFFLTGKGHFNEVLQFKTPSTLSPTGPARTGSPTVEPFKSYFAKGFLSMDSGYFSAKCYPRASNSGLQLINVTQHSTRITDTPGPKITNLKTINCINLKASVFKEHREIEINVLLPQVAVNLSSCHVLIKSHVCDYSLDIDGPVRLPRIHHEGTFIPGTYKIVIDKKNKQNDRCTLVTNCVIKGREIRKGQSVLRQYRTEIKIGKASSGSRRLLSEESGDDCISRTQLLRTETAEIHSDNYGGPGDKITICNGSTVVDQRLGSELGCYTINRVKSFKLCENSATGKSCEIDSTPVKCRQGFCLKITQEGRGHVKLSRGSEVVLDACDSSCEIMIPKGTGDILVDCSGGQQHFLKDNLIDLGCPNIPLLGKMAIYICRMSNHPKTTMGFLFWFSFGYVVTCILCKVIFYLLIVVGTLGKKFKQYRELKPQTCTICETTPVNAIDAEMHDLNCSYNICPYCASRLTSDGLARHVMQCPKRKEKIEETELYLNLERIPWVVRKLLQVSESTGVALKRSSWLVVLLVLLTVSLSPVQSAPIGHGKTVETYQTREGYTSICLFVLGSILFIVSCLMKGLVDSVGNSFFPGLSICKTCSIGSVNGFEIESHKCYCSLFCCPYCRHCSADREIHRLHLSICKKRKTWSNVMLAVCKRMCFRATVEVSNKALLIRNIINTTFVLCILILAVCVVSTSAVEMESLPAGTWEREEDLTNFCHQECQVTETECLCPYEALVLRKPLFSDSIVKGMKNLLNSTSLETSLSIEAPWGAINVQSTFKPTMSAANIALSWSSVEHRGNKILVSGRSESIMKLEERTGISWNLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFIKWKVEYIKTEAIVCVELTSQERQCTLIEAGTRFNLGPVTITLSEPRNIQQKLPPEIVTLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHAAFVNMLNIETDYTKNFHFHSKRVTAHGDTPQLDLKARPTYGAGEITVLVEVADMELHTKKIEISGLKFASLTCTGCYACSSGISCKVRIHVDEPDELTVHVKSEDPDLVAASSSLMARKLEFGTDSTFKAFSAMPKTSLCFYIVEREYCKSCSKEDTQKCVNTKLEQPQSILIEHKGTIIGKQNNTCTAKASCWLESVKSFFYGLKNMLSGIFGNVFIGVFLFFAPFILLILFFMFGWRILFCFKCCRRTRGLFKYRHLKDDEETGYRKIIERLNNKKGKNKLLDGERLADRKIAELFSTKTHIG

SEQ ID NO: 1305 - protein, 1684 aa, Artificial Sequence
  derived and/or modified protein sequence (wt) from CCHFV(strain BA88166)__AF338470.1__GP
MYTPLLCAVLCLQLWSLEGSHGLSNKTQHSNTSTTKAPEVSQELGLPVSTVSTITSDPPSITSAVSVSGSEGSGDTNTSPSVTTQGPTLPETTLEPLTTTDTDASSTVVVDVSTQTVKDTPISTTYTSLPSTPSEPTTPQGTHHTARGLLSVTSTKPEEASTQANPGKISMETNSPRLAISETPSFSPTTQAPTENSNPITSKQLMLSAQPVTPNPMTSPVQPALSQSDTSTAIQDIHPSPTGRSKRNLEMEIILTLSQGLKKYYGKILKLLDLTLEEDTEGLLEWCKRNLGLVCDDNFFQKRIEEFFLTGKGHFNEVLQFKTPSTLSPTGPARTGSPTVEPFKSYFAKGFLSMDSGYFSAKCYPRASNSGLQLINVTQHSTRITDTPGPKITNLKTINCINLKASVFKEHREIEINVLLPQVAVNLSSCHVLIKSHVCDYSLDIDGPVRLPRIHHEGTFIPGTYKIVIDKKNKQNDRCTLVTNCVIKGREIRKGQSVLRQYRTEIKIGKASSGSRRLLSEESGDDCISRTQLLRTETAEIHSDNYGGPGDKITICNGSTVVDQRLGSELGCYTINRVKSFKLCENSATGKSCEIDSTPVKCRQGFCLKITQEGRGHVKLSRGSEVVLDACDSSCEIMIPKGTGDILVDCSGGQQHFLKDNLIDLGCPNIPLLGKMAIYICRMSNHPKTTMGFLFWFSFGYVVTCILCKGIFYLLIVVGTLGKKFKQYRELKPQTCTICETTPVNAIDAEMHDLNCSYNICPYCASRLTSDGLARHVMQCPKRKEKIEETELYLNLERIPWVVRKLLQVSESTGVALKRSSWLVVLLVLLTVSLSPVQSAPIGHGKTVETYQTREGYTSICLFVLGSILFIVSCLMKGLVDSVGNSFFPGLSICKTCSIGSVNGFEIESHKCYCSLFCCPYCRHCSADREIHRLHLSICKKRKTWSNVMLAVCKRMCFRATVEVSNKALLIRNIINTTFVLCILILAVCVVSTSAVEMESLPAGTWEREEDLTNFCHQECQVTETECLCPYEALVLRKPLYLDSIVKGMKNLLNSTSLETSLSIEAPWGAINVQSTFKPTMSAANIALSWSSVEHRGNKILVSGRSESIMKLEERTGISWNLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFIKWKVEYIKTEAIVCVELTSQERQCTLIEAGTRFNLGPVIITLSEPRNIQQKLPPEIVTLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHAAFVNMLNIETDYTKNFHFHSKRVTAHGDTPQLDLKARPTYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSKEDTQKCVNTKLEQPQSILIEHKGTIIGKQNNTCTAKASCWLESVKSFFYGLKNMLSGIFGNVFIGVFLFFAPFILLILFFMFGWRILFCFKCCRRTRGLFKYRHLKDDEETGYRKIIERLNNKKGKNKLLDGERLADRKIAELFSTKTHIG

SEQ ID NO: 1306 - protein, 1684 aa, Artificial Sequence
  derived and/or modified protein sequence (wt) from CCHFV(SPU 130/89)__KJ682807.1__GP
MYTPLLCAILCLQLWSLEGIYGLSNKTQHNDNSTTKAPEESHKTSLPANTASPITSDPPSTTSTTSASGPEGSGDTSTSPPVTTQGPASPETTPEPHTTIDIDKSSTAIADISTQTVKDIPTPTTHTSLPSTLSAPTIPQEAHHTARGLLSVTRHKPGEASKPTSPGEASTEASSSQPTISETPSPPPTTQAPTEINNPNTSRQPMPSTQPAAPSSVTHPAQPTPSQSDVPTAAQDIHPSPTNRSKRNLEMEIILTLSQGLKKYYGKVLKLLDLTLEEDTEGLLEWCKRNLGLTCDDNFFQKRIEEFFLTGEGHFNEVLQFKTPSTLSPTEPARVESPTVEPFKSYFAKGFLSMDSGYFSAKCYPKSSNSGLQLINVTQHLIRITDTPGPKITNLKTINCINLKALVFKEHREIEINVLLPQVAVNLSNCHVLIKSHVCDYSLDIDGPVRLPSIHHEGTFIPGTYKIVIDKKNKQNDRCTLVTNCVIKGREIRKGQSVLRQYRTEIKIGKASSGSRRLLSEEPNYDCLSRTQLLRTENAEIHSDNYGGPGDKITICNGSTIVDQRLGSELGCYTINRVKSFKLCENSATGKSCEIDSTPVRCRQGFCLKITQEGRGHVKLSRGSEVVLDACDSSCEIMIPKGTGDILVDCSGGQQHFLKDNLVDLGCPNIPLLGKMAIYICRMSNHPKTTMAFLFWFSFGYVITCILCKVIFYLLIVVGTLGKKFKQYRELKPQTCTICETNPVNAIDAEMHDLNCSYNICPYCASRLTSDGLARHVMQCPKRKEKIEETELYLNLERIPWVVRKLLQVSESTGVALKRSSWLVVLLVLLTVSLSPVQSAPISHGETVEVYQTREGYTSICLFVLGSILFLVSCLMKGLVDSVGNSFFPGLSICKTCSIGSINGFEIESHKCYCSLFCCPYCRHCSADIEIHKLHLSICKKRKTGSNVMLAVCKRMCFRATVEVSNKALLIRNIINTTFVVCILILAVCVVSTSAVEMENLPAGTWEKEEDLTNFCHQECQVTETECLCPYEALVLRKPLSLDSIVKGMKNLLNSTSLETSLSIEAPWGAINVQSTFKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVDYIKTEAIVCVELTSQERQCSLIEAGTRFNLGPVTITLSEPRNIQQKLPPEIVTLHPRIEEGFFDLMHIQKVLSASTVCKLQSCTHGVPGDLQIYHIGNLLKGDKVNGHLIHKIEPHFNTSWMSWDGCDLDYYCNMGDWPSCSYTGVTQHNHAAFVNMLNIETDYTKNFHFHSKRVTAHGDTPQLDLKARPTYGAGEITVLVEVADMELHTKKVEISGLKFASLTCTGCYACSSGISCKVRIHVDEPDELTVHVKSEDPDIVAASSSLMARKLEFGTDSTFKAFSAMPKTSLCFYIVEREHCKSCSKEDTQRCVNTKLEQPQSILIEHKGTIIGKQNDTCTAKASCWLESIKSFFYGLKNMLSGIFGNVFIGVFLFLAPFIILILFFMFGWRILFCFKCCRRTRGLLKYRHLKDDEEIGYRKIIERLNNKKGKNKLLDGERLADRKIAELFSTKTHIG

SEQ ID NO: 1307 - protein, 1683 aa, Artificial Sequence
  derived and/or modified protein sequence (wt) from CCHFV(4701-ST-2009)__KR814872.1__GP
MHTLLVCFILYLQLSGLGGAHGQSNATEHNGTNTTTAPGTSQSPKPPASTTLPHTPESSTVKLTTPTSETEGSGETTPPPNTTQGLPLTGTTPERSATTATSTSSTDNMNSTTQVTDNTPTSTVSISPSSSSSMPSTPQGTHHPVRSLLSVSSPKTVTTPTPMSPGEMSPETSSQHSAMSRVPTLYTATQVSTENTDRSTPRQSESSVQPATQSPITSPAQTILLMSAAPKAIQDMHPSPTNRSKRNLEVEIILTLSQGLKKYYGKILKLLHLTLEEDTEGLLEWCKRNLGSNCDDDFFQKRIEEFFITGEGYFNEVLQFKTLSTLSPTEPSHVRLPTAEPFKSYFAKGFLSIDSGYFSAKCYPRSSTSGLQLINVTQHPARIAETPGPKTTSLKTINCINLRASVFKEHREVEINVLLPQIAVNLSNCHVVINSHVCDYSLDTDGPVRLPRIHHEGTFIPGTYKIVIDRKNKLNDRCSLVTNCVIKGREVRKGQSVLRQYKTEIKIGKASTGSRKLLSEEPGDDCISRTQLLKTETAEIHDDNYGGPGDKITICNGSTVVDQRLGSELGCYTINRVKSFKLCENSATGKTCEIDSTPVKCRQGFCLKITQEGRGHVKLSRGSEVVLDACDSSCEIMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLTVSLSPVQSAPVGHGKTIETYQTREGFTSICLFMLGSILFIVSCLVKGLVDSVSDSFFPGLSVCKTCSIGSINGFEIESHKCYCSLFCCPYCRHCSADREIHQLHLSICKKRKTGSNVMLAVCKRMCFKATIEASRRALLIRSIINTTFVMCILTLAICVVSTSAVEMEDLPAGTWEREEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLTCTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGGFFVGILLFLAPFVLLVLFFMFGWKILFCFKCCRRTRGLFKYRHLKDDEETGYRRIIERLNSKKGKNRLLDGERLADRKIAELFSTKTHIG

SEQ ID NO: 1308 - protein, 1683 aa, Artificial Sequence
  derived and/or modified protein sequence (wt) from CCHFV(36-ST-2014)__KR814857.1__GP
MHTLLVCFILYLQLSGLGGAHGQSNATEHNGTNTTTVPGTSQSPKPPASTTLPHTPESSTVKLTTPTSETEGSGETTPPPNTTQGLPPPGTTPERPATTATSMSSTDNMNSTTQVTDNTPTSTVSISPSSSPSMPSTSQGIHYPVRSLLSVSSPKTVTTPTPMSPGEMSPETSSQHSAMSRIPTLYTATQVSTENTNRSTPRQSESSAQPATQSPTTSPTQTILLMSAAPKAIQDMHPSPTNRSKRNLEVEIILTLSQGLKKYYGKILKLLHLTLEEDTEGLLEWCKRNLGSNCDDDFFQKRIEEFFITGEGYFNEVLQFKTLSTLSPTEPSHVRLPTAEPFKSYFAKGFLSIDSGYFSAKCYPRSSTSGLQLINVTQHPARIAETPGPKTTSLKTINCINLRASVFKEHREVEINVLLPQIAVNLSNCHVVINSHVCDYSLDTDGPVRLPRIHHEGTFIPGTYKIVIDKKNKLNDRCSLVTNCVIKGREVRKGQSVLRQYKTEIKIGKASTGSRKLLSEEPGDDCISRTQLLKTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEIMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLTVSLSPVQSAPVGHGKTIETYQTREGFTNICLFMLGSILFIVSCLVKGLVDSVSDSFFPGLSVCKTCSIGSINGFEIESHKCYCSLFCCPYCRHCSADREIHQLHLGICKKRKTGSNVMLAVCKRMCFKATIEASRRALLIRSIINTTFVICILTLAICVVSTSAVEMENLPAGTWEREEDLTNFCHQECQVSETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRLNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEDDTKKCVDTKLDQPQSILIEHKGTIIGKQNDTCTAKASCWLESVKSFFYGLKNMLGSVFGNFFVGILLFLAPFVLLVLFFMCGWKFLFCFKCCRRTRGLFKYRHLKDDEETGYRRIIERLNSKKGKNRLLDGERLADRKIAELFSTKSHIG

SEQ ID NO: 1309 - protein, 1684 aa, Artificial Sequence
  derived and/or modified protein sequence (wt) from CCHFV(Matin)__AF467769.2__GP
MYTLLLCAILCSQLWSSEGIHGLSNETQHGNASTIKAPEVSQGLGLPVSTAPPITSDPPSITSAASVSGPEGSGDTNTSPPVTTQGLTLPETTLELLTTTNTGASSTVIVDVSTQTVKDTPVSTAHTSPPGTPSAPTTPQGTHHTARGLLSVTSTKSEEASTQTNPKKTSMETNSPGPATSETPSPSPTTQAPTENNNPNTPRQPTPPTQPATPSPVTSPALLASSQGDTSTAVQDVHPSPTNRSKRNLEMEIILTLSQGLKKYYGKILKLLDLTLEEDTEGLLEWCKRNLGLVCDDSFFQKRIEEFFLTGEGHFNEVLQFKTPSTLSPTEPARAGSPTVEPFKSYFARGLLSMDSGYFSAKCYPRASNSGLQLINITQHSARITDTPGPKITNLKTINCINLKASTFKEHREIEINVLLPQVAVNLSSCHVLIKSHVCDYSLDIDGPVRLPRIHHEGTFIPGTYKIVIDKKNKQNDRCTIVTNCVIKGREIRKGQSVLRQYKTEIKIGKASSGSRRLLSEESGDDCISRTQLLRTETAEIHSDSYGGPGDKITICNGSTVVDQRLGSELGCYTINRVKSFKLCENSATGKSCEIDSTPVKCRQGFCLKITQEGRGHVKLSRGSEVVLDACDSSCEIMIPKGTGDILVDCSGGQQHFLKDNLIDLGCPNIPLLGKMAIYICRMSNHPKTTMVFLFWFSFGYVITCILCKVIFYLLIVVGTLGKKFKQYRELKPQTCTICETTPVNAIDAEMHDLNCSYNICPYCASRLTSDGLARHVMQCPKRKEKIEETELYLNLERIPWVVRKLLQVSESTGVALKRSSWLVVLLVLLTVSLSPVQSAPIGHGKTVETYQIREGYTSVCLFVLGSILFIVSCLMKGLVDSDGNSFFPGLSICKTCSIGSINGFEIESHKCYCSLFCCPYCRHCSTDREIHKLHLSICKKRKTGSNVMLAVCKRMCFRATVEVSNKALLIRSIINTTFVVCILILAVCVVSTSAVEMESLPAGTWEREEDLINFCHQECQVTETECLCPYEALVLRKPLFLDSIIKGMKNLLNSTSLETSLSIEAPWGAINVQSTFKPTMSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEVIVCVELTSQERQCSLIEAGTRFNLGPVTITLSEPRNIQQKLPPEIVTLHPRIEEGFFDLMHVQKVLSASTVCKLQSCTHGVPGDLQVYHIGNLLKGDKVNGHLIHKIEPHFNTSWMSWDGCDLDYYCNMGDWPSCSYTGVTQHNHAAFVNMLSIETDYTKNFHFHSKRVTAHGDTPQLDLKARPTYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSKEDTQKCVNTKLEQPQSILIEHKGTIIGKQNDTCTAKASCWLESVKSFFYGLKNMLSGIFGNVFIGIFLFLAPFALLILFFMFGWRILFCFKCCRRTRGLFKYRHLKDDEETGYRKIIERLNNKKGKNKLLDGERLADRKIAELFSTKTHVG

SEQ ID NO: 1310 - protein, 1683 aa, Artificial Sequence
  derived and/or modified protein sequence (wt) from CCHFV(UCCR4405)__KY484029.1__GP
MHALLVCFILYLQLSGLGGAHRQSNATEHNGTNTTTAPGTSQSPKPPVSTTLPHTPEASTIKLTTPTSETEGSGETTPPPNTTQGLPLPGTTPERSATTATSTSSTDDMNSTTQMTDNTPTSTVSIGLSSSPSMPSTSQGIHYPVRSLLSVSSPKTATTPTPMSPGEVSPETSSQHSAMSRIPTLYTATQVSTENTNRSIPRQSESSVQPATQSPITSPAQTILLMSAAPTAIQDMHPSPKNRSKRNLEVEIILTLSQGLKKYYGKILKLLHLTLEEDTEGLLEWCKRNLGSNCDDDFFQKRIEEFFITGEGYFNEVLQFKTPSTLSPTEPSHVRLPTAEPFKSYFAKGFLSIDSGYFSAKCYPRSSTSGLQLINVTQHPARIAETPGPKTTSLKTINCINLRASVFKEHREVEINVLLPQIAVNLSNCHVVINSHVCDYSLDTDGPVRLPRIHHEGAFIPGTYKIVIDKKNKLNDRCSLVTNCVIKGREVRKGQSVLRQYKTEIKIGKASTGSRKLLSEEPGDDCISRTQLLKTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLKCSYNICPYCASRLTSDGLARHVTQCPKRKEKVEETELYLNLERIPWIVRKLLQVSESTGVALKRSSWLIVLLVLLTVSLSPVQSAPVGHGKTIETYQTREGFTSICLFMLGSILFIVSCLVKGLVDSVSDSFFPGLSVCKTCSIGSINGFEIESHKCYCSLFCCPYCRHYSADREIHQLHLSICKKRKTGSNVMLAVCKRMCFKATIEASRRALLIRSIINTTFVICILILAICVVSTSAVEMENLPAGTWEREEDLTNFCHQECQVTETECLCPYEALVLRKPLFLDSTVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRVNGHLIHKIEPHFNTSWMSWDGCDLDYYCNMGNWPSCTYTGVTQHNHAAFVNLLNIETDYTKTFHFHSKRVTAHGDTPQLDLKARPTYGAGEITVLVEVADMELHTKKVEISGLKFASLVCTGCYACSSGISCKVRIHVDEPDELTVHVKSSDPDVVAASTSLMARKLEFGTDSIFKAFSAMPKTSLCFYIVEREYCKSCSEDDTKKCVDTKLEQPQSILIEHKGTIIGKQNDTCTAKASCWLESVKSFFYGLKNMLGSVFGNFFVGILLFLAPFVLLVLFFMFGWKILFCFKCCRRTRGLFKYRHLKDDEETGYRRIIERLNSKKGKNRLLDGERLADRKIAELFSTKTHIG

SEQ ID NO: 1311 - protein, 1683 aa, Artificial Sequence
  derived and/or modified protein sequence (wt) from CCHFV(Drosdov)__DQ211630.1__GP
MHALLVCFILYLQLSGLGGAHRQSNATEHNGTNTTTAPGTSQSPKPPVSTTLPHTPEASTIKLTTPTSETEGSGETTPPPNTTQGLPLPGTTPERSATTATSTSSTDDMNSTTQMTDNTPTSTVSIGLSSSPSMPSTSQGIHYPVRSLLSVSSPKTATTPTPMSPGEVSPETSSQHSAMSRIPTLYTATQVSTENTNRSIPRQSESSVQPATQSPITSPAQTILLMSAAPTAIQDMHPSPKNRSKRNLEVEIILTLSQGLKKYYGKILKLLHLTLEEDTEGLLEWCKRNLGSNCDDDFFQKRIEEFFITGEGYFNEVLQFKTPSTLSPTEPSHVRLPTAEPFKSYFAKGFLSIDSGYFSAKCYPRSSTSGLQLINVTQHPARIAETPGPKTTSLKTINCINLRASVFKEHREVEINVLLPQIAVNLSNCHVVINSHVCDYSLDTDGPVRLPRIHHEGAFIPGTYKIVIDKKNKLNDRCSLVTNCVIKGREVRKGQSVLRQYKTEIKIGKASTGSRKLLSEEPGDDCISRTQLLKTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLKCSYNICPYCASRLTSDGLARHVTQCPKRKEKVEETELYLNLERIPWIVRKLLQVSESTGVALKRSSWLIVLLVLLTVSLSPVQSAPVGHGKTIETYQTREGFTSICLFMLGSILFIVSCLVKGLVDSVSDSFFPGLSVCKTCSIGSINGFEIESHKCYCSLFCCPYCRHYSADREIHQLHLSICKKRKTGSNVMLAVCKRMCFKATIEASRRALLIRSIINTTFVICILILAICVVSTSAVEMENLPAGTWEREEDLTNFCHQECQVTETECLCPYEALVLRKPLFLDSTVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYMKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRVNGHLIHKIEPHFNTSWMSWDGCDLDYYCNMGNWPSCTYTGVTQHNHAAFVNLLNIETDYTKTFHFHSKRVTAHGDTPQLDLKARPTYGAGEITVLVEVADMELHTKKVEISGLKFASLVCTGCYACSSGISCKVRIHVDEPDELTVHVKSSDPDVVAASTSLMARKLEFGTDSIFKAFSAMPKTSLCFYIVEREYCKSCSEDDTKKCVDTKLEQPQSILIEHKGTIIGKQNDTCTAKASCWLESVKSFFYGLKNMLGSVFGNFFVGILLFLAPFVLLVLFFMFGWKILFCFKCCRRTRGLFKYRHLKDDEETGYRRIIERLNSKKGKNRLLDGERLADRKIAELFSTKTHIG

SEQ ID NO: 1312 - protein, 1683 aa, Artificial Sequence
  derived and/or modified protein sequence (wt) from CCHFV(44-ST-2010)__KR814859.1__GP
MHTLLVCFILYLQLSGLGGAHGQSNATEHNGTNTTTVPGTSQSPKPPASTTLPHTPESSTVKLTTPTSETEGSGETTPPPNTTQGLPPPGTTPERPATTATSMSSTDNMNSTTQVTDNTPTSTVSISPSSSPSMPSTSQGIHYPVRSLLSVSSPKTVTTPTPMSPGEMSPETSSQHSAMSRIPTLYTATQVSTENTNRSTPRQSESSAQPATQSPTTSPTQTILLMSAAPKAIQDMHPSPTNRSKRNLEVEIILTLSQGLKKYYGKILKLLHLTLEEDTEGLLEWCKRNLGSNCDDDFFQKRIEEFFITGEGYFNEVLQFKTLSTLSPTEPSHVRLPTAEPFKSYFAKGFLSIDSGYFSAKCYPRSSTSGLQLINVTQHPARIAETPGPKTTSLKTINCINLRASVFKEHREVEINVLLPQIAVNLSNCHVVINSHVCDYSLDTDGPVRLPRIHHEGTFIPGTYKIVIDKKNKLNDRCSLVTNCVIKGREVRKGQSVLRQYKTEIKIGKASTGSRKLLSEEPGDDCISRTQLLKTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEIMIPKGTGDILVDCSGGQQHFLKDNLIDLGCPHIPLLGKMAIYICRMSNHPRTTMAFLLWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLTVSLSPVQSAPVGHGKTIETYQTREGFTNICLFMLGSILFIVSCLVKGLVDSVSDSFFPGLSVCKTCSFGSINGFEIESHKCYCSLFCCPYCRHCSADREIHQLHLGICKKRKTGSNVMLAVCKRMCFKATIEASRRALLIRSIINTTFVICILTLAICVVSTSAVEMENLPAGTWEREEDLTNFCHQECQVSETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRLNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEDDTKKCVDTKLDQPQSILIEHKGTIIGKQNDTCTAKASCWLESVKSFFYGLKNMLGSVFGNFFVGILLFLAPFVLLVLFFMCGWKILFCFKCCRRTRGLFKYRHLKDDEETGYRRIIERLNSKKGKNRLLDGERLADRKIAELFSTKSHIG

SEQ ID NO: 1313 - protein, 1683 aa, Artificial Sequence
  derived and/or modified protein sequence (wt) from CCHFV(3756-ST-2007)__KR814866.1__GP
MHTLLVCFILYLQLSGLGGAHGQSNATEHNRTNTTTVPGTSQSPKPPASTTLPHTPESSTVKLTTPTSETEGSGETTPPPNTTQGLPLPGTTPERSATTATSTSSTDNMNTTTQVTDNTPTSTVSISPSSSPSMPSTSQGIHYPVRSLLSVSSPKTVTTPTPMSPGEMSPETSSQHSAMSRIPTLYTATQVSTENINRSTPRQSESSVQPATQSPITSPAQTILLMSAAPKAIQDMHPSPTNRSKRNLEVEIILTLSQGLKKYYGKILKLLHLTLEEDTEGLLEWCKRNLGSNCDDDFFQKRIEEFFITGEGYFNEVLQFKTLSTLSPTEPSHVRLPTAEPFKSYFAKGFLSIDSGYFSAKCYPRSSTSGLQLINVTQHPARIAETPGPKTTSLKTINCINLRASVFKEHREVEINVLLPQIAVNLSNCHVVINSHVCDYSLDTDGPVRLPRIHHEGTFIPGTYKIVIDRKNKLNDRCSLVTNCVIKGREVRKGQSVLRQYKTEIKIGKASTGSRKLLSEEPGDDCISRTQLLKTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEIMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLTVSLSPVQSAPVGHGKTIETYQTREGFTSICLFMLGSILFIVSCLVKGLVDSVSDSFFPGLSVCKTCSIGSINGFEIESHKCYCSLFCCPYCRHCSADREIHQLHLSICKKRKTGSNVMLAVCKRMCFKATIEASRRALLIRSIINTTFVICILTLAICVVSTSAVEMEDLPAGTWEREEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLTCTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGSFFVGILLFLTPFVLLVLFFMFGWKILFCFKCCRRTRGLFKYRHLKDDEETGYRRIIERLNSKKGKNRLLDGERLADRKIAELFSTKTHIG

SEQ ID NO: 1314 - protein, 1683 aa, Artificial Sequence
  derived and/or modified protein sequence (wt) from CCHFV(47-ST-2013)__KR814861.1__GP
MHTLLACFILYLQLSGLGGAHGQSNATEHNGTNTTTVPGTSQSPKPPASTTLPHTPESSTVKLTTPTSETEGSGETTPPPNTTQGLPPPGTTPERSATTATSTSSTDNMNSTTQMTGNTPTPTVNMSPSSSPSMPSTSQGIHYPVRSLLSVPSPKTATTPTPVSPGEMSPETSSQHSATSRIPTLYTATQVSTENTNRSTPRQSKSSVQPATQSPITPPAQTILLMSAAPKAIQDMHPSPTNRSKRNLEVEIILTLSQGLKKYYGKILKLLHLTLEEDTEGLLEWCKRNLGSNCDDDFFQKRIEEFFITGEGYFNEVLQFKTLSTLSPTEPSHVRLPTAEPFKSYYAKGFLSLDSGYFSAKCYPRSSTSGLQLINVTQHPARIAETPGPKTTSLKTINCINLRASVFKEHREVEINVLLPQIAVNLSNCHVVINSHVCDYPLDTDGPVRLPRIHHEGTFIPGTYKIVIDKKNKLNDRCSLVTNCVIKGREVRKGQSVLRQYKTEIKIGKASTGSRKLLSEEPGDDCISRTQLLKTETAEIHDDNYGGPGDKITICNGSTIVDQRLGSELGCYTINRVKSFKLCKNSATGKTCEIDSTPVKCRQGFCLKITQEGRGHVKLSRGSEVVLDACDSSCEIMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLTVSLSPVQSAPVGHGKTIETYQTREGFTSICLFMLGSILFIVSCLVKGLVDSVSDSFFPGLSVCRTCSIGSINGFEIESHKCYCSLFCCPYCRHCSADREIHQLHLSICKKRKTGSNVMLAVCKRMCFKATIEASRRALFIRSIINTTFVTCILTLAICVVSTSAVEMEDLPAGTWEREEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGECPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEVSGLKFASLACTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGNFFVGILLFLAPFVLLVLFFMFGWKILFCFKCCRRTRGLFKYRHLKDDEETGYRRIIERLNSKKGKNRLLDGERLADRKIAELFSTKTHIG

SEQ ID NO: 1315 - protein, 1683 aa, Artificial Sequence
  derived and/or modified protein sequence (wt) from CCHFV(1-CR/HU-2015)__KU161584.1__GP
MHTLLVCFILYLQLLGLGGAHEQSNATDHNRTNTITAPSTSQNPKPPASTTPPHTPESSTIKLITSTGEAEGSGETTPPLNTTQGPFPPETTSEHPASTATNTSSTNSMNSTTQMTDNTLTSTVSTSLSISPSTPSTSQGIHYPVRSLLSVSSPKTAATPTPMSTREMSSETSSQHSAMSRTPTFHTATQVSTENANRSTPRQSESSAQPATQSPMTSPAQSIFLVSAAPTTIQNIHPSPTNRSKRNLEMEIILTLPQGLKKYYGKILKLLHLTLEEDTEGLLEWCKRNLGSNCDDEFFQKRIEEFFITGEGYFNEVLQFKTLSTLSPTEPSHARPPTAEPFKSYFAKGFLSIDSGYFSAKCYPRSSTSGLQLINITQHPARIAETPGPKTTSLKTINCINLRASVFKEHREVEINVLLPQIAVNLSNCHVVINSHVCDYSLDTDGPVRLPRIYHEGTFIPGTYKIVIDKKNKLNDRCTLVTNCVIKGREVRKGQSVLRQYKTEIKIGKASTGSRKLLSEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLTVSLSPVQSAPVGHGKTIETYQTREGFTSICLFMLGSILFIVSCLVKGLVDSVSDSFFPGLSVCRTCSIGSINGFEIESHKCYCSLFCCPYCRHCSADREIHQLHLSICKKRKTGSNVMLAVCKRMCFRATMEASRRALLIRSIINTTFVICILTLTICVVSTSAVEMENLPAGTWEREEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGNFFIGILLFLAPFVLLVLFFMFGWKILFCFKCCRRTRGLFKYRHLKDDEETGYRRIIERLNNKKGKNRLLDGERLADRKIAELFSTKTHIG

SEQ ID NO: 1316 - protein, 1682 aa, Artificial Sequence
  derived and/or modified protein sequence (wt) from CCHFV(3820-ST-2007)__KR814868.1__GP
MHTLLVCFILYLQLSGLGGAHGQSNATEHNGTNTTTVPGTSQSPKPPASTTLPHTPESSTVKLTTPTSETEGSGETTPPNTTQGLPLPGTTPERSATTATSTSSTDNMNSTTQVTDNTPTSTVSISPSSSSSMPSTSQGIHHPVRSLLSVSSPKTVTTPTPMSPGEMSPETSSQHSAMSRVPTLYTATQISTENTDRSTPRQSESSVQPATQSPITSPAQTILLMSAAPKAIQDMHPSPTNRSKRNLEVEIILTLSQGLKKYYGKILKLLHLTLEEDTEGLLEWCKRNLGSNCDDDFFQKRIEEFFITGEGYFNEVLQFKTLSTLSPTEPSHVRLPTAEPFKSYFAKGFLSIDSGYFSAKCYPRSSTSGLQLINVTQHPARIAETPGPKTTSLKTINCINLRASVFKEHREVEINVLLPQIAVNLSNCHVVINSHVCDYSLDTDGPVRLPRIHHEGTFIPGTYKIVIDRKNKLNDRCSLVTNCVIKGREVRKGQSVLRQYKTEIKIGKTSTGSRKLLSEEPGDDCISRTQLLKTETAEIHDDNYGSPGDKITICNGSTIVDQRLGSELGCYTINRVKSFKLCENSATGKTCEIDSTPVKCRQGFCLKITQEGRGHVKLSRGSEVVLDACDSSCEIMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLAVSLSPVQSAPVGHGKTIETYQTREGFTSICLFMLGSILFIVSCLVKGLVDSVSDSFFPGLSVCKTCSIGSINGFEIESHKCYCSLFCCPYCRHCSADREIHQLHLSICKKRKTGSNVMLAVCKRMCFKATIEASRRALLIRSIINTTFVMCILTLAICVVSTSAVEMEDLPAGTWEREEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLTCTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGSFFVGILLFLAPFVLLVLFFMFGWKILFCFKCCRRTRGLFKYRHLKDDEETGYRRIIERLNSKKGKNRLLDGERLADRKIAELFSTKTHIG

SEQ ID NO: 1317 - protein, 1683 aa, Artificial Sequence
  derived and/or modified protein sequence (wt) from CCHFV(Ast199)__KX056051.1__GP
MHTLLVCFILYLQLSGLGGAHVQSNATEHNGTNTTTVPGTSQSPKPPASTTLPHTPESSTVKLTTPTSETEGSGETTPPPNTTQGLPPPGTTPERPATTATTTSSTDNMNSTTQVTDNTPTSTVSISPSSNPSMPSTSQGIHYPVRSLLSVSSPKTVTTPTPMSPGEMSPETSSQHSAMSRIPTLYTAAQVSTENTNRSTPRQSESSAQPATQSPTTFPAQTIPLMSAAPKAIQDMHPSPTNRSKRNLEVEIILTLSQGLKKYYGKILKLLHLTLEEDTEGLLEWCKRNLGSNCDDDFFQKRIEEFFITGEGYFNEVLQFKTPSTLSPTEPSHVRLPTAEPFKSYFAKGFLSIDSGYFSAKCYPRSSTSGLQLINVTQHPARIAETPGPKTTSLKTINCINLRASVFKEHREVEINVLLPQIAVNLSNCHVVINSHVCDYSLDTDGPVRLPRIHHEGTFIPGTYKIVIDKKNKLNDRCSLVTNCVIKGREVRKGQSVLRQYKTEIKIGKASTGSRKLLSEEPGDDCISRTQLLKTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEIMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRCSWLIVLLVLLTVSLSPVQSAPVGHGKTIETYQTREGFTNICLFMLGSILFIVSCLVKGLVDSVSDSFFPGLSVCKTCSIGSINGFEIESHKCYCSLFCCPYCRHCSADREIHQLHLGICKKRKTGSNVMLAVCKRMCFKATIEASRRALLIRSIINTTFVICILTLAICVVSTSAVEMENLPAGTWEREEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRLNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEVSGLKFASLACTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGNFFVGILLFLAPFVLLVLFFIFGWKILFCFKCCRRTRGLFKYRHLKDDEETGYRKIIERLNSKKGKNRLLDGERLADRKIAELFSTKTHIG

SEQ ID NO: 1318 - protein, 1683 aa, Artificial Sequence
  derived and/or modified protein sequence (wt) from CCHFV(Turkey200310849)__DQ211636.1__GP
MHTLLVCFILYLQLLCLGGAHGQLNTTEHNGTNNTTAPGASQSPKPPMSTTPPHAPESSTIKPTTPISEAEGSGETTSTPNTTQGLSSPETTSERPATTAISTSSTDSTNPTTQMTDNTPTLTVSTSPSSSPSTPSTPQGIYHPARSLLSVSSPKTVTTPTPTSPGEMSSETSSQHSAMSRIPTPHTATRVSTENTNHSTPRQSESSAQQTTPSPMTSPAQSILLMSAAPTAVQDIHPSPTNRSKRNLETEIILTLSQGLKKYYGKILKLLHLTLEEDTEGLLEWCKRNLGSNCDDDFFQKRIEEFFMTGEGYFNEVLQFKTLSTLSPTEPSHARLPTAEPFKSYFAKGFLSIDSGYFSAKCYPRSSASGLQLINVTQHPARIAETPGPKTTSLKTINCINLRASVFKEHREIEINVLLPQIAVNLSNCHVVINSHVCDYSLDTDGPVRLPRIYHEGTFIPGTYKIVIDKKNKLNDRCTLVTNCVIKGREVRKGQSVLRQYKTEIKIGKASTGFRKLLSEEPGDDCISRTQLLRTETAEIHDDNYGGPGDKITICNGSTIVDQRLGSELGCYTINRVKSFKLCENSATGKTCEVDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCISCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLTVSLSPVQSAPVGHGKTIEIYQTREGFASICLFMLGSILFIVSCLVKGLVDSVSDSFFPGLSVCKTCSIGSVNGFEIESHKCYCSLFCCPYCRHCSADREIHQLHLSICKKRKTGSNVMLAVCKRMCFRATIEASRRALLIRSIINTTFVICILTLTICVVSTSAVEMENLPAGTWEREEDLTNFCHQECQVTETECLCPYEALVLRKPLFLDSIVKGMKNLLNSTSLETSLSIEAPWGAINVQSTFKPAVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQVYHIGNLLKGDRVNGHLIHKIESHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEDDTQKCVDTRLEQPQSILIEHKGTIIGKQNDTCTAKASCWLESVKSFFYGLKNMLGSVFGNLFIGILLFLAPFVLLVLFFMFGWKILFCFKCCRRTRGLFKYRHLKDDEETGYRRIIERLNSKKGKNRLLDGDRLADRKIAELFSTKTHIG

SEQ ID NO: 1319 - protein, 1683 aa, Artificial Sequence
  derived and/or modified protein sequence (wt) from CCHFV(5170-R-2011)__KR814873.1__GP
MHTLLVCFILYLQLSGLGGAHGQSNETEHNGTNTTTVPGTSQSPKPPASTTLQHTPESSTVKLTTPTSETEGSGETTPPPNTTQGLPPPGTTPERSATTATSTSSTDNMNSTTQVTDNTPTSTVSISPSSSPSMPSTSQGIHYPIRSLLSVSSPKTVTTPTPISPGEMSPETSSQHSAMSRIPTLYTATQVSTENTNRSTPRQSESSVQPATQSPITSPAQTILLMSAAPKAIQDMHPSPTNRSKRNLEVEIILTLSQGLKKYYGKILKLLHLTLEEDTEGLLEWCKRNLGSNCDDDFFQKRIEEFFITGEGYFNEVLQFKTLSTLSPTELSHVRLPTAEPFKSYFAKGFLSIDSGYFSAKCYPRSSTSGLQLINVTQHPARIAETPGPKTTSLKTINCINLRASVFKEHREVEINVLLPQIAVNLSNCHVVINSHVCDYSLDTDGPVRLPRIHHEGTFIPGTYKIVIDKKNKLNDRCSLVTNCVIKGREVRKGQSVLRQYKTEIKIGKASTGSRKLLSEEPGDDCISRTQLLKTETAEIHDDNYGGPGDKITICNGSTIVDQRLGSELGCYTINRVKSFKLCENSATGKTCEIDSTPVKCRQGFCLKITQEGRGHVKLSRGSEVVLDVCDSSCEIMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSEGLARHVTQCPKRKEKVEETELYLNLERIPWIVRKLLQVSESTGVALKRSSWLIVLLVLLTVSLSPVQSAPVGHGKTIETYQTREGFTSICLFMLGSILFIVSCLVKGLVDSVSDSFFPGLSVCKTCSIGSINGFEIESHKCYCSLFCCPYCRHCSADREIHQLHLSICKKRKTGSNVMLAVCKRMCFKATIEASRRALLIRSIINTTFVICILTLAICVVSTSAVEMEDLPAGTWEREEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLTCTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGSFFVGILLFLAPFVLLVLFFMFGWKILFCFKCCRRTRGLFKYRHLKDDEETGYRRIIERLNSKKGKNRLLDGERLADRKIAELFSTKTHIG

SEQ ID NO: 1320 - protein, 1684 aa, Artificial Sequence
  derived and/or modified protein sequence (wt) from CCHFV(SCT ex Afghanistan)__KC344856.1__GP
MYTLLVCAILCPQPWSLEGTHVPLNGTKHNGTGITAAPGGSQGPTSPASTAVSLTPDPFTTEPTASAVELESSGEGHTSLSVTTQGLTSPETTPGLPTVTDTGVSSTSIFGIGIRVAGDTPTSTTHTGLPSSPSMPSTAQGPHHAVRGLLSVSSTRPGEASTITVPGEAGTEANSSSSAISKKPAPSPTAEAITEANNSSNPRQPELSTQPAIPGLVTSSAQPILLQSATSTAAQDIYPSPTNRSKRNLEMEIILTLSQGLKKYYGKILRILDLTLEEDTEGLLEWCKRNLGLTCNDNFFQERIEEFFLTGEGHFNEVLQFKTPSTLSPTEPTHTRTPTVKPFKSYFARGFLSIDSGYFSAKCYSKTSNSGLQLINITQHPARIADTPGPKITNLKAINCINLKASVFKEHREIEINVLLPQVAVNLSNCHVLIKSHVCDYSLDIDGAVRLPHVHHKGTFIPGTYKIVIDKRNKQNDRCTLVTNCVIKGKEIRKGQSALRQYRTEIRIGKASAGSRRLLSEESGDDCISRTQLLRTETAEVHNDNYGGPGDKITICNGSTIVDQRLGSELGCYTINRVKSFKLCENSATGKSCKIDSTPVKCRQGFCLKITQEGRGHVKLSRGSEVVLDACDSSCEIMIPKGTGDILVDCSGGQQHFLKDNLIDLGCPNIPLLGKMAIYICRMSNHPKTTMAFLFWFSFGYVITCIFCKVIFYLLIVVGTLGKKFKQYRELKPQTCTICETTPTNAIDAEMHDLNCSYNICPYCASRLTSDGLARHVTQCPKRKEKVEETELYLNLERIPWIVRKLLQVSESTGVALKRSSWLIVLLVLLTVSLSPVQSAPIGHGKTIETYQTREGYISVCLFVLGGILFVVSCLIKGLVDSVGNSFFPGLSICKTCSIGSVNGFEIESHKCYCSLLCCPYCRHCSTDREIHQLHLSICKKRRTGGNVMLAVCKRMCFRATMEVSNKVLFIRNIINTTFVICILILAVCVVSTSAVEMESLPAGTWEREEDLTNFCHQECQVTETECLCPYEALVLRKPLFLNSIVKGMKNLLNSTNLETSLSIEAPWGAINVQSTFKPTVSTANIALSWSSVEHRGNKILVSGRSESIMKLEERTGISWDLGVEDASESKSLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKLNGHMIHKIEPHFNTSWMSWDGCDLDYYCNMGDWPSCTYTGVTQHNHAAFVNLLNIETDYTKNFHFHSKRVTAHGDTPQLDLKARPTYGAGEITVLVEVADMELHTKKIDISGLKFASLTCAGCYACSSGISCKVRIHVDEPDELTVHVKSEDPDIVAASTSLIARKLELGTDSTFKAFSAMPKTSLCFYIVEREYCKSCSKEDTQKCVNTKLEHPQGILIEHKGTIIGKQNDTCTAKAGCWLESVKSFFYGLKNMLSGIFGNVFIGIFLFLAPFVLLILFFMFGWRLLFCFKCCRRTRGLFKYRHLKEDEESGYRRIIERLNNKKGKNKLLDGERLADRRIAELFSTKTHIG

SEQ ID NO: 1321 - protein, 1684 aa, Artificial Sequence
  derived and/or modified protein sequence (wt) from CCHFV(SPU 44/08)__KJ682805.1__GP
MYTPLLCAILCLQLWSLEGIYGLSNNTQHNDTSTIKVPEESQKTSLPANTASPITSDPPPTTPTASASGPEGSGDTSTSPPVTTQGPTPPETTPEPHTTIDIDKSSTAIADISTQTVKNIPTPTAHTSLPSTLSAPTMPQEAHHTARGLLSVTSTKPGEASTPTSPGEASTEASSPQPTIRETPSPPPTTQTPTEINNPNTSRQPMPSTQPAAPSSVTHPAQPTPSQSDVPTAAQDIHPSPTNRSKRNLEMEIILTLSQGLKKYYGKVLKLLDLTLEEDTEGLLEWCKRNLGLTCDDNFFQKRIEEFFLTGEGHFNEVLQFKTPSTLSPTEPARVESPTVEPFKSYFAKGFLLMDSGYFSAKCYPKSSNSGLQLINVTQHLIRITDTPGPKITNLKTINCINLKALVFKEHREIEINVLLPQVAVNLSNCHVLIKSHVCDYSIDIDGPVRLPRIHHEGTFIPGTYKIVIDKKNKQNDRCTLVTNCVIKGREIRKGQSVLRQYRTEIKIGKASSGSRRLLSEESNDDCLSRTQLLRTENAEIHSDNYGGPGDKITICNGSTIVDQRLGSELGCYTINRVKSFKLCENSATGKSCEIDSTPVRCRQGFCLKITQEGRGHVKLSRGSEVVLDACDSSCEIMIPKGTGDILVDCSGGQQHFLKDNLVDLGCPNIPLLGKMAIYICRMSNHPKTTMAFLFWFSFGYVITCILCKAIFYLLIVVGTLGKKFKQYRELKPQTCTICETNPVNAIDAEMHDLNCSYNICPYCASRLTSDGLARHVMQCPKRKEKIEETELYLNLERIPWVVRKLLQVSESTGVALKRSSWLVILLVLLTVSLSPVQSAPISHGETVEVYQTREGYTSICLFVLGSILFLVSCLMRGLVDSVSNSFFPGLSICKTCSIGSINGFEIESHKCYCSLFCCPYCRHCSADIEIHKLHLSICKKRKTGSNVMLAVCKRMCFRATVEVSNKALLIRNIINTTFVVCILILAVCVVSTSAVEMENLPAGTWEKEEDLTNFCHQECQVTETECLCPYEALVLRKPLFLDSIVKGMKNLLNSTSLETSLSIEAPWGAINVQSTFKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVDYIKTEAIVCVELTSQERQCSLIEAGTRFNLGPVTITLSEPRNIQQKLPPEIVTLHPRIEEGFFDLMHIQKVLSASTVCKLQSCTHGVPGDLQIYHIGNLLKGDKVNGHLIHKIEPHFNTSWMSWDGCDLDYYCNMGDWPSCSYTGVTQHNHAAFVNMLNIETDYTKNFHFHSKRVTAHGDTPQLDLKARPTYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSKEDTQKCVNTKLEQPQSILIEHKGTIIGKQNDTCTAKASCWLESIKSFFYGLKNMLSGIFGNVFIGIFLFLAPFIMLILFFMFGWRILFCFKCCRRTRGLFKYRHLKDDEEIGYRKIIERLNNKKGKNKLLDGERLADRKIAELFSTKTHIG

SEQ ID NO: 1322 - protein, 1683 aa, Artificial Sequence
  derived and/or modified protein sequence (wt) from CCHFV(K323_27)__KX013472.1__GP
MHTLLVCFILYLQLSGLGGAHGQSNATEHNGTNTTTVPGTSQSPKPPASTTLPHTPESSTVKLTTPTSETEGSGETTPPPNTTQGLPLPGTTPERSATTATSTSSTDNMNSTTQVTDNTPTSTVSISPSSSPSMPSTSQGIHHPVRSLLSVSSPKTVTTPTPMSPGEMSPETSSQHSAMSRIPTLYTATQVSTENTDRSTPRQSESSVQPATQSPITSPAQTILLMSAAPKAIQDMHPSPTNRSKRNLEVEIILTLSQGLKKYYGKILKLLHLTLEEDTEGLLEWCKRNLGSNCDDDFFQKRIEEFFITGEGYFNEVLQFKTLSTLSPTESSHVRLPTAEPFKSYFAKGFLSIDSGYFSAKCYPRSSTSGLQLINVTQHPARIAETPGPKTTSLKTINCINLRASVFKEHREVEINVLLPQIAVNLSNCHVVISSHVCDYSLDTDGPVRLPRIHHEGTFIPGTYKIVIDRKDKLNDRCSLVTNCVIKGREVRKGQSVLRQYKTEIKIGKASTGSRKLLSEEPGDDCISRTQLLKTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEIMIPKGTGDILVDCSGGQQHFLKDNLIDLGCPHIPLLGKMAIYICRMSNHPRTTMAFLFWFSFGYVITCIFCKALFYLLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLTVLLVLLTVSLSPVQSAPVGHGNTIETYQTREGFTSICLFMLGSILFIVSCLVKGLVDSVSDSFFPGLSVCKTCSIGSINGFEIESHKCYCSLFCCPHCRHRSADREIHQLHLSICKKRKTGSNVMLAVCKRMCPKATIEASRRALPIRSIINTTLVMCILTLAICVVSTSAVEMEDLPAGTWEREEDLTNFCHQECQVTETECLCPYEALVLRKPLFLDSIAKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTGQERQCSLIEAGTRFNLGPVTITLSEPRNIQQKLPPEIITLHPKIEEGFFDLMHVQKVLSASTVCKLQSCTHGIPGDLQIYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLTCTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGSFFVGILLFLAPFVLLVLFFMFGWKILFCFKCCRRTRGLFKYRHLNDDEETGYRRIIERLNSKKGKNRLLDGERLADRKIAELFSTKTHIG

SEQ ID NO: 1323 - protein, 1683 aa, Artificial Sequence
  derived and/or modified protein sequence (wt) from CCHFV(1231-CR/TI-2015)__KU161585.1__GP
MHTLLVCFILYLQLLGLGGAHEQSNATDHNRTNTITAPSTSQNPKPPASTTPPHTPESSTIKLITSTGEAEGSGETTPPLNTTQGPFPPETTSEHPASTATNTSSTNSMNSTTQMTDKTLTSTVSTSLSISPSTPSTSQGIHYPIRSLLSVSSPRTAATPTPMSTREMSSETNSQHSAVSRTPTFHTATQVSTENDNRSTPRQSESSAQPATQSPMTSPAQSILLVSAAPTTIQNIHPSPTNRSKRNLEMEIILTLPQGLKKYYGKILKLLHLTLEEDTEGLLEWCKRNLGSNCDDEFFQKRIEEFFITGEGYFNEVLQFKTLSTLSPMEPSHARPPTAEPFKSYFAKGFLSIDSGYFSAKCYPRSSSSGLQLINITQHPARIAETPGPKTTSLKTINCINLRASVFKEHREVEINVLLPQIAVNLSNCHVVINSHVCDYSLDTDGPVRLPRIYHEGTFIPGTYKIVIDKKNKLNDRCTLVTNCVTKGREVRKGQSVLRQYKTEIKIGKASTGSRKLLSEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLTVSLSPVQSAPVGHGKTIETYQTREGFTSICLFMLGSILFIVSCLVKGLVESVSDSFFPGLSVCRTCSIGSINGFEIESHKCYCSLFCCPYCRHCSADREIHQLHLSICKKRKTGSNVMLAVCKRMCFRATMEASRRALLIRSIINTTFVICILTLTICVVSTSAVEMENLPAGTWEREEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGNFFIGILLFLAPFVLLVLFFMFGWKILFCFKCCRRTRGLFKYRHLKDDEETGYRRIIERLNNKKGKNRLLDGERLADRKIAELFSTKTHIG

SEQ ID NO: 1324 - protein, 1683 aa, Artificial Sequence
  derived and/or modified protein sequence (wt) from CCHFV(K229_194)__KX013463.1__GP
MHTLLVCFILYLQLSGLGGAHGQSNATEHNGTNTTTVPGTSQSPKPPASTTLPHTPESSTVKLTTPTSETEGSGETTPPPNTTQGLPPPGTTPERPATTATSTSSTDNMNSTTQVTDNTPISTVSISPSSSPSMPSTSQGIHYPVRSLLSVSSPKTVTTPTPMSPGEMSPETSSQHSAMSRIPTLYTATQVSTENTNRSTPRQSESSAQPATQSPTTSPTQTILLMSAAPKAIQDMHPSPTNRSKRNLEVEIILTLSQGLKKYYGKILKLLHLTLEEDTEGLLEWCKRNLGSNCDDDFFQKRIEEFFITGEGYFNEVLQFKTLNTLSPTEPSHVRLPTAEPFKSYFAKGFLSVDSGYFSAKCYPRSSTSGLQLINVTQHPARIAETPGPKTTSLKTINCINLRASVFKEHREVEINVLLPQIAVNLSNCHVVINSHVCDYSLDTDGPVRLPRIHHEGTFIPGTYKIVIDKKNKLNDRCSLVTNCVIKGREVRKGQSVLRQYKTEIKIGKASTGSRKLLSEEPGDDCISRTQLLKTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEIMIPKGTGDILVDCSGGQQHFLKGNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLTVSLSPVQSAPVGHGKTIETYQTREGFTNICLFMLGSILFIVSCLVKGLVDSVSDSFFPGLSVCKTCSIGSINGFEIESHKCYCSLFCCPYCRHCSADREIHQLHLGICKKRKTGSNVMLAVCKRMCFKATIEASRRALLIRSIINTTFVICILTLAICVVSTSAVEMENLPAGTWEREEDLTSFCHQECQVTETECLCPYEALVLRKPLFLDSIVKGKKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRLNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYSCSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGNFFVGILLFLAPFVLLVLFFMFGWKILFCFKCCRRTRGLFKYRHLKDDEETGYRKIIERLNSKKGKNRLLDGERLADRKIAELFSTKTHIG

SEQ ID NO: 1325 - protein, 1683 aa, Artificial Sequence
  derived and/or modified protein sequence (wt) from CCHFV(K315_14)__KX013469.1__GP
MHTLLVCFILYLQLSGLGGAHGQSNETEHNGTNTTTVPGTSQSPKPPASTTLQHTPESSTVKLTTPTSETEGSGETTPPPNTTQGLPPPGTTPERSATTATSTSSTDNMNSTTQVTDNTPTSTVSISPSSSPSMPSTSQGIHYPIRSLLSVSSPKTVTTPTPISPGEMSPETSSQHSAMSRIPTLYTATQVSTENTNRSTPRQSESSVQPATQSPITSPAQTILLMSAAPKAIQDMHPSPTNRSKRNLEVEIILTLSQGLKKYYGKILKLLHLTLEEDTEGLLEWCKRNLGSNCDDDFFQKRIEEFFITGEGYFNEVLQFKTLSTLSPTEPSHVRLPTAEPFKSYFAKGFLSIDSGYFSAKCYPRSSTSGLQLINVTQHPARIAETPGPKTTSLKTINCINLRASVFKEHREVEINVLLPQIAVNLSNCHVVINSHVCDYSLDTDGPVRLPRIHHEGTFIPGTYKIVIDKKNKLNDRCSLVTNCVIKGREVRKGQSVLRQYKTEIRIGKASTGSRKLLSEEPGDDCISRTQLLKTETAEIHDDNYGGPGDKITICNGSTVVDQRLGSELGCYTINRVKSFKLCKNSATGKTCEIDSTPVKCRQGFCLKITQEGRGHVKLSRGSEVVLDVCDSSCEIMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSEGLARHVTQCPKRKEKVEETELYLNLERIPWIVRKLLQVSESTGVALKRSSWLIVLLVLLTVSLSPVQSAPVGHGKTIETYQTREGFTSICLFMLGSILFIVSCLVKGLVYSVSDSFFPGLSVCKTCSIGSINGFEIESHKCYCSLFCCPYCRHCSADREIHQLHLSICKKRKTGSNVMLAVCKRMCFKATIEASRRALLIRSIINTTFVICILTLAICVVSTSAVEMEDLPAGTWEREEDLTNFCHQECQVTETECLCPYEALVLRKPLFLDSIVKGMKKLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLTCTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGSFFVGILLFLAPFVLLVLFFMFGWKILFCFKCCRRTRGLFKYRHLKDDEETGYRRIIERLNSKKGKNRLLDGERLADRKIAELFSTKTHIG

SEQ ID NO: 1326 - protein, 1684 aa, Artificial Sequence
  derived and/or modified protein sequence (wt) from CCHFV(BA8402)__AF350449.1__GP
MYTPLLCAVLCLQLWSLEGSHGLSNKTQHSNTSTTKAPEVSQELGLPVSTVSTITSEPPSITSAVSVSGSEGSGDTNTSPSVTTQGPTLPETTLEPLTTTDTDASSTVVVDVSTQTVKDTPISTTYTSLPSTPSEPTTPQGTHHTARGLLSVTSTKPEEASPQANPGKISMETNGPRLAISETPSFSPTTQAPTENSNPITSKQLMLSAQPVTPNPMTSPVQPALSQSDTSTAIQDVHPSPTGRSKRNLEMEIILTLSQGLKKYYGKILKLLDLTLEEDTEGLLEWCKRNLGLVCDDNFFQKRIEEFFLTGKGHFNEVLQFKTPSTLSPTGPARTGSPTVEPFKSYFAKGFLSMDSGYFSAKCYPRASNSGLQLINVTQHSTRITDTPGPKITNLKTINCINLKASVFKEHREIEINVLLPQVAVNLSSCHVLIKSHVCDYSLDIDGPVRLPRIHHEGTFIPGTYKIVIDKKNKQNDRCTLVTNCVIKGREIRKGQSVLRQYRTEIKIGKASSGSRRLLSEESGDDCISRTQLLRTETAEIHNDNYGGPGDKITICNGSTVVDQRLGSELGCYTINRVNSFNLCENTATGKSCEIDSTPVKCRQGFCLKITQEGRGHVKLSRGSEVVLDACESSCEIMIPKGTGDILVDCSGGQQHFLKDNLIDLGCPNIPLLGKMAIYICRMSNHPKTTMAFLFWFSFGYVVTCILCKVIFYLLIVVGTLGKKFKQYRELKPQTCTICETTPVNAIDAEMHDLNCSYNICPYCASRPTSDGLARHVMQCPKRKEKIEETALYLNLERIPWVVRKLLQVSESTGVALKRSSWLVVLLVLLTVSLSPVQSAPIGHGKTVETYQTREGYTSICLFVLGSILFIVSCLMKGLVDSVGNSFFPGLSICKTCSIGSVNGFEIESHKCYCSLFCCPYCRHCSADREIHRLHLSICKKRKTGSNVMLAVCKRMCFRATVEVSNKALLIRNIINTTFVLCILILAVCVVSTSAVEMESLPAGTWEREEDLTNFCHQECQVTETECLCPYEALVLRKPLFSDSIVKGMKNLLNSTSLETSLSIEAPWGAINVQSTFKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFIKWKVEYIKTEAIVCVELTSQERQCTLIEAGTRFNLGPVTITLSEPRNIQQKLPPEIVTLHPRIEEGFFDLMHVQKVLSASTVCKLQSCTHGVPGDLQVYHIGNLLKGDKVNGHLIHKIEPHFNTSWMSWDGCDLHYYCNMGDWPSCTYTGVTQHNHAAFVNMLNIETDYTKNFHFHSKRVTAHGDTPQLDLKARPTYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCESCSKEDTQKCVNTKLEQPQSILIEHKGTIIGKQSNTCTAKASCWLESVKSFFYGLKNMLSGIFGNVFIGVFLFFAPFILLILFFMFGWRILFCFKCCRRTRGLFKYRHLKDDEETGYRKIIERLNNKKGKNKLLDGERLADRKIAELFSTKTHIG

SEQ ID NO: 1327 - protein, 1684 aa, Artificial Sequence
  derived and/or modified protein sequence (wt) from CCHFV(UCCR4459)__KY484032.1__GP
MYTPLLCAVLCLQLWSLEGSHGLSNKTQHSNTSTTKAPEVSQEFGLPVSTVSTITSDPPSITSAVSVSGSEGSGDTNTSPSVTTQGLTLPETTLELLTTTDTDASSTVVVDVSTQTVKDTPISTTHTSLPSTPSATTTPQGTHHTARGLLSVTSTKPEGASTQANPEKISMETNSPRLAISETPSFSPTTQAPTENSNPITSKQLIFSAQPVTPNPVTPPVQPALSQSDTSTAIQDIHPSPTSRSKRNLEMEIILTLSQGLKKYYGKILKLLDLTLEEDTEGLLEWCKRNLGLVCDDDFFQKRIEEFFLTGEGHFNEVLQFKTPSTLSPTGPARTGSPTVEPFKSYFAKGFLSMDSGYFSAKCYPRASNSGLQLINVTQHSTRITDTPGPKVTNLKTINCINLKASVFKEHREIEINVLLPQVAVNLSSCHVLIKSHVCDYSLDIDGPVRLPRIHHEGTFIPGTYKLVIDKKNKQNDRCTLITNCVIKGREIRKGQSVLRQYRTEIKIGKASSGSRRLLSEESGDDCISRTQLSRTETAEIHSDNYGGPGDKITICNGSTIVDQRLGSELGCYTINRVKSFKLCENSATGKSCEIDSTPIKCRQGFCLKITQEGRGHVKLSRGSEVVLDACDSSCEIMIPKGTGDILVDCSGGQQHFLKDNLIDLGCPNIPLLGKMAIYICRMSNHPKTTMAFLFWFSFGYVITCILCKVIFYLLIVVGTLGKKFKQYRELKPQTCTICETTPVNAIDAEMHDLNCSYNICPYCASRLTSDGLARHVMQCPKRKEKVEETELYLNLERIPWVVRKLLQVSESTGVALKRSSWLVVLLVLLTVSLSPVQSAPIGHGKTVETYQTREGYTSICLFVLGSILFIVSCLMKGLVDSVGNSFFPGLSICKTCSIGSINGFEIESHKCYCSLFCCPYCRHCSADREIHKLHLSICKKRKTGSNVMLAVCKRMCFRATVEVSNKALLIRNIINTTFVVCILILAVCVVSTSAVEMESLPAGTWEREEDLTNFCHQECQVTETECLCPYEALVLRKPLFSDSIVKGMKNLLNSTSLETSLSIEAPWGAINVQSTFKPTVSAANIALSWSSVEHRGNKILVSGRSESIMKLEERTGISWDLGVEDASESKLLTVSIMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIVTLHPRIEEGFFDLMHVKKVLSASTVCKLQSCTHGVPGDLQVYHIGNLLKGDKVNGHLIHKIEPHFNTSWMSWDGCDLDYYCNMGDWPSCSYTGVTQHNHAAFVNMLNIETDYTKIFHFHSKRVTAHGDTPQLDLKARPTYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSKEDTQKCVNTKLEQPQSILIEHKGTIIGKQNDTCTSKAGCWLESVKSFFYGLKNMLSGIFGNVFIGIFLFLAPFILLILFFMFGWRILFCFKCCRRTRGLFKYRHLKDDEETGYRKIIERLNNKKGKNKLLDGERLADRKIAELFSTKTHIG

SEQ ID NO: 1328 - protein, 1683 aa, Artificial Sequence
  derived and/or modified protein sequence (wt) from CCHFV(Ast149)__KX056054.1__GP
MHTLLVCFILYLQLSGLGGAHGQSNATEHNGTNTTTAPGTSQSPKPPASTTPPHTPESSTVKLTTPTSETEGSGETTPPPNTTQGLPPPGTTPERPATTATSTSSTDNMNSTTQVTDNTPTSTVSTSPSSSPSMPSTSQGIHYPVRSLLSVSSPKTVTTPTPMSPGEMSPETSSQHSAMSRIPTLYTAAQVSTENANRSTPRQSESSAQPATQSPTTFPAQTILLMSAAPKAIQDMHPSPTNRSKRNLEVEIILTLSQGLKKYYGKILKLLHLTLEEDTEGLLEWCKRNLGSNCDDDFFQKRIEEFFITGEGYFNEVLQFKTLSTLSPTEPSHVRLPTAEPFKSYFAKGFLSIDSGYFSAKCYPRSSTSGLQLINVTQHPARIAETPGPKTTSLKTINCINLRASVFKEHREVEINVLLPQIAVNLSNCHVVIYSHVCDYSLDTDGPVRLPRIHHEGTFIPGTYKIVIDKKNKLNDRCSLVTNCVIKGREVRKGQSVLRQYKTEIKIGKASTGSRKLLSEEPGDDCISRTQLLKTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEIMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLTVSLSPVQSAPVGHGKTIETYQTREGFTNICLFMLGSILFIVSCLVKGLVDSVSDSFFPGLSVCKTCSIGSINGFEIESHKCYCSLFCCPYCRHCSADREIHQLHLGICKKRKTGSNVMLAVCKRMCFKATIEASRRALPIRSIINTTFVICILTLAICVVSTSAVEMENLPAGTWEREEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRLNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEVSGLKFASLACTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGNFFVGILLFLAPFVLLALFFIFGWKILFCFKCCRRTRGLFKYRHLKDDEETGYRKIIERLNSKKGKNRLLDGERLADRKIAELFSTKTHIG

SEQ ID NO: 1329 - protein, 1683 aa, Artificial Sequence
  derived and/or modified protein sequence (wt) from CCHFV(Ast137)__KX056057.1__GP
MHTLLVCFILYLQLSGLGGAHGQSNATEHNGTNTTTVPGTSQSPKPPASTTLPHTPESSTVKLTTPTSETEGSGETTPPPNTTQGLPPPGTTPERPATTATSTSSTDNMNSTTQVTDNTPTSTVSISPSSSPSMPSTSQGIHYPVRSLLSVSSPKTVTTPTPMSPGEMSPETSSQHSAMSRIPTLYTAAQVSTENTNRSTPRQSESSAQPATQSPTTFPAQTILLMSAAPKAIQDMHPSPTNRSKRNLEVEIILTLSQGLKKYYGKILKLLHLTLEEDTEGLLEWCKRNLGSNCDDDFFQKRIEEFFITGEGYFNEVLQFKTLSTLSPTEPSHVRLPTAEPFKSYFAKGFLSIDSGYFSAKCYPRSSTSGLQLINVTQHPARIAETPGPKTTSLKTINCINLRASVFKEHREVEINVLLPQIAVNLSNCHVVINSHVCDYSLDTDGPVRLPRIHHEGTFIPGTYKIVIDKKNKLNDRCSLVTNCVIKGREVRKGQSVLRQYKTEIKIGKASTGSRKLLSEEPGDDCISRTQLLKTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEIMIPKGTGDILVDCSGGQQHFLKDNLIDLGCPHIPLLGKMAIHICRMSNHPRTTMAFLFWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLTVSLSPVQSAPVGHGKTIETYQTREGFTNICLFMLGSILFIVSYLVKGLVDSVSDSFFPGLSVCKTCSIGSINGFEIESHKCYCSLFCCPYCRHCSADREIHQLHLGICKKRKTGSNVMLAVCKRMCFKATIEASRRALLIRSIINTTFVICILTLAICVVSTSAVEMENLPAGTWEREEDLTNFCHQECQVTETECLCPYEALVLRKPLFLDSIVKGTKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRLNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEVSGLKFASLACTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGNFFVGILLFLAPFVLLVLFFIFGWKILFCFKCCRRTRGLFKYRHLKDDEETGYRKIIERLNSKKGKNRLLDGERLADRKIAELFSTKTHIG

SEQ ID NO: 1330 - protein, 1684 aa, Artificial Sequence
  derived and/or modified protein sequence (wt) from CCHFV(C-68031)__DQ211629.1__GP
MYTPLLCAVLCLQLWSLEGSHGLSNKTQHSNTSTTKAPEVSQEFGLPVSTVSTITSDPPSITSAVSVSGSEGSGDTNTSPSVTTQGLTLPETTLELLTTTDTDASSTVVVDVSTQTVKDTPISTTHTSLPSTPSAPTTPQGTHHTARGLLSVTSTKPEGASTQANPEKISMETNSPRLAISETPSFSPTTQAPTENSNPITSKQLILSAQPVTPNPVTPPVQPALSQSDTSTAIQDIHPSPTSRSKRNLEMEIILTLSQGLKKYYGKILKLLDLTLEEDTEGLLEWCKRNLGLVCDDDFFQKRIEEFFLTGEGHFNEVLQFKTPSTLSPTGPARTGSPTVEPFKSYFAKGFLSMDSGYFSAKCYPRASNSGLQLINVTQHSTRITDTPGPKVTNLKTINCINLKASVFKEHREIEINVLLPQVAVNLSSCHVLIKSHVCDYSLDIDGPVRLPRIHHEGTFIPGTYKLVIDKKNKQNDRCTLITNCVIKGREIRKGQSVLRQYRTEIKIGKASSGSRRLLSEESGDDCISRTQLSRTETAEIHSDNYGGPGDKITICNGSTIVDQRLGSELGCYTINRVKSFKLCENSATGKSCEIDSTPIKCRQGFCLKITQEGRGHVKLSRGSEVVLDACDSSCEIMIPKGTGDILVDCSGGQQHFLKDNLIDLGCPNIPLLGKMAIYICRMSNHPKTTMAFLFWFSFGYVITCILCKVIFYLLIVVGTLGKKFKQYRELKPQTCTICETTPVNAIDAEMHDLNCSYNICPYCASRLTSDGLARHVMQCPKRKEKVEETELYLNLERIPWVVRKLLQVSESTGVALKRSSWLVVLLVLLTVSLSPVQSAPIGHGKTVETYQTREGYTSICLFVLGSILFIVSCLMKGLVDSVGNSFFPGLSICKTCSIGSINGFETESHKCYCSLFCCPYCRHCSADREIHKLHLSICKKRKTGSNVMLAVCKRMCFRATVEVSNKALLIRNIINTTFVVCILILAVCVVSTSAVEMESLPAGTWEREEDLTNFCHQECQVTETECLCPYEALVLRKPLFSDSIVKGMKNLLNSTSLETSLSIEAPWGAINVQSTFKPTVSAANIALSWSSVEHRGNKILVSGRSESIMKLEERTGISWDLGVEDASESKLLTVSIMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIVTLHPRIEEGFFDLMHVKKVLSASTVCKLQSCTHGVPGDLQVYHIGNLLKGDKVNGHLIHKIEPHFNTSWMSWDGCDLDYYCNMGDWPSCSYTGVTQHNHAAFVNMLNIETDYTKIFHFHSKRVTAHGDTPQLDLKARPTYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSKEDTQKCVNTKLEQPQSILIEHKGTIIGKQNDTCTSKAGCWLESVKSFFYGLKNMLSGIFGNVFIGIFLFLAPFILLILFFMFGWRILFCFKCCRRTRGLFKYRHLKDDEETGYRKIIERLNNKKGKNKLLDGERLADRKIAELFSTKTHIG

SEQ ID NO: 1331 - protein, 1683 aa, Artificial Sequence
  derived and/or modified protein sequence (wt) from CCHFV(K340_6)__KX013475.1__GP
MHTLLVCFILYLQLSGLGGAHVQSNATEHNGTNTTTAPGTSQSPKPPASTTLPHTPESSTVKPTTPTSETEGSGETTPPPNTTQGLPPTGTTPERSATTATSTSSTDNMNSTTQVTDSTPTSTVSTSPSSSSSMPSTSQGIHHPVRSLLSVSSPKTVTTPTPMSPGEMSPETSSQHSAMSRVPTLYTATQVSTENTDRSTPRQSESSVQPATQSPITSPAQTILLMSAAPKAIQDMHPSPTNRSKRNLEVEIILTLSQGLKKYYGKILKLLHLTLEEDTEGLLEWCKRNLGSNCDDDFFQKRIEEFFITGEGYFNEVLQFKTLSTLSPTEPSHVRLPTAEPFKSYFAKGFLSIDSGYFSAKCYPRSSTSGLQLINVTQHPARIAETPGPKTTSLKTINCINLRASVFKEHREVEINVLLPQIAVNLSNCHVVINSHVCDYSLDTDGPVRLPRIHHEGTFIPGTYKIVIDRKNKLNDRCSLVTNCVIKGREVRKGQSVLRQYKTEIKIGKASTGSRKLLSEEPGDDCISRTQLLKTETAEIHDDNYGGPGDKITICNGSTIVDQRLGSELGCYTINRVKSFKLCENSTTGKTCEIDSTPVKCRQGFCLKITQEGRGHVKLSRGSEVVLDACDSSCEIMIPKGTGDILVDCSGGQQHFLKDNLIDLGCPHIPPLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLTVSLSPVQSAPVGHGKTIETYQTREGFTSICLFMLGSILFIVSCLVKGLVDSVSDSFFPGLSVCKTCSIGSINGFEIESHKCYCSLFCCPYCRHCSADREIHQLHLSICKKRKTGSNVMLAVCKRMCFKATIEASRRALLIRSIINTTFVMCILTLAICVVSTSAVEMEDLPAGTWEREEDLTNFCHQECQVTETECLCPYEALVLRKPLSLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVTDMELHTKKVEISGLKFASLTCTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGSFFVGILLFLAPFVLLVLFFMFGWKILFCFKCCRRTRGLFKYRHFKDDEETGYRRIIERLNSKKGKNRLLDGERLADRKIAELFSTKTHIG

SEQ ID NO: 1332 - protein, 1684 aa, Artificial Sequence
  derived and/or modified protein sequence (wt) from CCHFV(Hy13)__AY900145.1__GP
MYTPLLCAVLCLQLWSLEGSHGLSNKTQHSNTSTTKAPEVSQEFGLPVSTVSTITSDPPSITSAVSVSGSEGSGDTNTSPSVTTQGLTLPETTLELLTTTDTDASSTVVVDVSTQTVKDTPISTTHTSLPSTPSATTTPQGTHHTARGLLSVTSTKPEGASTQANPEKISMETNSPRLAISETPSFSPTTQAPTENSNPITSKQLIFSAQPVTPNPVTPPVQPALSQSDTSTAIQDIHPSPTSRSKRNLEMEIILTLSQGLKKYYGKILKLLDLTLEEDTEGLLEWCKRNLGLVCDADFFQKRIEEFFLTGEGHFNEVLQFKTPSTLSPTGPARTGSPTVEPFKSYFAKGFLSMDSGYFSAKCYPRASNSGLQLINVTQHSTRITDTPGPKVTNLKTINCINLKASVFKEHREIEINVLLPQVAVNLSSCHVLIKSHVCDYSLDIDGPVRLPRIHHEGTFIPGTYKLVIDKKNKQNDRCTLITNCVIKGREIRKGQSVLRQYRTEIKIGKASSGSRRLLSEESGDDCISRTQLSRTETAEIHSDNYGGPGDKITICNGSTIVDQRLGSELGCYTINRVKSFKLCENSATGKSCEIDSTPIKCRQGFCLKITQEGRGHVKLSRGSEVVLDACDSSCEIMIPKGTGDILVDCSGGQQHFLKDNLIDLGCPNIPLLGKMAIYICRMSNHPKTTMAFLFWFSFGYVITCILCKVIFYLLIVVGTLGKKFKQYRELKPQTCTICETTPVNAIDAEMHDLNCSYNICPYCASRLTSDGLARHVMQCPKRKEKVEETELYLNLERIPWVVRKLLQVSESTGVALKRSSWLVVLLVLLTVSLSPVQSAPIGHGKTVETYQTREGYTSICLFVLGSILFIVSCLMKGLVDSVGNSFFPGSSICKTCSIGSINGFEIESHKCYCSLFCCPYCRHCSADREIHKLHLSICKKRKTGSNVMLAVCKRMCFRATVEVSNKALLIRNIINTTFVVCILILAVCVVSTSAVEMESLPAGTWEREEDLTNFCHQECQATETECLCPYEALVLRKPLFSDSIVKGMKNLLNSTSLETSLSIEAPWGAINVQSTFKPTVSAANIALSWSSVEHRGNKILVSGRSESIMKLEERTGISWDLGVEDASESKLLTVSIMDLSQMYSPVFEYLSGDRQVEEWPKATCTGDCPERCGCTSSTCLHKEWPHSRNWRCNPTWCWGVGTGCTCCGLDVKDLFTDHMFVKWKVEYIKTEAIVCVELTSQERQCSLIEAGTRFNLGPVTITLSEPRNIQQKLPPEIVTLHPRIEEGFFDLMHVKKVLSASTVCKLQSCTHGVPGDLQVYHIGNLLKGDKVNGHLIHKIEPHFNTSWMSWDGCDLDYYCNMGDWPSCSYTGVTQHNHAAFVNMLNIETDYTKIFHFHSKRVTAHGDTPQLDLKARPTYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSKEDTQKCVNTKLEQPQSILIEHKGTIIGKQNDTCTSKAGCWLESVKSFFYGLKNMLSGIFGNVFIGIFLFLAPFILLILFFMFGWRILFCFKCCRRTRGLFKYRHLKDDEETGYRKIIERLNNKKGKNKLLDGERLADRKIAELFSTKTHIG

SEQ ID NO: 1333 - protein, 1683 aa, Artificial Sequence
  derived and/or modified protein sequence (wt) from CCHFV(4574-ST-2008)__KR814870.1__GP
MHTLLVCFILYLQLLGPGGAHGQPNATEHNRTNTTTAPSTSQSPKPPVSTAPPHALESPTIKSTTPTSETEGSGETTSPPNTTQGPSLPETTPKRPATTATSTPSTDNTNSTTHVTDNNPTSTISTSPSSSPSTPSTPRGIHHPARNLLSVSSPKTATTPTPTSPGEISSETSSLHSAMSRTSTLYTATQASTENANHSAPRQSESPAQPTTTSLMTSPAQSILVMSAAPTAIQNIHPSPTNRSKRNLEMEIILTLSQGLKKYYGKILKLLHLTLEEDTEGLLEWCKRNLGSNCEDDFFQKRIEEFFMTGEGYFNEVLQFKTLSTLSPTEPSHARPPTVEPFKSYFAKGFLSIDSGYFSAKCYPRSSTSGLQLINVTQHPARIAETPGPKTTSLKTINCINLRASVFKEHREIEINVLLPQIAVNLSNCHVVINSHVCDYSLDTDGPVRLPHIYHEGTFIPGTYKIVIDKKNKLNDRCTLVTNCVIKGREVRKGQSVLRQYKTEIKIGKVSTGSRKLLSEESGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCLFCKALFYSLIIIGTLGKKIKQYRELRPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVGHGKTIETYQTREGFTSICLFMLGSILFLVSCLVKGLVDSVSDSFFPGLSVCKTCSIGSINGFEIESHKCYCSLLCCPYCRHCSADREIHQLHLSICKKRKTGSNVMLAVCKRMCFRATIEASRRALLIRSIINTTFVICILTLTICVVSTSAVEMENLPSGTWEKEEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEEDTQKCVDTKLEQPQSILIEHKGTIIGKQNDTCTAKASCWLESVKSFFYGLKNMLGSVFGNFFIGILLFLAPFVLLVLFFMFGWKILFCFKCCRRARGLLKYRHLKDDEETGYRKIIERLNNKKGKNRLLDGERLADRKIAELFSTKTHIG

SEQ ID NO: 1334 - protein, 1683 aa, Artificial Sequence
  derived and/or modified protein sequence (wt) from CCHFV(75-ST-2010)__KR814864.1__GP
MHTLLVCFILYLQLLGPGGAHGQPNATEHNRTNTTTAPSTSQSPKPPVSTAPPHALESPTIKSTTPTSETEGSGETTPPPNTTQGPSLPETTPERPATTATSTPSTDNTNSTTHVTDNNPTSTISTSPSSSPSTPSTPRGIHHPARNLLSVSSPKTATTPTPTSPGEISSETSSLHSAMSRTSTLYTATQASTENANHSAPRQSESPAQPTTTSLMTSPAQSILVMSAAPTAIQNIHPSPTNRSKRNLEMEIILTLSQGLKKYYGKILKLLHLTLEEDTEGLLEWCKRNLGSNCDDDFFQKRIEEFFMTGEGYFNEVLQFKTLSTLSPTEPSHARPPTVEPFKSYFAKGFLSIDSGYFSAKCYPRSSTSGLQLINVTQHPARIAETPGPKTTSLKTINCINLRASVFKEHREIEINVLLPQIAVNLSNCHVVINSHVCDYSLDTDGPVRLPHIYHEGTFIPGTYKIVIDKKNKLNDRCTLVTNCVIKGREVRKGQSVLRQYKTEIKIGKVSTGSRKLLSEESGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCLFCKALFYSLIIIGTLGKKIKQYRELRPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVGHGKTIETYQTREGFTSICLFMLGSILFLVSCLVKGLVDSVSDSFFPGLSVCKTCSIGSINGFEIESHKCYCSLLCCPYCRHCSADREIHQLHLSICKKRKTGSNVMLAVCKRMCFRATIEASRRALLIRSIINTTFVICILTLTICVVSTSAVEMENLPSGTWEKEEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEEDTQKCVDTKLEQPQSILIEHKGTIIGKQNDTCTAKASCWLESVKSFFYGLKNMLGSVFGNFFIGILLFLAPFVLLVLFFMFGWKILFCFKCCRRARGLLKYRHLKDDEETGYRKIIERLNNKKGKNRLLDGERLADRKIAELFSTKTHIG

SEQ ID NO: 1335 - protein, 1683 aa, Artificial Sequence
  derived and/or modified protein sequence (wt) from CCHFV(37-R-2013)__KR814858.1__GP
MHTLLVCFILYLQLLGLGGAHRQSNATEHNGTNTTTAPSTSQSPKPPVSTAPPHAPETSTIKPTTPASETEGSGETTPPPNTTQGPSPPEATPERPATTVTSTPSTDNTNSTTHATDNNPTSTISTSPSSSPSTPSTPQGIHHPARNLLSVSSPKTATTPTPTSPGDISSETSSLHSAMSRTPTLHTATQASTENANHSAPRQSESSAQQTTTSPMTSPAQPILVMSAAPTAIQNIHPSPTNRSKRNLEMEIILTLSQGLKKYYGKILKLLHLTLEEDTEGLLEWCKRNLGSNCDDDFFQKRIEEFFMTGEGYFNEVLQFKTLSTLSPTEPSHARPPTVEPFKSYFAKGFLSIDSGYFSAKCYPRLTTSGLQLINVTQHPARIAETPGPKTTSLKTINCINLRASVFKEHREIEINVLLPQIAVNLSNCHVVINSHVCDYSLDTDGPVRLPHIYHEGTFIPGTYKIVIDKKNKLNDRCTLVTNCVIKGREVRKGQSVLRQYKTEIKIGKASTGSRKLLSEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDTSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVGHGKTIETYQTREGFTSVCLFMLGSILFLVSCLVKGLVDSVSDSFFPGLSVCKTCSIGSINGFEIESHKCYCSLFCCPYCRHCSADREIHQLHLSICKKRKMGSNVMLAVCKRMCFRATIEASRRALLIRSIINTTFVICILTLTICVVSTSAVEMENLPSGTWEREEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVDDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSNDPDVVAASTSLMARKLEFGTDSTFKAFSAMPKTSLCFYIVEREYCKSCSEEDTQKCVDTKLEQPQSILIEHKGTIIGKQNVTCTAKASCWLESVKSFFYGLKNMLGSVFGNFFIGILLFLAPFVLLVLFFMFGWKILFCFKCCRRTRGLLKYRLLKDDEETGYRRIIERLNNKKGKNRLLDGERLADRKIAELFSTKTHIG

SEQ ID NO: 1336 - protein, 1683 aa, Artificial Sequence
  derived and/or modified protein sequence (wt) from CCHFV(Kashmanov)__DQ211631.1__GP
MHTLLVCFILYLQLLGLGGAHGQSNATEHNGTNTTTAPSTSQSPKPLVSTAPPHALESSTIKPTTPASETEGSGETTPPPNTTQGPSPPETTPERPATTATSTPSTDNTNSTTHVTDNNPTSTISTSPSSSPSTPSTPQGIHHPARNLLSVSSPKTATTPTPTSPGEISSEASSLHSAMSRTSTLYTATQVSTENANHSAPRQSESSAQPTTTSPMTSPAQSILVMSAAPIAIQNIHPSPTNRSKRNLEMEIILTLSQGLKKYYGKILKLLHLTLEEDTEGLLEWCKRNLGSNCDDDFFQKRIEEFFMTGEGYFNEVLQFKTLSTLSPTEPSHAGPPTVEPFKSYFAKGFLSIDSGYFSAKCYPRSSTSGLQLINVTQHPARIAETPGPKTTSLKTINCINLRASVFKEHREIEINVLLPQIAVNLSNCHVVINSHVCDYSLDTDGPVRLPHIYHEGTFIPGTYKIVIDKKNKLNDRCTLVTNCVIKGREVRKGQSVLRQYKTEIKIGKASTGSRKLLSEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVGHGKTIETYQTREGFTSICLFMLGSILFLVSCLVKGLVDSVSDSFFPGLSVCKTCTIGSINGFEIESHKCYCSLFCCPYCRHCSADREIHQLHLSICKKRKTGSNVMLAVCKRMCFRATIEASRRALLIRSIINTTFVICILTLTICVVSTSAVEMENLPSGTWEREEDLTNFCHQECQVTETECLCPYEALVLRKPLFLDSIVKGMKNSLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRINGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEEDTQKCVDTKLEQPQSILIEHKGTIIGKQNDTCTAKASCWLESVKSFFYGLKNMLGSVFGNFFIGILLFLAPFVLLVLFFMFGWKILFCFKCCRRTRGLLKYRHLKDDEETGYRRIIERLNNKKGKNRLLDGERLADRKIAELFSTKTHIG

SEQ ID NO: 1337 - protein, 1683 aa, Artificial Sequence
  derived and/or modified protein sequence (wt) from CCHFV(Haskovo-V46/13)__KR092379.1__GP
MHTLLVCFILYLQLLGLGGAHGQSNTTEHNGTNNTTAPGTSQSPKPHMSTTPPHAPESSTIKPTTPTSETEGSGETTPPSNTTQGPSPPETTSERPATTAISTSSTDNMNPTSQMTDNTPTSTVSISPSSSPSTPSTPQGMHHPARSLLSVSSPKTATTPTPTSPVEVGSETSSQHSAMSSTPTPHTATQVSTENTNHSTPRQSEPSAQQTTPSPMPSPAQSTLLMSAAPTAVQNTHPSPTNRSKRNLEMEIILTLSQGLKKYYGKILKLLHLTLEEDTEGLLEWCKRNLGSNCDDDFFQKRIEEFFMTGEGYFNEVLQFKTLSTLSPMEPSHAELPTAEPFKSYFAKGFLSIDSGYFSAKCYPRSSTSGLQLINVTQHPARIAETPGPKTTSLKAINCINLRASVFKEHREIEINVLLPQIAVNLSNCHVVINSHVCDYSLDTDGPVRLPHIYHEGTFIPGTYKIVIDKKNKLNDRCTLVTNCVIKGREVRKGQSVLRQYKTEIKIGKASTGSRKLLSEELGDDCISRTQLLRTETAEIHDDNYGGPGDKITICNGSTIVDQRLGSELGCYTINRGKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETTPVNAIDAEMHDLNCSYNICPYCASRLTSDGLARHVTQCPKRKEKVEETELYLNLERIPWIVRKLLQVSESTGVALKRSSWLIVLLVLLPVSLSPVQSAPVGHGKTIETYQTREGFTSICLFMLGSILFIVSCLVKGLVDSVGDSFFPGLSVCKTCSIGSINGFEIESHKCYCSLFCCPYCRHCSADREIHQLHLSICKKRKTGSNVMLAVCKRMCFRATIEASRRALLIRSIINTTFAMCILTLTICVVSTSAVEMENLPAGTWEREEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLTCTGCYACSSGISCKVRIHVDEPDELTVHVKSSDPDVVAAGTSLMARKLEFGTDSTFKAFSAMPKTSLCFYIVEREYCKSCSEDDTQKCVDTKLEQPQSILIEHKGTIIGKQNDTCTARASCWLESVKSFFYGLKNMLGSVFGNFLIGILLFLAPFVLLVLFFMFGWKILFCFKCCRRTRGLFKYRHLKDDEETGYRRIIERLNSKKGKNRLLDGERLADRKIAELFSTKTHIG

SEQ ID NO: 1338 - protein, 1683 aa, Artificial Sequence
  derived and/or modified protein sequence (wt) from CCHFV(Min)__KX013481.1__GP
MHTLLVCFILYLQLLGLGGAHGQSNATEHNGTNTTTAPSTSQSPKPLVSTAPPHALESSTIKPTTPASETEGSGETTPPPNTTQGPSPPETTPERPATTATSTPSTDNTNSTTHVTDNNPTSTISTSPSSSPSTPSTPQGIHHPARNLLSVSSLKTATTPTPTSPGEISSETSSLHSAMSRTSTLYTATQVSTENANHSAPRQSESSAQPTTTSPMTSPAQSILVMSAAPIAIQNIHPSPTNRSKRNLEMEIILTLSQGLKKYYGKILKLLHLTLEEDTEGLLEWCKRNLGSNCDDDFFQKRIEEFFMTGEGYFNEVLQFKTLSTLSPTEPSHARPPTVEPFKSYFAKGFLSIDSGYFSAKCYPRSSTSGLQLINVTQHPARIAETPGPKTTSLKTINCINLRASVFKEHREIEINVLLPQIAVNLSNCHVVINSHVCDYSLDTDGPVRLPHIYHEGTFIPGTYKIVIDKKNKLNDRCTLVTNCVIKGREVRKGQSVLRQYKTEIKIGKASTGSRKLLSEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVGHGKTIETYQTREGFTSICLFMLGSILFLVSCLVKGLVDSVSDSFFPGLSVCKTCTIGSINGFEIESHKCYCSLFCCPYCRHCSADREIHQLHLSICKKRKTGSNVMLAVCKRMCFRATIEASRRALLIRSIINTTFVICILTLTICVVSTSAVEMENLPSGTWEREEDLTNFCHQECQVTETECLCPYEALVLRKPLFLDSIVKGTKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRINGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEEDTQKCVDTKLEQPQSILIEHKGTIIGKQNDTCTAKASCWLESVKSFFYGLKNMLGSVFGNFFIGILLFLAPFVLLVLFFMFGWKILFCFKCCRRTRGLLKYRHLKDDEETGYRRIIERLNNKKGKNRLLDGERLADRKIAELFSTKTHIG

SEQ ID NO: 1339 - protein, 1683 aa, Artificial Sequence
  derived and/or modified protein sequence (wt) from CCHFV(Kosovo/9553/2001)__AY675511.1__GP
MHTLLVCFILYLQLLGLGGAHGQSNATEHNGTNTTTAPGTSQSPKPPASTTPSHAPESSTIKLTTPTSETEGSGETTPPTSTTQGSPPLETTPERSTTTATSTSGTDNMNSTTQMTDNTPTLTASTSPSSSPSTPSTSQGLHYPVRSLLSVSSPKTVTTPTPMSPGEMSSETSSQHSAMSRTPTPHTATQVSTENANRSTSRQSESSAQPATQSPVTSPAQSILLMSATPTTIQNIHPSPTNRSKRNLEMEIILTLSQGLKKYYGKILKLLHLTLEEDTEGLLEWCKRNLGSNCDDDFFQKRIEEFFITGEGYFNEVLQFKTLSTPSPTEPSHARLPTAEPFKSYFAKGFLSIDSGYFSAKCYPRSSTSGLQLINVTQHPARIAETPGPKITSLKTINCINLRASVFKEHREVEINVLLPQIAVNLSNCHVVINSHVCDYSLDTDGPVRLPRIYHEGTFMPGTYKIVIDRKNKLNDRCTLVTNCVIKGREVRKGQSVLRQYKTEIKIGKAPTGSRKLLSEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYIARMSNHPKTTMAFLFWFSLGYVITCILCKALFYSLIIIGTLGKKIKQYRELKPQTCTICETAPVNAIDAEMHDLNCSYNICPYCASRLTSDGLARHVKQCPKRKEKVEETELYLNLERIPWVVRKLLQVSESTGVALKRSSWLIVLLVLLTVSLSPVQSAPVGHGKTIETYQTREGFTSICLFMLGSILFIVSCLVKGLVDSVSDSFFPGLSVCKTCSIGSINGFEIESHKCYCSLFCCPYCRHCSADREIHQLHLSICKKRKTGSNVMLAVCKRMCFRATIEASRRALLIRSIINTTFVICILTLTICVASTSAVEMETLPAATWEREEDLTNFCHQECQVPETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEKEYCKSCSEDDTKKCVDTKLEQPQSILIEHRGTIIGKPNDTCPAKTSCWLESVKSFFYGLKNMLGSVFGNFFIGILLFLAPFFLWMLSFMFGWKILFCFKCCRRTRGLFKYRHLKDDEETGYRRIIERLNNKKGKNRLLDGERLADRKIAELFSTKTHIG

SEQ ID NO: 1340 - protein, 1683 aa, Artificial Sequence
  derived and/or modified protein sequence (wt) from CCHFV(4495-ST-2008)__KR814869.1__GP
MHTLLVCFILYLQLLGPGGAHGQPNATEHNRTNTTTAPSTSQSPKPPVSTAPPHALESPTIKSTTPTSETEGSGETTPPPNTTQGPSPPETTPERPATTATSTPSTDNTNSTTHVTDNNPTSTISTSPSSSPSTPSTPRGIHHPARNLLSVSSPKTATTPTPTSPGEISSETSSLHSAMSRTSTLYTATQASTENANHSTPRQSESPAQPTTTSLMTSPAQSILVMSAAPTAIQNIHPSPTNRSKRNLEMEIILTLSQGLKKYYGKILKLLHLTLEEDTEGLLEWCKRNLGSNCDDDFFQKRIEEFFMTGEGYFNEVLQFKTLSTLSPTEPSHARPPTVEPFKSYFAKGFLSIDSGYFSAKCYPRSSTSGLQLINVTQHPARIAETPGPKTTSLKTINCINLRASVFKEHREIEINVLLPQIAVNLSNCHVVINSHVCDYSLDTDGPVRLPHIYHEGTFIPGTYKIVIDKKNKLNDRCTLVTNCVIKGREVRKGQSVLRQYKTEIKIGKVSTGSRKLLSEESGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCLFCKALFYSLIIIGTLGKKIKQYRELRPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVGHGKTIETYQTREGFTSICLFMLGSILFLVSCLVKGLVDSVSDSFFPGLSVCKTCSIGSINGFEIESHKCYCSLLCCPYCRHCSADREIHQLHLSICKKRKTGSNVMLAVCKRMCFRATIEASRRALLIRSIINTTFVICILTLTICVVSTSAVEMENLPSGTWEKEEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGISWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEEDTQRCVDTKLEQPQSILIEHKGTIIGKQNDTCTAKASCWLESVKSFFYGLKNMLGSVFGNFFIGILLFLAPFVLLVLFFMFGWKILFCFKCCRRARGLLKYRHLKDDEETGYRKIIERLNNKKGKNRLLDGERLADRKIAELFSTKTHIG

SEQ ID NO: 1341 - protein, 1683 aa, Artificial Sequence
  derived and/or modified protein sequence (wt) from CCHFV(Mamon)__KX013478.1__GP
MHTLLVCFILYLQLLGLGGAHGQSNTTEHNGTNTTTAPSTSQSPKPLVSTAPPHALESSTIKPTTPASETEGSGETTPPPNITQGPSPPETTPERPATTATSTPSTDNTNSTTHVTDNNPTSTISTSPSSSPSTPSTPQGIHHPARNLLSVSSPKTATTPTPTSPGEISSKTSSLHSAMSRTSTLYTATQVSTENANHSAPRQSESSAQPTTTSPMTSPAQSILVMSAAPTAIQNIHPSPTNRSKRNLEMEIILTLSQGLKKYYGKILKLLHLTLEEDTEGLLEWCKRNLGSNCDDDFFQKRIEEFFMTGEGYFNEVLQFKTLSTLSPTEPSHARPPTVEPFKSYFAKGFLSIDSGYFSAKCYPRSSTSGLQLINVTQHPARIAETPGPKTTSLKTINCINLRASVFKEHREIEINVLLPQIAVNLSNCHVVINSHVCDYSLDTDGPVRLPHIYHEGTFIPGTYKIVIDKKNKLNDRCTLVTNCVIKGREVRKGQSVLRQYKTEIKIGKASTGSRKLLSEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVSDACDSSCEVMIPKGTGDILVDCSGGQQHFLKDNLIDLGCPHIPLLGKMAIYICRMSNHPRTTVAFLFWFSFGYVITCIFCKALFYSLIIIGTLGKKIKQYRELKPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVGHGKTIETYQTREGFTSICLFMLGSILFLVSCLVKGLVDSVSDSFFPGLSVCKTCSIGSINGFEIESHKCYCSLFCCPYCRHCSADREIHQLHLSICKKRKTGSNVMLAVCKRMCFRATIEASRRALLIRSIINTTFVICILTLTICVVSTSAVEMENLPSGTWEREEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEEDTQKCVDTKLEQPQSILIEHKGTIIGKQNDTCTAKTSCWLESVKSFFYGLKNMLGSVFGNFFIGILLFLAPFVLLVLFFMFGWKILFCFKCCRRTRGLLKYRHLKDDEETGYRRIIERLNNKKGKNRLLDGERLADRKIAELFSTKTHIG

SEQ ID NO: 1342 - protein, 1683 aa, Artificial Sequence
  derived and/or modified protein sequence (wt) from CCHFV(81-R-2014)__KR814865.1__GP
MHTLLVCFILYLQLLGLGGAHGQSNATEHNGTNTTTVPSTSQSPKPLVSTTPPHALESSTIKPTTPTSETEGSGETAPLPNTTQGPPPPETTPERPATTVTSTPSTDNTNSTIHVTDNNPTSTISTSPSSSPSTPSTPQGIHHPARSLLSVSSPKTATTPTPTSPGEINSETSSLHSAMSRTPTLHTATQVSTENANHSAPRQSESSAQPTTTSLMTSPAQSILLMSAAPTAIQNTHPSPTNRSKRNLEMEIILTLSQGLKKYYGKILKLLHLTLEEDTEGLLEWCKRNLGSNCDDDFFQKRIGEFFMTGEGYFNEVLQFKTLSTLSPTEPSHARLPTVEPFKSYFAKGFLSIDSGYFSAKCYPRSSTSGLQLINVTQHPARIAETPGPKTTSLKTINCINLRASVFKEHREIEINVLLPQIAVNLSNCHVVINSHVCDYSLDTDGPVRLPHIYHEGTFIPGTYKIVIDKKNKLNDRCTLVTNCVIKGREVRKGQSVLRQYKTEIKIGKASTGSRKLLSEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVGHGKTIETYQTREGFTSICLFMLGSILFLVSCLVKGLVDSVSDSFFPGLSVCKTCSIGSINGFEIESHKCYCSLFCCPYCRHCSADREIHQLHLSICKKRKTGSNVMLAVCKRMCFRATIEASRRALLIRSIINTTFVICILTLTICVVSTSAVEMENLPAGTWEREEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRINGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEEDTQKCVDTRLEQPQSILIEHKGTIIGKQNDTCTAKASCWLESVKSFFYGLKNMLGSVFGNFFIGILLFLAPFVLLVLFFMFGWKILFCFKCCRRTRGLLKYRHLKDDEETGYRRIIERLNNKKGKNRLLDGERLADRKIAELFSTKTHIG

SEQ ID NO: 1343 - protein, 1683 aa, Artificial Sequence
  derived and/or modified protein sequence (wt) from CCHFV(5180-R-2011)__KR814874.1__GP
MHTLLVCFILYLQLLGLGGAHRQSNATEHNGTNTTTAPSTSQSPKPPVSTAPPYAPESSTIKPTTPASETEGSGETTPPPNTTQGPSPPEATPERPATTATSTPSTDNTNSTTHATDNNPTSTISTSPSSSPSTPSTPQGIHHPARNLLSVSSPKTATTPTPTSPGDISSETSSLHSAMSRTPTLHTATQASTENANHSAPRQSESSAQQTTTSPMTSPAQPILVMSAAPTAIQNIHPSPTNRSKRNLEMEIILTLSQGLKKYYGKILKLLHLTLEEDTEGLLEWCKRNLGSNCDDDFFQKRIEEFFMTGEGYFNEVLQFKTLSTLSPTEPSHARPPTVEPFKSYFAKGFLSIDSGYFSAKCYPRLSTSGLQLINVTQHPARIAETPGPKTTSLKTINCINLRASVFKEHREIEINVLLPQIAVNLSNCHVVINSHVCDYSLDTDGPVRLPHIYHEGTFIPGTYKIVIDKKNKLNDRCTLVTNCVIKGREIRKGQSVLRQYKTEIKIGKASTGSRKLLSEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDTSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVGHGKTIETYQTREGFTSVCLFMLGSILFLVSCLVKGLVDSVSDSFFPGLSVCKTCSIGSINGFEIESHKCYCSLFCCPYCRHCSADREIHQLHLSICKKRKMGSNVMLAVCKRMCFRATIEASRRALLIRSIINTTFVICILTLTICVVSTSAVEMENLPSGTWEREEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSNDPDVVAASTSLMARKLEFGTDSTFKAFSAMPKTSLCFYIVEREYCKSCSEEDTQKCVDTKLEQPQSILIEHKGTIIGKQNDTCTAKASCWLESVKSFFYGLKNMLGSVFGNFFIGILLFLAPFVLLVLFFMFGWKILFCFKCCRRTRGLLKYRLLKDDEETGYRRIIERLNNKKGKNRLLDGERLADRKIAELFSTKTHIG

SEQ ID NO: 1344 - protein, 1683 aa, Artificial Sequence
  derived and/or modified protein sequence (wt) from CCHFV(24-R-2012)__KR814856.1__GP
MHTLLVCFILYLQLLGLGGAHRQSNATEHNGTNTTTAPSTSQSPKPPVSTAPPHAPESSTIKPTTPASETEGSGETTPPPNTTQGPSPPEATPERTATTATSTPSTDNTNSTTHATDNNPTSTISTSPSSSPSTPSTPQGIHHPARNLLSVSSPKTATTPTPTSPGDISSETSSLHSAMSRTPTLHTATQASTENANHSAPRQSESSAQQTTTSPMTSPAQPILVMSAAPTAIQNIHPSPTNRSKRNLEMEIILTLSQGLKKYYGKILKLLHLTLEEDTEGLLEWCKRNLGSNCDDDFFQKRIEEFFMTGEGYFNEVLQFKTLSTLSPTEPSHARPPTVEPFKSYFAKGFLSIDSGYFSAKCYPRLSTSGLQLINVTQHPARIAETPGPKTTSLKTINCINLRASVFKEHREIEINVLLPQIAVNLSNCHVVINSHVCDYSLDTDGPVRLPHIYHEGTFIPGTYKIVIDKKNKLNDRCTLVTNCVIKGREVRKGQSVLRQYKTEIKIGKASTGSRKLLSEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDTSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVGHGKTIETYQTREGFTSVCLFMLGSILFLVSCLVKGLVDSVSDSFFPGLSVCKTCSIGSINGFEIESHKCYCSLFCCPYCRHCSADREIHQLHLSICKKRKMGSNVMLAVCKRMCFRATIEASRRALLIRSIINTTFVICILTLTICVVSTSAVEMENLPSGTWEREEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSNDPDVVAASTSLMARKLEFGTDSTFKAFSAMPKTSLCFYIVEREYCKSCSEEDTQKCVDTKLEQPQSILIEHKGTIIGKQNDTCTAKASCWLESVKSFFYGLKNMLGSVFGNFFIGILLFLAPFVLLVLFFMFGWKILFCFKCCRRTRGLLKYRLLKDDEETGYRRIIERLNNKKGKNRLLDGERLADRKIAELFSTKTHIG

SEQ ID NO: 1345 - protein, 1683 aa, Artificial Sequence
  derived and/or modified protein sequence (wt) from CCHFV(46-ST-2012)__KR814860.1__GP
MHTLLVCFILYLQLLGLGGAHGQSNATEHNGTNTTTVPSTSQSPKPLVSTTPPHALESSTIKPTTPTSETEGSGETAPLPNTTQGPPPPETTPERPATTVTSTPSTDNTSSTIHVTDNNPTSTISTSPSSSPSTPSTPQGIHHPARSLLSVSSPKTATTPTPTSPGEINSETSSLHSAMSRTPTLHTATQVSTENANHSAPRQSESSAQPTTTSLMTSPAQSILLMSAAPTAIQNIHPSPTNRSKRNLEMEIILTLSQGLKKYYGKILKLLHLTLEEDTEGLLEWCKRNLGSNCDDDFFQKRIEEFFMTGEGYFNEVLQFKTLSTLSPTEPSHARLPTVEPFKSYFAKGFLSVDSGYFSAKCYPRSSTSGLQLINVTQHPARIAETPGPKTTSLKTINCINLRASVFKEHREIEINVLLPQIAVNLSNCHVVINSHVCDYSLDTDGPVRLPHIYHEGTFIPGTYKIVIDKKNKLNDRCTLVTNCVIKGREVRKGQSVLRQYKTEIKIGKASTGSRKLLSEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVGHGKTIETYQTREGFTSICLFMLGSILFLVSCLVKGLVDSVSDSFFPGLSVCKTCSIGSINGFEIESHKCYCSLFCCPYCRHCSADREIHQLHLSICKKRKTGSNVMLAVCKRMCFRATIEASRRALLIRSIINATFVICILTLTICVVSTSAVEMESLPAGTWEREEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRINGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEEDTQKCVDTRLEQPQSILIEHKGTIIGKQNDTCTAKASCWLESVKSFFYGLKNMLGSVFGNFFIGILLFLAPFVLLVLFFMFGWKILFCFKCCRRTRGLLKYRHLKDDEETGYRRIIERLNNKKGKNRLLDGERLADRKIAELFSTKTHIG

SEQ ID NO: 1346 - protein, 1683 aa, Artificial Sequence
  derived and/or modified protein sequence (wt) from CCHFV(ROS/HUVLV-100)__DQ206448.1__GP
MHTLLVCFILYLQLLGLGGAHRQSNATEHNGTNTTTAPSTSQSPKPLVSTAPPHALESSTIKPTTPVSETEGSGETTPPPNTTQGPSPPEATPERPTTTATSTPSTDNTNSTTHVTDNNPTSTISTSPSSSPSTPSTPQGIHHPARNLLSVSSPKTATTPTPTSPGEISSETSSLHSAMSRTSTLYTATQVSTENANHSAPRQSESSAQQTTTSPMTSPAQSILVMSAAPTAIQNIHPSPTNRSKRNLEMEIILTLSQGLKKYYGKILKLLHLTLEEDTEGLLEWCKRNLGSNCDDDFFQKRIEEFFMTGEGYFNEVLQFKTLSTLSPTEPSHARPPTVEPFKSYFAKGFLSIDSGYFSAKCYPRLSTSGLQLINVTQHPARIAETPGPKTTSLKTINCINLRASVFKEHREIEINVLLPQIAVNLSNCHVVINSHVCDYSLDTDGPVRLPHIYHEGTFIPGTYKIVIDKKNKLNDRCTLVTNCVIKGREVRKGQSVLRQYKTEIKIGKASTGSRKLLSEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVGHGKTIETYQTREGFTSICLFMLGSILFLVSCLVKGLVDSVSDSFFPGLSVCKTCSIGSINGFEIESHKCYCSLFCCPYCRHCSADREIHQLHLSICKKRKTGSNVMLAVCKRMCFRATIEASRRALLIRSIINTTFVICILTLTICVVSTSAVEMENLPSGTWEREEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEEDTQKCVDTKLEQPQSILIEHKGTIIGKQNDTCTAKASCWLESVKSFFYGLKNMLGSVFGNFFIGILLFLAPFVLLVLFFMFGWKILFCFKCCRRTRGLLKYRLLKDDEETGYRRIIERLNNKKGKNRLLDGERLADRKIAELFSTKTHIG

SEQ ID NO: 1347 - protein, 1683 aa, Artificial Sequence
  derived and/or modified protein sequence (wt) from CCHFV(Saf)__KX013487.1__GP
MHTLLVCFILYLQLLGLGGAHGQSNATEHNGTNTTTAPSTSQSPKPLVSTAPPHALESSTIKPTTPASETEGSGETTPPPNTTQGPSPPETTPERPATTATSTPSTDNTNSTTHVTDNNPTSTISTSPSSSPSTPSTPQGIHHPARNLLSVSSPKTATTPTPTSPGEISSETSSLHSAMSRTSTLYTATQVSTENANHSAPRQSESSAQPTTTSPMTSPAQSILVMSAAPTAIQNIHPSPTNRSKRNLEMEIILTLSQGLKKYYGKILKLLHLTLEEDTEGLLEWCKRNLGSNCDDDFFQKRIEEFFMTGEGYFNEVLQFKTLSTLSPTEPSHARPPTVEPFKSYFAKGFLSIDSGYFSAKCYPRSSTSGLQLINVTQHPARIAETPGPKTTSLKTINCINLRASVFKEHREIEINVLLPQIAVNLSNCHVVINSHVCDYSLDTDGPVRLPHIHHEGTFIPGTYKIVIDKENKLNDRCTLVTNCVIKGREVRKGQSVLRQYKTEIKIGKASTGSRKLLSEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHYLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVGHGKTIETYQTREGFTSICLFMLGSILFLVSCLVKGLVDSVSDSFFPGLSVCKTCSIGSINGFEIESHKCYCSLFCCPYCRHCSADREIHQLHLSICKKRKTGSNVMLAVCKRMCFRATIEASRRALLIRSIINTTFVICILTLTICVVSTSAVEMENLPSGTWEREEDLTNFCHQECQVTETECLCPYEALVLRKPLFSDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYMKTFHFHSKRVTAHGDTPQLDLKARPTYGAGEITVLVEVADMELHTKKVEISGLKFVSLACTGCYACSSGISCKVRIHVDEPDELTVHVKSSDPDVVAASTSLMARKLEFGTDSTFKAFSAMPKTSLCFYIVEREYCKSCSEEDTQKCVDTKLEQPQSILIEHKGTIIGKQNDTCTAKASCWLESVKSFFYGLKNMLGSVFGNFFIGILLFLAPFVLLVLFFMFGWKILFCFKCCRRTRGLLKYRHLKDDEETGYRRIIERLNNKKGKNRLLDGERLADRKIAELFSTKTHIG

SEQ ID NO: 1348 - protein, 1683 aa, Artificial Sequence
  derived and/or modified protein sequence (wt) from CCHFV(52-R-2014)__KR814862.1__GP
MHTLLVCFILYLQLLGLGGAHRQSNATEHNGTNTTTAPSTSQSPKPPVSTAPPHAPESSTIKPTTPASETEGSGETTPPPNTTQGPSPPEATPERPATTATSTPSTDNTNSTTHATDNNPTSTISTSPSSSPSTPSTPQGIHHPARNLLSVSSPKTATTPTPTSPGDISSETSSLHSAMSRTPTLHTATQASTENANHSAPRQSESSAQQTTTSPMTSPAQPILVMSAAPTAIQNIHPSPTNRSKRNLEMEIILTLSQGLKKYYGKILKLLHLTLEEDTEGLLEWCKRNLGSNCDDDFFQKRIEEFFMTGEGYFNEVLQFKTLSTLSPTEPSHARPPTVEPFKSYFAKGFLSIDSGYFSAKCYPRLSTSGLQLINVTQHPARIAETPGPKTTSLKTINCINLRASVFKEHREIEINVLLPQIAVNLSNCHVVINSHVCDYSLDTDGPVRLPHIYHEGTFIPGTYKIVIDKKNKLNDRCTLVTNCVIKGREVRKGQSVLRQYKTEIKIGKASTGSRKLLSEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDTSCEVMIPKGTGDILVDCSGGQQHFLKDNLIDLGCPHVPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVGHGKTIETYQTREGFTSVCLFMLGSILFLVSCLVKGLVDSVSDSFFPGLSVCKTCSIGSINGFEIESHKCYCSLFCCPYCRHCSADREIHQLHLSICKKRKMGSNVMLAVCKRMCFRATIEASRRALLIRSIINTTFVICILTLTICVVSTSAVEMENLPSGTWEREEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVDDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSNDPDVVAASTSLMARKLEFGTDSTFKAFSAMPKTSLCFYIVEREYCKSCSEEDTQKCVDTKLEQPQSILIEHKGTIIGKQNDTCTAKAGCWLESVKSFFYGLKNMLGSVFGNFFIGILLFLAPFVLLVLFFMFGWKILFCFKCCRRTRGLLKYRLLKDDEETGYRRIIERLNNKKGKNRLLDGERLADRKIAELFSTKTHIG

SEQ ID NO: 1349 - protein, 1683 aa, Artificial Sequence
  derived and/or modified protein sequence (wt) from CCHFV(Turkey-Kelkit06)__GQ337054.1__GP
MHTPLVCFILYLQLLCLGGAHGQLNATEHNGTNNTTAPGASQSPKPPMSTTPPHAPESSTIKPTTPISEAEGSGETTSPPNTTQGLSSPETTSERPATTSISTSSTDSTNPTTQMTDNTPTPTVSTSPSSSPSTPSTPQGIHHPARSLLSVSSPKTVTTPTPTSPGEMSSETSSQHSAMSRIPTPHTATRVSTEITNHRTPRQSESSAQQTTPSPMTSPAQSILLMSAAPTAVQDIHPSPTNRSKRNLETEIILTLSQGLKKYYGKILKLLHLTLEQDTEGLLEWCKGNLGSNCDDDFFQKRIEEFFMTGECYFNEVLQFKTLSTLSPTEPSHARLPTAEPFKSYFAKGFLSIDSGYFSAKCYPRSSASGLQLINVTQHPARIAETPGPKTTSLKTINCINLRASVFKEHREVEINVLLPQIAVNLSNCHVVINSHVCDYSLDTDGPVRLPRIYHEGTFIPGTYKIVIDKKNKLNDRCTLVTNCVIKGREVRKGQSVLRQYKTEIKIGKASTGFRKLLSEEPGDDCISRTQLLRTETAEIHDDNYGGPGDKITICNGSTIVDQRLGSELGCYTINRVKSFKLCKNSATGKTCEVDSTPVKCRQGFCLKITQEGRGHVKLSRGSEVVLDACDSSCEVMIPKGTGDILVDCSGGQQHFLKDNLIDLGCPHIPLLGRMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLTVSLSPVQSAPVGHGKTIEIYQTREGFASICLFMLGSILFIVSCLVKGLVDSVSESFFPGLSVCKTCSIGSVNGFEIESHKCYCSLFCCPYCRHCSADREIHQLHLSICKKRKTGSNVMLAVCKRMCFRATIEASRRALLIRSIINTTFVICILTLTICVVSTSAVEMENLPAGTWEREEDLTNFCHQECQVTETECLCPYEALVLRKPLFLDSIVKGMKNLLNSTSLETSLSIEAPWGAINVQSTFKPTVSTANIALSWSSVVHRGNKILVTGRSESIMKLEERTGVSWDLGVEDASESKLLTVSIMDLSQMYSPVFEYLSGDRQVEEWPKATCTGDCPERCGCTSSTCLHKEWSHSRNWRCNPTWCWGVGTGCTCCGVDVKDLFTDHMFVKWKVEYIKTEAIVCVALTSQERQCSLIEAGTRFNLGPVTITLSEPRNIQQKLPPEIITLHPKIEEGFFDLMHVQKVLSASTVCKLQSCTHGIPGDLQVYHIGNLLKGDRVNGHLIHKIESHFNTSWMSWDGCDLDYYCNMGDWPSCTYTGVTQHNHAAFVNLLNIETDYTKTFHFHSKRVTAHGDTPQLDLKARPTYGAGGITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEDDTQKCVDTRLEQPQSILIEHKGTIIGKQNDTCTAKASCWLESVKSFFYGLKNMLGSVFGNLFIGILLFLAPFVLLVLFFMFGWKILFCFKCCRRTRGLFKYRHLKDDEETGYRRIIERLNSKKGKNRLLDGDRLADRKIAELFSTKTHIG

SEQ ID NO: 1350 - protein, 1683 aa, Artificial Sequence
  derived and/or modified protein sequence (wt) from CCHFV(V42/81)__GU477490.1__GP
MHTLLVCFILYLQLLGLGGAHVQPNATEHNRTNTTTAPGTSHSLKPLVSTTPPQAPESSTIKPTTPTSETEGSGEATPLSNTIQAPSSPETTSERPATAVISTSGTDSTNSTTQTTDNNPTTTVGTSPSSSPSTPSTPQGIHHHARSLLSVTSPETVTTPKPTSPREMSSETSNQHSAMSRTPTHHTVTQVSTENTSHSTPRQPESSAQPTSSSPMTSPAQSTLLMSAAPTAVQSIHPSPTNRSKRNLETEIILTLSQGLKKYYGKILKLLHLTLEEDTEGLLEWCKRNLGSNCDDDFFQKRIEEFFMTGEGYFNEVLQFKTPSTVSPTEPSHARLPTAEPFKSYFAKGFLSIDSGYFSAKCYSRSSTSGLQLINVTQHPARIAETPGPKTTSLKTINCINLRASVFKENREIEISVLLPQIAVNLSNCHVVINSHVCDYSLDTDGPVRLPRINHEGTFIPGTYKIVIDKKNKLNDRCTLVTNCVIKGREVRKGQSVLRQYKTEIKIGKASTGSRKLLSKEPGDDCISRTQLMRTETAEIHDDNYGGPGDKITICNGSTIVDQRLGSELGCYTINRVKSFKLCENSATGKACEVDSTPVKCRQGFCLKITQEGRGHVKLSRGSEVVLDACDSSCEVMIPKGTGDILVDCSGGQQHFLKDNLIDLECPHIPLLGKLAIYICRMSNHPRTTMAFLFWFGFGYVITCILCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVVLKRSSWLIVLLVLLTVSLSPVQSAPVGHGKTIETYQTREGFTSICLFMLGSILFIVSCIVKGLVDSVSDSFFPGLSVCKTCSISSINGFEIESHKCYCSLFCCPYCRHCSADREIHQLHLSICRKRRTGSNVMLAVCKRMCFRATIEVSRRALLIRSIINTTFVICILTLTICVVSTSAVEMENLPAGTWEREEDLTNFCHQECQVTETECLCPYEALVLRKPLFLDSIVKGKKNLLNSTSLETSLSIEAPWGAINIQSTFKPTVSAANIALSWSSVEHRGNKILVSGRSESIMKLEERTGVSWNLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFIDHMFVKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGETPQLDLKARPAYGAGEITVLVEVADMELHTKKVEISGLKFASLACTGCYACSSGISCKVRIHVDEPDELTVHVKSNDPDVVAASTSLMARKLESGTDSTFKAFSAMPKTSLCFYIVEREYCKSCSEDDTQKCVETKLEQPQSILIEHKGTIIGKQNDTCTAKASCWLESVKSFFYGLKNMLGSVFGNFFIGILLFLAPFVLLVLFFMFGWKILFCFKCCRRTRGLFKYRHLKEDEETGYRRIIERLNSKKGKNRLLDGERLADRKIAELFSTKTHIG

SEQ ID NO: 1351 - protein, 1683 aa, Artificial Sequence
  derived and/or modified protein sequence (wt) from CCHFV(75-R-2012)__KR814863.1__GP
MHTLLVCFILYLQLLGLGGAHRQSNATGHNGTNTTTAPSTSQSPKPLVSTAPPHALESSIIKHTTPVSETEGSGETTPPPNTTQGPSPLETTPERPATTATSTPSTDNTNSTTHVTDNNPTSTISTSPSSSPSTPSTPQGIHHPARNLLSVSSLKTATTPTPTSPGEISSETSSLHSAMSRTSTLYTATQVSTENANHSAPRQSESSAQQTTTSPMTSPAQSILVMSAAPTAIQNTHPSPTNRSKRNLEMEIILTLSQGLKKYYGKILKLLHLTLEEDTEGLLEWCKRNLGSNCDDDFFQKRIEEFFMTGEGYFNEVLQFKTLSTQSPTEPSHARPPTVEPFKSYFAKGFLSIDSGYFSAKCYPRLSTSGLQLINVTQHPARIAETPGPKTTSLKTINCINLRASVFKEHREIEINVLLPQIAVNLSNCHVVINSHVCDYSLDTDGPVRLPHIYHEGTFIPGTYKIVIDKKNKLNDRCTLVTNCVIKGREVRKGQSVLRQYKTEIKIGKASTGSRKLLSEEPGDDCISRTQLLRTETAEIHDDNYGGPGDKITICNGSTIVDQRLGSELGCYTINRVKSFKLCENSATGKTCEIDSAPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVGHGKTIETYQTREGFTSICLFMLGSILFLVSCLVKGLVNSVSDSFFPGLSVCKTCSIGSINGFEIESHKCYCSLFCCPYCRHCSADREIHQLHLSICKKRKTGSNVMLAVCKRMCFRATIEASRRALLIRSIINTTFVICILTLTICVVSTSAVEMENLPSGTWEREEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEEDTQKCVDTKLEQPQSILIEHKGTIIGKQNDTCTAKASCWLESVKSFLYGLKNMLGSVFGNFFIGILLFLAPFVLLVLFFMFGWKILFCFKCCRRTRGLLKYRLLKDDEETGYRRIIERLNNKKGKNRLLDGERLADRKIAELFSTKTHIG

SEQ ID NO: 1352 - protein, 1683 aa, Artificial Sequence
  derived and/or modified protein sequence (wt) from CCHFV(VLG/TI29414)__AY179961.1__GP
MHTLLVCFILYLQLLGLGGAHIQSNATEHNGTNTTTAPSTSQSPKPLVSTAPPHALESSTIKPTTPVSETEGSGGTTPPPNTTQGPSPPEATPERPATTATSTPSTDNTNSTTHVTDNNPTSTISTSPSSSPSTPSTPQGIHHPARNLLSVSSPKTATTPTPTSPGDISSETSSLHSAMSRTSTLYTATQVSTENANHSAPRQSESSAQQTTTSPMTSPAQPILVMSAAPTAIQNIHPSPTNRSKRNLEMEIILTLSQGLKKYYGKILKLLHLTLEEDTEGLLEWCKRSLGSNCDDDFFQKRIEEFFMTGEGYFNEVLQFKTLSTLSPTEPSHARPPTVEPFKSYFAKGFLSIDSGYFSAKCYPRLSTSGLQLINVTQHPARIAETPGPKTTSLKTINCINLRASVFKEHREIEINVLLPQIAVNLSNCHVVINSHVCDYSLDTDGPVRLPHIYHEGTFIPGTYKIVIDKKNKLNDRCTLVTNCVIKGREVRKGQSVLRQYKTEIKIGKASTGSRKLLSEEPGDDCISRTQLLRAEPAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVPQCPKRKEKVEETELYLNLERIPWNVRKLLQVSESTGVALKRSSWLIVLLVLLTVSLSPVQSAPVGHGKTIETYQTREGFTSICLFMLGSILFLVSCLVKGLVDSVSDSFFPGLSVCKTCSIGSINGFEIESHKCYCSLFCCPYCRHCSADREIHQLHLSICKKRKMGSNVMLAVCKRMCFRATIEASRRALLIRSIINTTFVICILTLTICVVSTSAVEMENLPSGTWEREEDLTNFCHQECQVTETECLCPYEALVLRKPLFLDSIVKGMKNLLNSTNLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWEVGTGCTCCGWNVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRVNGHLIHKIEPHFNTSWMSWDGCDLDYYCNMGDWPSCTYTGMTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSNDPDVIAASTSLMARKLEFGTDSTFKAFSAMPKTSLCFYIAEREYCKSCSEEDTQKCVDTKLEQPQSILIEHKGTIIGKQNDTCTAKASCWLESVKSFFYGLKNMLGSVFGNFFIGILLFLAPFVLLVLFFMFGWKILFCFKCCRRTRGLLKYRLLKDDEETGYRRIIERLNNKKGKNRLLDGERLADRKIAELFSTKTHIG

SEQ ID NO: 1353 - protein, 1684 aa, Artificial Sequence
  derived and/or modified protein sequence (wt) from CCHFV__KJ648916.1__GP
MHISLMYAILCLQLCGLGETHGSHNETRHNKTDTMTTPGDNPSSEPPVSTALSITLDPSTVTPTTPASGLEGSGEVYTSPPITTGSLPLSETTPELPVTTGTDTLSAGDVDPSTQTAGGTSAPTVRTSLPNSPSTPSTPQDTHHPVRNLLSVTSPGPDETSTPSGTGKESSATSSPHPVSNRPPTPPATAQGPTENDSHNATEHPESLTQSATPGLMTSPTQIVHPQSATPITVQDTHPSPTNASKANLKMEIILTLSQGLKKYYGKILRLLQLTLEEDTEGLLEWCKRNLGLDCDDTFFQKRIEEFFITGEGHFNEVLQFRTPGTLSTTESTPAGLPTAEPFKSYFAKGFLSIDSGYYSAKCYSGTSNSGLQLINITRHSTRIVDTPGPKITNLKTINCINLKASIFKEHREVEINVLLPQVAVNLSNCHVVIKSHVCDYSLDIDGAVRLPHIYHEGVFIPGTYKIVIDKKNKLNDRCTLFTDCVIKGREVRKGQSVLRQYKTEIRIGKASTGSRRLLSEEPSDDCISRTQLLRTETAEIHGDNYGGPGDKITICNGSTIVDQRLGSELGCYTINRVRSFKLCENSATGKNCEIDSVPVKCRQGYCLRITQEGRGHVKLSRGSEVVLDACDTSCEIMIPKGTGDILVDCSGGQQHFLKDNLIDLGCPKIPLLGKMAIYICRMSNHPKTTMAFLFWFSFGYVITCILCKAIFYLLIIVGTLGKRLKQYRELKPQTCTICETTPVNAIDAEMHDLNCSYNICPYCASRLTSDGLARHVIQCPKRKEKVEETELYLNLERIPWVVRKLLQVSESTGVALKRSSWLIVLLVLFTVSLSPVQSAPIGQGKTIEAYRAREGYTSICLFVLGSILFIVSCLMKGLVDSVGNSFFPGLSICKTCSISSINGFEIESHKCYCSLFCCPYCRHCSTDKEIHKLHLSICKKRKKGSNVMLAVCKLMCFRATMEVSNRALFIRSIINTTFVLCILILAVCVVSTSAVEMENLPAGTWEREEDLTNFCHQECQVTETECLCPYEALVLRKPLFLDSTAKGMKNLLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVGEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFVNLLNIETDYTKNFHFHSKRVTAHGDTPQLDLKARPTYGAGEITVLVEVADMELHTKKIEISGLKFASLACTGCYACSSGISCKVRIHVDEPDELTVHVKSDDPDVVAASSSLMARKLEFGTDSTFKAFSAMPKTSLCFYIVEREHCKSCSEEDTKKCVNTKLEQPQSILIEHKGTIIGKQNSTCTAKASCWLESVKSFFYGLKNMLSGIFGNVFMGIFLFLAPFILLILFFMFGWRILFCFKCCRRTRGLFKYRHLKDDEETGYRRIIEKLNNKKGKNKLLDGERLADRRIAELFSTKTHIG

SEQ ID NO: 1354 - protein, 1165 aa, Artificial Sequence
  derived and/or modified protein sequence (wt) from CCHVF(CCHVF 10200)__U39455.2__Gn-NSm-Gc
SEEPSDDCVSRTQLLRTETAEIHGDNYGGPGDKITICNGSTIVDQRLGSELGCYTINRVRSFKLCENSATGKNCEIDSVPVKCRQGYCLRITQEGRGHVKLSRGSEVVLDACDTSCEIMIPKGTGDILVDCSGGQQHFLKDNLIDLGCPKIPLLGKMAIYICRMSNHPKTTMAFLFWFSFGYVITCILCKAIFYLLIIVGTLGRRLKQYRELKPQTCTICETTPVNAIDAEMHDLNCSYNICPYCASRLTSDGLARHVIQCPKRKEKVEETELYLNLERIPWVVRKLLQVSESTGVALKRSSWLIVLLVLFTVSLSPVQSAPIGQGKTIEAYRAREGYTSICLFVLGSILFIVSCLMKGLVDSVGNSFFPGLSICKTCSISSINGFEIESHKCYCSLFCCPYCRHCSTDKEIHKLHLSICKKRKTGSNVMLAVCKLMCFRATMEVSNRALFIRSIINTTFVLCILILAVCVVSTSAVEMENLPAGTWEREEDLTNFCHQECQVTETECLCPYEALVLRKPLFLDSTAKGMKNLLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFVNLLNIETDYTKNFHFHSKRVTAHGDTPQLDLKARPTYGAGEITVLVEVADMELHTKKIEISGLKFASLACTGCYACSSSISCKVRIHVDEPDELTVHVKSDDPDVVAASSSLMARKLEFGTDSTFKAFSAMPKTSLCFYIVEREHCKSCSEEDTKKCVNTKLEQPQSILIEHKGTIIGKQNSTCTAKASCWLESVKSFFYGLKNMLSGIFGNVFMGIFLFLAPFILLILFFMFGWRILFCFKCCRRTRGLFKYRHLKDDEETGYRRIIEKLNNKKGKNKLLDGERLADGRIAELFSTKTHIG

SEQ ID NO: 1355 - protein, 1165 aa, Artificial Sequence
  derived and/or modified protein sequence (wt) from CCHVF(CCHVF IbAr10200)__AF467768.2__Gn-NSm-Gc
SEEPSDDCISRTQLLRTETAEIHGDNYGGPGDKITICNGSTIVDQRLGSELGCYTINRVRSFKLCENSATGKNCEIDSVPVKCRQGYCLRITQEGRGHVKLSRGSEVVLDACDTSCEIMIPKGTGDILVDCSGGQQHFLKDNLIDLGCPKIPLLGKMAIYICRMSNHPKTTMAFLFWFSFGYVITCILCKAIFYLLIIVGTLGKRLKQYRELKPQTCTICETTPVNAIDAEMHDLNCSYNICPYCASRLTSDGLARHVIQCPKRKEKVEETELYLNLERIPWVVRKLLQVSESTGVALKRSSWLIVLLVLFTVSLSPVQSAPIGQGKTIEAYRAREGYTSICLFVLGSILFIVSCLMKGLVDSVGNSFFPGLSICKTCSISSINGFEIESHKCYCSLFCCPYCRHCSTDKEIHKLHLSICKKRKKGSNVMLAVCKLMCFRATMEVSNRALFIRSIINTTFVLCILILAVCVVSTSAVEMENLPAGTWEREEDLTNFCHQECQVTETECLCPYEALVLRKPLFLDSTAKGMKNLLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVGEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFVNLLNIETDYTKNFHFHSKRVTAHGDTPQLDLKARPTYGAGEITVLVEVADMELHTKKIEISGLKFASLACTGCYACSSGISCKVRIHVDEPDELTVHVKSDDPDVVAASSSLMARKLEFGTDSTFKAFSAMPKTSLCFYIVEREHCKSCSEEDTKKCVNTKLEQPQSILIEHKGTIIGKQNSTCTAKASCWLESVKSFFYGLKNMLSGIFGNVFMGIFLFLAPFILLILFFMFGWRILFCFKCCRRTRGLFKYRHLKDDEETGYRRIIEKLNNKKGKNKLLDGERLADRRIAELFSTKTHIG

SEQ ID NO: 1356 - protein, 1165 aa, Artificial Sequence
  derived and/or modified protein sequence (wt) from CCHVF(CCHVF Turkey-Kelkit06)__GQ337054.1__Gn-NSm-Gc
SEEPGDDCISRTQLLRTETAEIHDDNYGGPGDKITICNGSTIVDQRLGSELGCYTINRVKSFKLCKNSATGKTCEVDSTPVKCRQGFCLKITQEGRGHVKLSRGSEVVLDACDSSCEVMIPKGTGDILVDCSGGQQHFLKDNLIDLGCPHIPLLGRMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLTVSLSPVQSAPVGHGKTIEIYQTREGFASICLFMLGSILFIVSCLVKGLVDSVSESFFPGLSVCKTCSIGSVNGFEIESHKCYCSLFCCPYCRHCSADREIHQLHLSICKKRKTGSNVMLAVCKRMCFRATIEASRRALLIRSIINTTFVICILTLTICVVSTSAVEMENLPAGTWEREEDLTNFCHQECQVTETECLCPYEALVLRKPLFLDSIVKGMKNLLNSTSLETSLSIEAPWGAINVQSTFKPTVSTANIALSWSSVVHRGNKILVTGRSESIMKLEERTGVSWDLGVEDASESKLLTVSIMDLSQMYSPVFEYLSGDRQVEEWPKATCTGDCPERCGCTSSTCLHKEWSHSRNWRCNPTWCWGVGTGCTCCGVDVKDLFTDHMFVKWKVEYIKTEAIVCVALTSQERQCSLIEAGTRFNLGPVTITLSEPRNIQQKLPPEIITLHPKIEEGFFDLMHVQKVLSASTVCKLQSCTHGIPGDLQVYHIGNLLKGDRVNGHLIHKIESHFNTSWMSWDGCDLDYYCNMGDWPSCTYTGVTQHNHAAFVNLLNIETDYTKTFHFHSKRVTAHGDTPQLDLKARPTYGAGGITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEDDTQKCVDTRLEQPQSILIEHKGTIIGKQNDTCTAKASCWLESVKSFFYGLKNMLGSVFGNLFIGILLFLAPFVLLVLFFMFGWKILFCFKCCRRTRGLFKYRHLKDDEETGYRRIIERLNSKKGKNRLLDGDRLADRKIAELFSTKTHIG

SEQ ID NO: 1357 - protein, 1166 aa, Artificial Sequence
  derived and/or modified protein sequence (wt) from CCHVF(CCHVF SR3)__AJ538199.1__Gn-NSm-Gc
SEESGDDCISRTQLLRTETAEVHGDNYGGPGDKITICNGSTVVDQRLGSELGCYTINRVRSFKLCENSATGKSCEIDSIPVKCKQGYCLKITQEGRGHVKLSRGSEVVLDVCDSSCEVMIPKGTGDILVDCSGGQQHFLKDNLVDLGCPKIPLLGKMAIYICRMSNHPKTTMAFLFWFSFGYVITCILCKAIFFLLIIFGTLGKRFKQYRELKPQTCTICETTPVNAIDAEMHDLNCSYNICPYCASRLTSDGLARHVTQCPRRKEKVEETELYLNLERIPWVVRKLLQVSESTGTVLKRSSWLIVLLVLFTVSLSPVQSAPIGHGKTIETYRVREEYTSICLFVLGSILFIVSFLMKGLVDGVGNIFFPGLSVCKTCSIGSINGFEIESHKCYCSLFCCPYCRHCSADGEIHQLHLSICKKRKTGSNVMLAVCKRMCFRATMEVSNKALFIRSIINTTFVMCILKGEFAAVKSIHPIEMESLPAGTWEREEDLTNFCHQECQVTETECLCPYEALVLRRPLFLDSIVKGMKNLLNSTSLETSLSIEAPWGAINVQSTYKPTVSTANIALSWSSVEHRGNKVLVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGSVTITLSEPRNIQQKLPPEIITLHPKIEEGFFDLMHVQKVLSASTVCKLQSCTHGVPGDLQVYHIGNLLKGDRVNGHLIHKIEQHFNTSWMSWDGCDLDYYCNMGDWPSCTYTGVTQHNHASFVNLLNIETDYTKTFHFHSKRVTAHGDTPQLDLKARPTYGAGEITVLVEVADMELHTKKIEISGLKFAGLTCTGCYACSSGISCKVRIHVDEPDELTVHVKSDDPDVVAASSSLMARKLEFGTDSTFKAFSAMPKTSLCFYIVEREYCKSCNKEDTQKCVNTKLEQPQSILIEHKGTIIGKQNNTCTAKASCWLESVKSFFYGLKNMLGGIFGNVFIGIFTFLTPFILLILFFMFGWRILFCFKCCRRTRGLFKYRHLKDDEETGYRKIIERLNNKKGKNRLLDGERLADRKIAELFSTKTHIG

SEQ ID NO: 1358 - protein, 1166 aa, Artificial Sequence
  derived and/or modified protein sequence (wt) from CCHVF(CCHVF UCCR4413)__KY484038.1__Gn-NSm-Gc
SESSASGCISRTQMIKSETAEIHDDIYGGPGEKLTICNGTTVVDQRLGSELGCYTINRIKTYKLCENSVKEKTCEIDSVPVKCRQGLCLKITQEGRGHVKLSRGSEIVLDICDSSCELMIPKGTGDILVDCSGGQQHFLQDNLVDLGCPNIPLLGKVAIYICRMSNHPKTTMAFLFWFSFGYVITCILCKILFYLLIITGTLGKKLKQYRELKPQTCTICESTPVNAIDAEMHDLNCSYNICPYCASRLTSDGLIRHVNLCPKRKEKVEETELYLNLERIPWFVRKLLQVSESTGVALKRSSWLLILVILLTVSMSPVQSAPINQQRAVEAYQAREGYTGICLFILGSVLFMTSWLTKGLIDSIGDSFFPGLFVCKTCSIGSINGFEIESHRCYCSLLCCPYCRTCSADKDSHQLHLSICKKKKAGSNVMLAVCKRMCFKATIEASNRVLLIRSIINTTFIICMLILVVCVISTSAVEMEDLPAGTWEREEDLTNFCHQECQVTETECLCPYEAFVLRKPLFLSSIVKGKKNLLNSASLETSLSIEAPWGAINAQSTFKPTISTANIALSWSSVEHRGNKVLVSGRSESIMKLEERTGISWNLGVEDASESRMLTVSVMDLSQMYLPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPSEIVTLHPKIEEGFFDLMHVQKVLSASTVCKLQSCTHGVAGDLQVYHVGNLLKGDKINGHSIHKIEPHLNTSWMSWDGCDLDYYCNMGDWPSCTYTGVTQHNHAAFVNLLNIETDYTKSFHFHSKRVTAHGDTPQLDLKARPMYGAGEITVLVEVADMELHSKNIEISGLKFASLTCSGCYACSSGISCKVRIHVDEPDELAVHVKSDDLDVVAASSSLMARKIEFGTDSTFKAFSSMPKESLCFYIVERDFCKSCAAEDTQKCVKAKLEQPQSILIEHKGTIIGKQNDTCSTKTSCWLESFKSFFYGLKNMLSGVFGSAIMGILLFLAPFILLILFFFFGWRILFCLRCCRRTRGLFKYKHIKDDEEAGYKKIIEKLNNKKGGTSKLLDGERLADRKIAELFSTKAHIG

SEQ ID NO: 1359 - protein, 1165 aa, Artificial Sequence
  derived and/or modified protein sequence (wt) from CCHVF(CCHVF 66019)__AB069669.1__Gn-NSm-Gc
SEESGDDCISRTQLLRTETAEVHGDNYGGPGDKITICNGSTIVDQRLGSELGCYTINRVKSFKLCENSGTGKSCKIDNTPVKCRQGFCLKITQEGRGHVKLSRGSEVVLDACDSSCEIMIPKGTGDILVDCSGGQQHFLKDNLVDLGCPNIPLLGKMAIYICRMSNHPKTTMAFLFWFSFGYVITCIFCKIIFYLLIVVGTLGKKFKQYRELKPQTCTICETTPTNAIDAEMHDLKCSYNICPYCASRLTSDGLARHVTQCPKRKEKVEETELYLNLERIPWIVRKLLQVSESTGVALKRSSWLIVLLVLLTVSLSPVQSAPIGHGKTIEAYQTREGYTSVCLFMLGGILFVVSCLMKGLVDSVSNSFFPGLSICKTCSIGSVNGFEIESHKCYCSLLCCLYCRHCSADREIHQLHLSICKKRRAGGNVMLAVCKRMCLRATMEVSNKVLFIRSIINTTFVICILVLAVCIVSTSAVEMESLPAGTWEREEDLTNFCHQECQVTETECLCPYEALVLRKPLFSDSIVKGMKNLLNSTSLETSLSIEAPWGAINVQSTFKPTVSTANIALSWSSVEHRGNKILVSGRSESIMKLEERTGISWDLGVEDASESKLLTVSVMDLSQMYSPVFEYLSGDRQVEEWPKATCTGNCPDRCGCTSSTCLHKEWPHSRNWRCNPTWCWGVGTGCTCCGLDVKDLFTDYMFVKWKVEYIKTEAIVCVELNSQERQCSLIEAGTRFNLGPVTITLSEPRNIQQKLPSEIITLHPRIEEGFFDLMHVQKVLSASTVCKLQSCTHGVPGDLQIYHIGNLLKGDRVNGHLIHKIEPHFNTSWMSWDGCDLDYYCNMGDWPSCTYTGVTQHNHAAFVNLLNIETDYTKNFHFHSKRVTAHGDTPQLDLKARPTYGAGEITVLVEVADMELHTKKIAISGLKFASLTCTGCYACSSGISCKVRIHVDEPDELTVHVKSEDPDIVAASSSLMARKLEFGTDSTFKAFSAMPKTSLCFYIVEREYCESCSKEDTQKCVNTKLEQPQSILIEHKGTIIGKQNDTCTAKASCWLESVKSFFYGLKNMLSGIFGNVFIGIFLFLAPFILLILFFMFGWRILFCFKCCRRTRGLFKYRYLKDDEESGYRRIIERLNNKKGKNKLLDGERLADRRIAELFSTKTHIG

SEQ ID NO: 1360 - protein, 1165 aa, Artificial Sequence
  derived and/or modified protein sequence (wt) from CCHVF(CCHVF 7001)__AB069670.1__Gn-NSm-Gc
AEGGSSDCISRTQLVKTEVAEIHEDSYGGPGEKITICNGSTIVDQRLGSELGCYTINRVRSYKLCENSASGKSCEIDSIPVKCKQGFCLKITQEGRGHVKLSRGTEIVLDVCDSSCELMIPKGTGDILVDCSGGQQHFLQNNLIDLGCPNVPLLGKMAIYVCRMSNHPKTTMAFLFWFSFGYVITCIACRVLFYLLIAIGTVGKKLKQYRELKPQTCIVCESVPVNAIDAEMHELNCSYNICPYCASRLSTDGLIRHVTQCPKRREKVEETELFLNLERIPWLVRKLLQVSESTGMALKRSCWMITLLILLLVSISPVQSAPVGKERAIETYQARETYTGICLFVLGSVLFAVSWLTKALIDGIGNSFFPGLSVCKTCSIGSINGFEIESHKCYCSLFCCPYCRACSSDKNTHRMHLNVCKKRKMGSNVMLAVCKRMCFRATIEASNKALLIRSIINSTFVICILILTICVVSTSAVDMENLPAGIWEKEEDLTNFCHQECQVTETECLCPYEAMVLRKPLFLDNIAKGMKSLLNSTSLETSLSIEAPWGAINVQSTFKPTVSAANIALSWSSVEHRGNKILVSGRSESIMKLEERTGVSWNLGVEDASESKTLTVSVMDLSQMYSPVFEYLSGDRQVEEWPKATCTGDCPERCGCTSSTCLHKEWPHSRNWRCNPTWCWGVGTGCTCCGLDVKDFFTDYMLVKWKVEYIKTEAIVCVELTSQERQCSLIEAGTRFNLGPVTITLSEPRNVQQRLPPEIVTLHPKIEEGFFDLMHVQKILSASTVCKLQSCTHGVPGDFQVYHVGNLLRGDKVNGHSIHKIEPHFNTSWMSWDGCDLDYFCNMGDWPSCTYTGVTQHNRAAFINMLNIETDYTKTFHFHSKRVTAHGDTPQLDLKARPAYGAGEVTVLVEVADLELHTKKLEVSGLKIASLTCSGCYACSSGISCKVRIHVNEPDEFTVHVRSSDPDVVAAGSSLMARKIEFGADSTFKAFSSMPKDSLCFYIVEKDYCSSCTDDDTQKCVNTKLDHPQSILIEHKGTIIGKQNDTCSTKTSCWLESVKGFFYGLKNMLSGIFGNVFLGIFLFLAPFVLLIFFFFFGWRLLFCLKCCRRTRGLLKYKHLKDEEEAGYKKIIERLNGKKGKSQLFDGERLADRKIAELFSTKIHIG

SEQ ID NO: 1361 - protein, 1165 aa, Artificial Sequence
  derived and/or modified protein sequence (wt) from CCHVF(CCHVF 75024)__AB069671.1__Gn-NSm-Gc
SEESGDDCISRTQLLRTETAEIHGDNYGGPGDKITICNGSTIVDQRLGSEMGCYTINRVKSFKLCENSATGKSCEIDSIPVKCRQGYCLKITQEGRGHVKLSRGSEVVLDACDSSCEVMIPKGTGDILVDCSGGQQHFLKDNLIDLGCPSIPLLGKMAIYICRMSNHPKTTMAFLFWFSFGYVITCILCKAIFYLLIIVGTLGKRFKQYRELKPQTCTICETTPANAIDAEMHDLNCSYNICPYCASRLTSDGLARHVTQCPKRKEKVEETELYLNLERIPWVVRKLLQVSESTGVALKRSSWLIVLLVLFAISLSPVQSAPIGHGKTIETYQAREEYTSICLFVLGSILFIVSCLMKGLVDSIGNIFFPGLSICKTCSIGSINGFEIESHKCYCSLLCCPYCRHCSADREIHQLHLSICKKRKTGSNVMLAVCKRMCFRATMEVSNKALLIRSIINTTFVVCILILAVCVVSTSAVEMESLPAGTWEREEDLTNFCHQECQVTETECLCPYEALVLRRPLFLDSIVRGMKNQLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTTSTCLHKEWPHSRNWRCNPTWCWGVGTGCTCCGLDVKDLFTDYMIVKWKVEYIKTEAIVCVELTSQERQCSLIEAGTRFNLGSVTITLSEPRNIQQKLPPEIITLHPRIEEGFFDLMHVQKVLSASTVCKLQSCTHGVPGDLQVYHVGNLLKGDKVNGHLIHKIEPHLNTSWMSWDGCDLDYYCNMGDWPSCTYTGVTQHNHASFVNLLNIETDYTKSFHFHSKRVTAHGDTPQLDLKARPTYGAGEITVLVEVADMEFTPKKIEISGLKFASLTCTGCYACSSGISCKVRIHVDEPDELTVHVKSDDPDVVAASSSLMARKLEFGTDSTFKAFSAMPKTSLCFYIVEREYCKSCSKEDTQKCVNTKLEQPQSILIEHKGTIIGKQNNTCTAKASCWLESVKSFFYGLKNMLSGIFGNLFMGIFLFLAPFILLILFFMFGWRILFCFKCCRRTRGLFKYRHLKDDEETGYRRIIERLNNKKGKNKLLDGERLADRRIAELFSTKTHIG

SEQ ID NO: 1362 - protein, 1165 aa, Artificial Sequence
  derived and/or modified protein sequence (wt) from CCHVF(CCHVF 7803)__AB069672.1__Gn-NSm-Gc
SEESGDDCISRTQLLRTETAEIHGDNYGGPGDKITICNGSTIVDQRLGSEMGCYTINRVKSFKLCENSATGKSCEIDSIPVKCRQGYCLKITQEGRGHVKLSRGSEVILDACDSSCEVMIPKGTGDILVDCSGGQQHFLKDNLIDLGCPSIPLLGKMAIYICRMSNHPKTTMAFLFWFSFGYVITCILCKAIFYLLIIVGTLGKRFKQYRELKPQTCTICETTPANAIDAEMHDLNCSYNICPYCASRLTSDGLARHVTQCPKRKEKVEETELYLNLERIPWVVRKLLQVSESTGVALKRSSWLIVLLVLFAISLSPVQSAPISHGKTIETYQAREEYTSICLFVLGSILFIVSCLMKGLVDSIGNIFFPGLSICKTCSIGSINGFEIESHKCYCSLLCCPYCRHCSADREIHQLHLSICKKRKTGSNVMLAACKRMCFRATMEVSNKALLIRSIINTTFVVYILILAVCVVSTSAVEMESLPAGTWEREEDLTNFCHQECQVTETECLCPYEALVLRRPLFLDSIVRGMKNPLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTTSTCLHKEWPHSRNWRCNPTWCWGVGTGCTCCGLDVKDLFTDYMIVKWKVEYIKTRGIVCVELTSQERQCSLIEAGTRFNLGSVTITLSEPRNIQQKLPPEIITLHPRIEEGFFDLMHVQKVLSASTVCKLQSCTHGVPGDLQVYHVGNLLKGDKVNGHLIHKIEPHLNTSWMSWDGCDLDYYCNMGDWPSCTYTGVTQHNHASFVNLLNIETDYTKSFHFHSKRVTAHGDTPQLDLKARPTYGAGEITVLVEVADMEFTPKKIEISGLKFASLTCTGCYACSSGISCKVRIHVDEPDELTVHVKSDDPDVVAASSSLMARKLEFGTDSTFKAFSAMPKTSLCFYIVEREYCKSCSKEDTQKCVNTKLEQPQSILIEHKGTIIGKQNNTCTAKASCWLESVKSFFYGLKNMLSGIFGNFFMGIFLFLAPFILLILFFMFGWRILFCFKCCRRTRGLFKYRHLKDDEETGYRRIIERLNNKKGKNKLLDGERLADRRIAELFSTKTHIG

SEQ ID NO: 1363 - protein, 1165 aa, Artificial Sequence
  derived and/or modified protein sequence (wt) from CCHVF(CCHVF 79121)__AB069673.1__Gn-NSm-Gc
AEGGSSDCISRTQLVKTEVAEIHEDSYGGPGEKITICNGSTIVDQGLGSELGCYTINRVRSYKLCENSASGKSCEIDSIPVKCKQGFCLKITQEGRGHVKLSRGTEIVLDVCDSSCELMIPKGTGDILVDCSGGQQHFLQNNLIDLGCPNVPLLGKMAIYVCRMSNHPKTTMAFLFWFSFGYVITCIACRVLFYLLIAIGTVGKKLKQYRELKPQTCIVCESVPVNAIDAEMHELNCSYNICPYCASRLSTDGLIRHVTQCPKRREKVEETELFLNLERIPWLVRKLLQVSESTGMALKRSCWMITLLILLLVSISPVQSAPVGKERAIETYQARETYTGICLFVLGSVLFAVSWLTKALIDGIGNSFSPGLSVCKTCSIGSINGFEIESHKCYCSLFCCPYCRACSSDKNTHRMHLNVCKKRKMGSNVMLAVCKRMCFRATIEASNKALLIRSIINSTFVICILILTICVVSTSAVDMENLPAGIWEKEEDLTNFCHQECQVTETECLCPYEAMVLRKPLFLDSTAKGMKSLLNSTSLETSLSIEAPWGAINVQSTFKPTVSAANIALSWSSVEHRGNKILVSGRSESIMKLEERTGVSWNLGVEDASESKTLTVSVMDLSQMYSPVFEYLSGDRQVEEWPKATCTGDCPERCGCTSSTCLHKEWPHSRNWRCNPTWCWGVGTGCTCCGLDVKDFFTDYMLVKWKVEYIKTEAIVCVELTSQERQCSLIEAGTRFNLGPVTITLSEPRNVQQRLPPEIVTLHPKIEEGFFDLMHVQKILSASTVCKLQSCTHGVPGDFQIYHVGNLLRGDKVNGHSIHKIEPHFNTSWMSWDGCDLDYFCNMGDWPSCTYTGVTQHNRAAFINMLNIETDYTKTFHFHSKRVTAHGDTPQLDLKARPAYGAGEVTVLVEVADLELHTKNLEVSGLKIASLTCSGCYACSSGISCKVRIHVNEPDEFTVHVRSSDPDVVAAGSSLMARKIEFGADSTFKAFSSMPKDSLCFYIVEKDYCSSCTDDDTQKCVNTKLDHPQSILIEHKGTIIGKQNDTCSTKTSCWLESVKGFFYGLKNMLSGIFGNVFLGIFLFLAPFVLLIFFFFFGWRLLFCLKCCRRTRGLLKYKHLKDEEEAGYKKIIERLNGKKGKSQLFDGERLADRKIAELFSTKIHIG

SEQ ID NO: 1364 - protein, 1165 aa, Artificial Sequence
  derived and/or modified protein sequence (wt) from CCHVF(CCHVF 8402)__AB069674.1__Gn-NSm-Gc
SEESGDDCISRTQLLRTETAEIHNDNYGGPGDKITICNGSTVVDQRLGSELGCYTINRVKSFKLCENSATGKSCEIDSTPVKCRQGFCLKITQEGRGHVKLSRGSEVVLDACDSSCEIMIPKGTGDILVDCSGGQQHFLKDNLIDLGCPNIPLLGKMAIYICRMSNHPKTTMAFLFWFSFGYVVTCILCKVIFYLLIVVGTLGKKFKQYRELKPQTCTICETTPVNAIDAEMHDLNCSYNICPYCASRLTSDGLARHVMQCPKRKEKIEETELYLNLERIPWVVRKLLQVSESTGVALKRSSWLVVLLVLLTVSLSPVQSAPIGHGKTVETYQTREGYTSICLFVLGSILFIVSCLMKGLVDSVGNSFFPGLSICKTCSIGSVNGFEIESHKCYCSLFCCPYCRHCSADREIHRLHLSICKKRKTGSNVMLAVCKRMCFRATVEVSNKALLIRNIINTTFVLCILILAVCVVSTSAVEMESLPAGTWEREEDLTNFCHQECQVTETECLCPYEALVLRKPLFSDSIVKGMKNLLNSTSLETSLSIEAPWGAINVQSTFKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFIKWKVEYIKTEAIVCVELTSQERQCTLIEAGTRFNLGPVTITLSEPRNIQQKLPPEIVTLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHAAFVNMLNIETDYTKNFHFHSKRVTAHGDTPQLDLKARPTYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSKEDTQKCVNTKLEQPQSILIEHKGTIIGKQSNTCTAKASCWLESVKSFFYGLKNMLSGIFGNVFIGVFLFFAPFILLILFFMFGWRILFCFKCCRRTRGLFKYRHLKDDEETGYRKIIERLNNKKGKNKLLDGERLADRKIAELFSTKTHIG

SEQ ID NO: 1365 - protein, 1165 aa, Artificial Sequence
  derived and/or modified protein sequence (wt) from CCHVF(CCHVF 88166)__AB069675.1__Gn-NSm-Gc
SEESGDDCISRTQLLRTETAEIHSDNYGGPGDKITICNGSTVVDQRLGSELGCYTINRVKSFKLCENSATGKSCEIDSTPVKCRQGFCLKITQEGRGHVKLSRGSEVVLDACDSSCEIMIPKGTGDILVDCSGGQQHFLKDNLIDLGCPNIPLLGKMAIYICRMSNHPKTTMGFLFWFSFGYVVTCILCKVIFYLLIVVGTLGKKFKQYRELKPQTCTICETTPVNAIDAEMHDLNCSYNICPYCASRLTSDGLARHVMQCPKRKEKIEETELYLNLERIPWVVRKLLQVSESTGVALKRSSWLVVLLVLLTVSLSPVQSAPIGHGKTVETYQTREGYTSICLFVLGSILFIVSCLMKGLVDSVGNSFFPGLSICKTCSIGSVNGFEIESHKCYCSLFCCPYCRHCSADREIHRLHLSICKKRKTWSNVMLAVCKRMCFRATVEVSNKALLIRNIINTTFVLCILILAVCVVSTSAVEMESLPAGTWEREEDLTNFCHQECQVTETECLCPYEALVLRKPLFSDSIVKGMKNLLNSTSLETSLSIEAPWGAINVQSTFKPTMSAANIALSWSSVEHRGNKILVSGRSESIMKLEERTGISWNLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFIKWKVEYIKTEAIVCVELTSQERQCTLIEAGTRFNLGPVTITLSEPRNIQQKLPPEIVTLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHAAFVNMLNIETDYTKNFHFHSKRVTAHGDTPQLDLKARPTYGAGEITVLVEVADMELHTKKIEISGLKFASLTCTGCYACSSGISCKVRIHVDEPDELTVHVKSEDPDLVAASSSLMARKLEFGTDSTFKAFSAMPKTSLCFYIVEREYCKSCSKEDTQKCVNTKLEQPQSILIEHKGTIIGKQNNTCTAKASCWLESVKSFFYGLKNMLSGIFGNVFIGVFLFFAPFILLILFFMFGWRILFCFKCCRRTRGLFKYRHLKDDEETGYRKIIERLNNKKGKNKLLDGERLADRKIAELFSTKTHIG

SEQ ID NO: 1366 - protein, 1165 aa, Artificial Sequence
  derived and/or modified protein sequence (wt) from CCHVF(CCHVF BA88166)__AF338470.1__Gn-NSm-Gc
SEESGDDCISRTQLLRTETAEIHSDNYGGPGDKITICNGSTVVDQRLGSELGCYTINRVKSFKLCENSATGKSCEIDSTPVKCRQGFCLKITQEGRGHVKLSRGSEVVLDACDSSCEIMIPKGTGDILVDCSGGQQHFLKDNLIDLGCPNIPLLGKMAIYICRMSNHPKTTMGFLFWFSFGYVVTCILCKGIFYLLIVVGTLGKKFKQYRELKPQTCTICETTPVNAIDAEMHDLNCSYNICPYCASRLTSDGLARHVMQCPKRKEKIEETELYLNLERIPWVVRKLLQVSESTGVALKRSSWLVVLLVLLTVSLSPVQSAPIGHGKTVETYQTREGYTSICLFVLGSILFIVSCLMKGLVDSVGNSFFPGLSICKTCSIGSVNGFEIESHKCYCSLFCCPYCRHCSADREIHRLHLSICKKRKTWSNVMLAVCKRMCFRATVEVSNKALLIRNIINTTFVLCILILAVCVVSTSAVEMESLPAGTWEREEDLTNFCHQECQVTETECLCPYEALVLRKPLYLDSIVKGMKNLLNSTSLETSLSIEAPWGAINVQSTFKPTMSAANIALSWSSVEHRGNKILVSGRSESIMKLEERTGISWNLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFIKWKVEYIKTEAIVCVELTSQERQCTLIEAGTRFNLGPVIITLSEPRNIQQKLPPEIVTLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHAAFVNMLNIETDYTKNFHFHSKRVTAHGDTPQLDLKARPTYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSKEDTQKCVNTKLEQPQSILIEHKGTIIGKQNNTCTAKASCWLESVKSFFYGLKNMLSGIFGNVFIGVFLFFAPFILLILFFMFGWRILFCFKCCRRTRGLFKYRHLKDDEETGYRKIIERLNNKKGKNKLLDGERLADRKIAELFSTKTHIG

SEQ ID NO: 1367 - protein, 1165 aa, Artificial Sequence
  derived and/or modified protein sequence (wt) from CCHVF(CCHVF BA66019)__AF350448.1__Gn-NSm-Gc
SEESGDDCISRTQLLRTETAEVHGDNYGGPGDKITICNGSTIVDQRLGSELGCYTINRVKSFKLCENSGTGKSCKIDKHPVKCRQGFCLKITQEGRGHVKLSRGSEVVLDACDSSCEIMIPKGTGDILVDCSGGQQHFLKDNLVDLGCPNIPLLGKMAIYICRMSNHPKTTMAFLFWFSFGYVITCIFCKIIFYLLIVVGTLGKKFKQYRELKPQTCTICETTPTNAIDAEMHDLKCSYNICPYCASRLTSDGLARHVTQCPKRKEKVEETELYLNLERIPWIVRKLLQVSESTGVALKRSSWLIVLLVLLTVSLSPVQSAPIGHGKTIEAYQTREGYTSVCLFMLGGILFVVSCLMKGLVDSVSNSFFPGLSICKTCSIGSVNGFEIESHKCYCSLLCCLYCRHCSADREIHQLHLSICKKRRAGGNVMLAVCKRMCLRATMEVSNKVLFIRSIINTTFVICILVLAVCIVSTSAVEMESLPAGTWEREEDLTNFCHQECQVTETECLCPYEALVLRKPLFSDSIVKGMKNLLNSTSLETSLSIEAPWGAINVQSTFKPTVSTANIALSWSSVEHRGNKILVSGRSESIMKLEERTGISWDLGVEDASESKLLTVSVMDLSQMYSPVFEYLSGDRQVEEWPKATCTGDCPDRCGCTSSTCLHKEWPHSRNWRCNPTWCWGVGTGCTCCGLDVKDLFTDYMFVKWKVEYIKTEAIVCVELNSQERQCSLIEAGTRFNLGPVTITLSEPRNIQQKLPPEIITLHPRIEEGFFDLMHVQKVLSASTVCKLQSCTHGVPGDLQIYHIGNLLKGDRVNGHLIHKIEPHFNTSWMSWDGCDLDYYCNMGDWPSCTYTGVTQHNHAAFVNLLNIETDYTKNFHFHSKRVTAHGDTPQLDLKARPTYGAGEITVLVEVADMELHTKKIAISGLKFASLTCTGCYACSSGISCKVRIHVDEPDELTVHVKSEDPDIVAASSSLMARKLEFGTDSTFKAFSAMPKTSLCFYIVEREYCESCSKEDTQKCVNTKLEQPQSILIEHKGTIIGKQNDTCTAKASCWLESVKSFFYGLKNMLSGIFGNVFIGIFLFLAPFILLILFFMFGWRILFCFKCCRRTRGLFKYRYLKDDEESGYRRIIERLNNKKGKNKLLDGERLADRRIAELFSTKTHIG

SEQ ID NO: 1368 - protein, 1165 aa, Artificial Sequence
  derived and/or modified protein sequence (wt) from CCHVF(CCHVF BA8402)__AF350449.1__Gn-NSm-Gc
SEESGDDCISRTQLLRTETAEIHNDNYGGPGDKITICNGSTVVDQRLGSELGCYTINRVNSFNLCENTATGKSCEIDSTPVKCRQGFCLKITQEGRGHVKLSRGSEVVLDACESSCEIMIPKGTGDILVDCSGGQQHFLKDNLIDLGCPNIPLLGKMAIYICRMSNHPKTTMAFLFWFSFGYVVTCILCKVIFYLLIVVGTLGKKFKQYRELKPQTCTICETTPVNAIDAEMHDLNCSYNICPYCASRPTSDGLARHVMQCPKRKEKIEETALYLNLERIPWVVRKLLQVSESTGVALKRSSWLVVLLVLLTVSLSPVQSAPIGHGKTVETYQTREGYTSICLFVLGSILFIVSCLMKGLVDSVGNSFFPGLSICKTCSIGSVNGFEIESHKCYCSLFCCPYCRHCSADREIHRLHLSICKKRKTGSNVMLAVCKRMCFRATVEVSNKALLIRNIINTTFVLCILILAVCVVSTSAVEMESLPAGTWEREEDLTNFCHQECQVTETECLCPYEALVLRKPLFSDSIVKGMKNLLNSTSLETSLSIEAPWGAINVQSTFKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFIKWKVEYIKTEAIVCVELTSQERQCTLIEAGTRFNLGPVTITLSEPRNIQQKLPPEIVTLHPRIEEGFFDLMHVQKVLSASTVCKLQSCTHGVPGDLQVYHIGNLLKGDKVNGHLIHKIEPHFNTSWMSWDGCDLHYYCNMGDWPSCTYTGVTQHNHAAFVNMLNIETDYTKNFHFHSKRVTAHGDTPQLDLKARPTYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCESCSKEDTQKCVNTKLEQPQSILIEHKGTIIGKQSNTCTAKASCWLESVKSFFYGLKNMLSGIFGNVFIGVFLFFAPFILLILFFMFGWRILFCFKCCRRTRGLFKYRHLKDDEETGYRKIIERLNNKKGKNKLLDGERLADRKIAELFSTKTHIG

SEQ ID NO: 1369 - protein, 1165 aa, Artificial Sequence
  derived and/or modified protein sequence (wt) from CCHVF(CCHVF Matin)__AF467769.2__Gn-NSm-Gc
SEESGDDCISRTQLLRTETAEIHSDSYGGPGDKITICNGSTVVDQRLGSELGCYTINRVKSFKLCENSATGKSCEIDSTPVKCRQGFCLKITQEGRGHVKLSRGSEVVLDACDSSCEIMIPKGTGDILVDCSGGQQHFLKDNLIDLGCPNIPLLGKMAIYICRMSNHPKTTMVFLFWFSFGYVITCILCKVIFYLLIVVGTLGKKFKQYRELKPQTCTICETTPVNAIDAEMHDLNCSYNICPYCASRLTSDGLARHVMQCPKRKEKIEETELYLNLERIPWVVRKLLQVSESTGVALKRSSWLVVLLVLLTVSLSPVQSAPIGHGKTVETYQIREGYTSVCLFVLGSILFIVSCLMKGLVDSDGNSFFPGLSICKTCSIGSINGFEIESHKCYCSLFCCPYCRHCSTDREIHKLHLSICKKRKTGSNVMLAVCKRMCFRATVEVSNKALLIRSIINTTFVVCILILAVCVVSTSAVEMESLPAGTWEREEDLINFCHQECQVTETECLCPYEALVLRKPLFLDSIIKGMKNLLNSTSLETSLSIEAPWGAINVQSTFKPTMSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEVIVCVELTSQERQCSLIEAGTRFNLGPVTITLSEPRNIQQKLPPEIVTLHPRIEEGFFDLMHVQKVLSASTVCKLQSCTHGVPGDLQVYHIGNLLKGDKVNGHLIHKIEPHFNTSWMSWDGCDLDYYCNMGDWPSCSYTGVTQHNHAAFVNMLSIETDYTKNFHFHSKRVTAHGDTPQLDLKARPTYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSKEDTQKCVNTKLEQPQSILIEHKGTIIGKQNDTCTAKASCWLESVKSFFYGLKNMLSGIFGNVFIGIFLFLAPFALLILFFMFGWRILFCFKCCRRTRGLFKYRHLKDDEETGYRKIIERLNNKKGKNKLLDGERLADRKIAELFSTKTHVG

SEQ ID NO: 1370 - protein, 1165 aa, Artificial Sequence
  derived and/or modified protein sequence (wt) from CCHVF(CCHVF Baghdad 12)__AJ538197.2__Gn-NSm-Gc
SEESGDDCISRTRLLRTETAEIHGDSYGGPGDKITICNGSTIVDQRLGSEMGCYTINRVKSFKLCENSATGKSCKIDSIPVKCRQGYCLKITQEGRGHVKLSRGSEVVLDACDSSCEVMIPKGTGDILVDCSGGQQHFLKDNLIDLGCPNIPLLGKMAIYICRMSNHPKTTMAFLFWFSFGYVITCILCKAIFYLLIIVGTLGKRFKQYRELKPQTCTICETTPVNAIDAEMHDLNCSYNICPYCASRLTSDGLARHVTQCPKRKEKVEETELYLNLERIPWVVRKLLQVSESTGVALKRSSWLIVLLVLLAVSSSPVQSAPIGYGKTIETYQAREGYTSICLFVLGSILFIVSCLTKGLVDSIGNIFFPGLSICKTCSIGSINGFEVESHKCYCSLLCCPYCRHCSADREIHQLHLSICKKRKTGSSVMLAVCKRMCFRATMEVSNKALLIRSIINTTFVVCILTLAVCVVSTSAVEMESLPAGTWEREEDLTNFCHQECQVTETECLCPYEALVLRKPLFLDSIVKGTKNLLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTTSTCLHKEWPHSRNWRCNPTWCWGVGTGCTCCGLDVKDLFTDYMFVKWKVEYIKTDAIVCVELTSQERQCSLIEAGTRFNLGSVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFVNLLNIETDYTKSFHFHSKRVTAHGDTPQLDLKVRPTYGAGEITVLVEVADMELHTKKIEISGLKFASLTCTGCYACSSGISCKVRIHVDEPDELTVHVKSDDPDVVAASSSLMARKLEFGTDSTFKAFSAMPKTSLCFYIVEREYCKSCSKEDTQKCVNTKLEQPQSILIEHKGTIIGKQNNTCTAKTSCWLESVKSFFYGLKNMLSGIFGNFFMGIFLFLAPFILLILFFMFGWRILFCFKCCRRTRGLFKYRHLKDDEETGYRRIIERLNNKKGKNKLLDGERLADRRIAELFSTKTHIG

SEQ ID NO: 1371 - protein, 1165 aa, Artificial Sequence
  derived and/or modified protein sequence (wt) from CCHVF(CCHVF VLG/TI29414)__AY179961.1__Gn-NSm-Gc
SEEPGDDCISRTQLLRAEPAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVPQCPKRKEKVEETELYLNLERIPWNVRKLLQVSESTGVALKRSSWLIVLLVLLTVSLSPVQSAPVGHGKTIETYQTREGFTSICLFMLGSILFLVSCLVKGLVDSVSDSFFPGLSVCKTCSIGSINGFEIESHKCYCSLFCCPYCRHCSADREIHQLHLSICKKRKMGSNVMLAVCKRMCFRATIEASRRALLIRSIINTTFVICILTLTICVVSTSAVEMENLPSGTWEREEDLTNFCHQECQVTETECLCPYEALVLRKPLFLDSIVKGMKNLLNSTNLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWEVGTGCTCCGWNVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRVNGHLIHKIEPHFNTSWMSWDGCDLDYYCNMGDWPSCTYTGMTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSNDPDVIAASTSLMARKLEFGTDSTFKAFSAMPKTSLCFYIAEREYCKSCSEEDTQKCVDTKLEQPQSILIEHKGTIIGKQNDTCTAKASCWLESVKSFFYGLKNMLGSVFGNFFIGILLFLAPFVLLVLFFMFGWKILFCFKCCRRTRGLLKYRLLKDDEETGYRRIIERLNNKKGKNRLLDGERLADRKIAELFSTKTHIG

SEQ ID NO: 1372 - protein, 1165 aa, Artificial Sequence
  derived and/or modified protein sequence (wt) from CCHVF(CCHVF TADJ/HU8966)__AY179962.1__Gn-NSm-Gc
SEESGDDCISRTQLLRTETAEIHGDDYGGPGDKITICNGSTIVDQRLGSELGCYTINRVKSFKLCENSATGKNCEIDSVPVKCRQGYCLKITQEGRGHVKLSRGSEVVLDACDSSCEVMIPKGTGDISVDCSGGQQHFLKDNLIDLGCPKIPLLGKMAIYICRMSNHPKTTMAFLFWFSFGYVITRILCKAIFYLLIIVGTLGKRFKQYRELKPQTCTICETTPANAIDAEMHDLNCSYNICPYCASRLTSDGLARHVTQCPKRKERVEETELYLNLERIPWIVRKLLQVSESTGVALKRSSWLIVLLVLFTVSLSPVQSAPIGYGNTIETYQAREEYTSICLFVLGSILFIVSCLMKGLVDSIGNIFFPGLTICKTCSIGSINGFEIESHKCYCSLLCCPYCRHCSADREIHQLHLSICKKRKTGSNVMLAVCKRMCFRATMEVSNKALLIRSIINTTFVVCILILAVCIVSTSAVEMESLPAGTWEREEDLTNFCHQECQVTETECLCPYEALVLRRPLFLDSIVKGMKNPLNSTSLETSLSIEAPWGAINVQSTYKPTVSTANIALSWSSIEHRGNNILVSGRSESIMKLEERTGISGDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFIDYMFVKWKVDYIKTEAIVCVELTSQERQCSLVEAGTRFNLGPVTITLSEPRNIQQKLPPEIITLHPRIEEGFFDLMHVQKVLSASTVCKLQSCTHGVPGDLQVYHIGNLLKGDKENGHLIHKIEPHFNTSWMSWDGCDLDYYCNMGDWPSCTYTGVTQHNHASFVNLLNIETDYTKSFHFHSKRVTAHGDTPQLDLKARPTYGAGEITVLVEVADMELHTKKIEITGLKFASLTCTGCYACSSGISCKVRIHVDEPDELTVHVKSDDPDVVAASSSLMARKLEFGTDSTFKAFSAMPKTSLCFYIVEREYRKSCSKEDTQKCVNTKLEQPQSILIEHKGTIIGKQNNTCTAKASCWLESVKSFFYGLKNMLSGIFGNVFVGIFLFLAPFILLILFFMFGWRILSCFKCCRRTRGLLKHRHLKDDEETGYRRIIERLNNKKGKNKLLDGERLADRRIAELFSTKTHIG

SEQ ID NO: 1373 - protein, 1165 aa, Artificial Sequence
  derived and/or modified protein sequence (wt) from CCHVF(CCHVF Hodzha)__AY223476.1__Gn-NSm-Gc
SEESGDDCISRTQLLRTETAEIHGDDYGGPGDKITICNGSTIVDQRLGSELGCYTINRVKSFKLCKNSATGKSCEIDSTPVKCRQGYCLKITQEGRGHVKLSRGSEVVLDACDSSCEVMIPKGTGDILVDCSGGQQHFLKDNLIDLGCPRIPLLGKMAIYICRMSNHPKTTMAFLFWFSFGYVITCILCKAIFYLLIIVGTLGKRFKQYRELKPQTCTICETTPANAIDAEMHDLNCSYNICPYCASRLTSDGLARHVTQCPKRKEKVEETELYLNLERIPWIVRKLLQVSESTGVALKRSSWLIVLLVLFAVSLSPVQSAPIGHGKTIETYQAREDYTSICLFVLGSILFIVSCLMKGLVDSIGNIFFPGLTICKTCSIGSINGFEIESHKCYCSLLCCPYCRHCSADREIHQLHLSICKKRKTGSNVMLAVCKRMCFRATMEVSNKALLIRSIINTTFVVCILILAVCVVSTSAVEMESLPAGTWEREEDLTNFCHQECQVTETECLCPYEALVLRRPLFLDSIVKGTKNLLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVDYIKTEAIVCVELTSQERQCSLVEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFVNLLNIETDYTKSFHFHSKRVTAHGDTPQLDLKARPTYGAGEITVLVEVADMELHTKKIEITGLKFASLTCTGCYACSSGISCKVRIHVDEPDELTVHVKSDDPDVVAASSSLMARKLEFGTDSTFKAFSAMPKTSLCFYIVEREYCKSCSKEDTQKCVNTKLEQPQSILIERKGTIIGKQNNTCTAKASCWLESVKSFFYGLKNMLSGIFGNVFVGIFLFLAPFILLILFFMFGWRILFCFKCCRRTRGLFKYKHLKDDEETGYRRIIERLNNKKGKNKLLDGERLADRRIAELFSTKTHIG

SEQ ID NO: 1374 - protein, 1165 aa, Artificial Sequence
  derived and/or modified protein sequence (wt) from CCHVF(CCHVF Kosovo/9553/2001)__AY675511.1__Gn-NSm-Gc
SEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYIARMSNHPKTTMAFLFWFSLGYVITCILCKALFYSLIIIGTLGKKIKQYRELKPQTCTICETAPVNAIDAEMHDLNCSYNICPYCASRLTSDGLARHVKQCPKRKEKVEETELYLNLERIPWVVRKLLQVSESTGVALKRSSWLIVLLVLLTVSLSPVQSAPVGHGKTIETYQTREGFTSICLFMLGSILFIVSCLVKGLVDSVSDSFFPGLSVCKTCSIGSINGFEIESHKCYCSLFCCPYCRHCSADREIHQLHLSICKKRKTGSNVMLAVCKRMCFRATIEASRRALLIRSIINTTFVICILTLTICVASTSAVEMETLPAATWEREEDLTNFCHQECQVPETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEKEYCKSCSEDDTKKCVDTKLEQPQSILIEHRGTIIGKPNDTCPAKTSCWLESVKSFFYGLKNMLGSVFGNFFIGILLFLAPFFLWMLSFMFGWKILFCFKCCRRTRGLFKYRHLKDDEETGYRRIIERLNNKKGKNRLLDGERLADRKIAELFSTKTHIG

SEQ ID NO: 1375 - protein, 1165 aa, Artificial Sequence
  derived and/or modified protein sequence (wt) from CCHVF(CCHVF SPU41/84)__AY900142.1__Gn-NSm-Gc
SEESSDDCISRTQLLRTETAEIHGDNYGGPGDKITICNGSTVVDQRLGSELGCYTINRVKTFKLCENSATGKSCEIDSVPVKCRQGYCLKITQEGRGHVKLSRGSEVVLDACDTSCEVMIPKGTGDILVDCSGGQQHFLKDNLIDLGCPKIPLLGKMAIYICRMSNHPKTTMAFLFWFSFGYVITCIICKVIFYLLIIVGTLGKRFKQYRELKPQTCTICETTPVNAIDAEMHDLNCSYNICPYCASRLTSDGLARHVTQCPKRKEKVEETELYLNLERIPWVVRKLLQVSESTGVALKRSSWLVVLLVLLTVSLSPVQSAPISHGKTVEAYRAREGYTSMCLFVLGSVLFLVSCLMKGLVDSVGNTFFPGLSICKTCSISSINGFEIESHRCYCSLFCCPYCRHCSANKEIHQLHLSICKKRKAGSNVMLAVCKRMCFRATMEVSNRALFIRSIINTTFVLCILILAACVVSTSAVEMESLPAGTWEREEDLTNFCHQECQVADTECLCPYEALVLRRPLFLDSIVKGMKNLLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLVHKIEPHFNTSWMSWDGCDLDYYCNMGDWPSCTYTGVTQHNHASFVNMLNIETDYTKNFHFHSKRVTAHGDTPQLDLKARPTYGAGEITVLVEVADMELHTKKIEISGLKFTSLTCTGCYACSSGISCKVRIHVDEPDELTVHVKSEDPDVVAASSSLMARKLEFGTDSTFKAFSAMPKTSLCFYIVEREYCKSCSEEDTQKCVNTKLEQPQSILIERKGTIIGKQNNTCKAKAGCWLESVKSFFYGLKNMLSGIFGNVFIGIFLFLAPFILLILFFMFGWRILFCFKCCRRTRGLFKYRHLKDDEETGYRKIIERLNNKKGKNKLLDGERLADRRIAELFSTKTHIG

SEQ ID NO: 1376 - protein, 1165 aa, Artificial Sequence
  derived and/or modified protein sequence (wt) from CCHVF(CCHVF UG3010)__AY900143.1__Gn-NSm-Gc
AEGVSNDCVSRTQLIKTEVAEIHEDSYGGPGEKITICNGSTIVDQRLGSELGCYTINRVKTYKLCENSATEKGCEIDSVPVKCKQGFCLKVTQEGRGHVKLSRGTEIVLDVCDTSCELMIPKGTGDILVDCSGGQQHFLQDNLIDLGCPNVPLLGKMAIYICRMSNHPKTTMAFLFWFSFGYVITCIVCKVLFYLLIVIGTLSKKLKQYRELKPQTCIVCESTPVNAIDAEMHELNCNYNICPYCASRLTSDGLVRHVNQCPKRKEKVEETELYLNLERIPWLVRRLLQVSESTGMALKRSCWMTTLLILLVVSLSPVQSAPVGQGKAVEVYRVRESYTSICLFVLGSVLFAVSWLIKGLIDGIGNSFFPGLSVCKTCSIGSINGFEIESHKCYCSLFCCPYCRACSSDKITHRMHLNVCKKRKAGSNVMLAVCKRMCFKATVEASNTALLIRGIINSTFVICVLILVICVVSTSAVDMENLPAGIWEREEDLTNFCHQECQVTETECLCPYEALILRKPLYLDSIAKGMKSLLNSTNLETSLSIEAPWGAINVQSTFKPTVSAANIALSWSSVEHRGNKILVSGRSESIMKLEERTGISWSLGVEDASESKTLTVSVMDLSQMYSPVFEYLSGDRQVEEWPKATCTGDCQERCGCTSSTCLHKEWPHSRNWRCNPTWCWGVGTGCTCCGLDVRDLFTDYMMVKWKVEYVKTEAIMCVELTSQERQCSLIEAGTRFNLGPVTITLSEPRNIQQRLPSEIVTLHPKIEEGFFDLMHVQKVLSASTVCKLQSCTHGVPGDLQVYHVGNLLKGDKVNGHSIHKIESHFNTSWMSWDGCDLDYFCNMGDWPSCTYTGVTQHNRAAFINMLNIETDYTKTFHFHSKRVTAHGDTPQLDLKARPTYGAGEVTVLVEVADLELHTKKIEVSGLKFASLTCSGCYACSSGISCKVRIHVNEPDEFTVHVKSSDPDVVAAGSSLMARKIEFGADSTFKAFSSMPKNSLCFYIVERDYCSSCTNDDTQKCVDTKLEHPQSILIEHKGTIIGKQNDTCSTKTSCWLESVKSFFYGLKNMLGGIFGNVFLGIFLFLAPFALLIFFFFFGWRLLFCLKCCRRTRGLLKYKQLKDEEEAGYKKIIERLNDKKGKSRLFDGERLADRKIAELFSTKTHIG

SEQ ID NO: 1377 - protein, 1165 aa, Artificial Sequence
  derived and/or modified protein sequence (wt) from CCHVF(CCHVF Hy13)__AY900145.1__Gn-NSm-Gc
SEESGDDCISRTQLSRTETAEIHSDNYGGPGDKITICNGSTIVDQRLGSELGCYTINRVKSFKLCENSATGKSCEIDSTPIKCRQGFCLKITQEGRGHVKLSRGSEVVLDACDSSCEIMIPKGTGDILVDCSGGQQHFLKDNLIDLGCPNIPLLGKMAIYICRMSNHPKTTMAFLFWFSFGYVITCILCKVIFYLLIVVGTLGKKFKQYRELKPQTCTICETTPVNAIDAEMHDLNCSYNICPYCASRLTSDGLARHVMQCPKRKEKVEETELYLNLERIPWVVRKLLQVSESTGVALKRSSWLVVLLVLLTVSLSPVQSAPIGHGKTVETYQTREGYTSICLFVLGSILFIVSCLMKGLVDSVGNSFFPGSSICKTCSIGSINGFEIESHKCYCSLFCCPYCRHCSADREIHKLHLSICKKRKTGSNVMLAVCKRMCFRATVEVSNKALLIRNIINTTFVVCILILAVCVVSTSAVEMESLPAGTWEREEDLTNFCHQECQATETECLCPYEALVLRKPLFSDSIVKGMKNLLNSTSLETSLSIEAPWGAINVQSTFKPTVSAANIALSWSSVEHRGNKILVSGRSESIMKLEERTGISWDLGVEDASESKLLTVSIMDLSQMYSPVFEYLSGDRQVEEWPKATCTGDCPERCGCTSSTCLHKEWPHSRNWRCNPTWCWGVGTGCTCCGLDVKDLFTDHMFVKWKVEYIKTEAIVCVELTSQERQCSLIEAGTRFNLGPVTITLSEPRNIQQKLPPEIVTLHPRIEEGFFDLMHVKKVLSASTVCKLQSCTHGVPGDLQVYHIGNLLKGDKVNGHLIHKIEPHFNTSWMSWDGCDLDYYCNMGDWPSCSYTGVTQHNHAAFVNMLNIETDYTKIFHFHSKRVTAHGDTPQLDLKARPTYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSKEDTQKCVNTKLEQPQSILIEHKGTIIGKQNDTCTSKAGCWLESVKSFFYGLKNMLSGIFGNVFIGIFLFLAPFILLILFFMFGWRILFCFKCCRRTRGLFKYRHLKDDEETGYRKIIERLNNKKGKNKLLDGERLADRKIAELFSTKTHIG

SEQ ID NO: 1378 - protein, 1165 aa, Artificial Sequence
  derived and/or modified protein sequence (wt) from CCHVF(CCHVF Semunya)__DQ094832.1__Gn-NSm-Gc
AEGVSNDCVSRTQLIKTEVAEIHEDSYGGPGEKITICNGSTIVDQRLGSELGCYTINRVKTYKLCENSATEKGCEIDSVPVKCKQGFCLKVTQEGRGHVKLSRGTEIVLDVCDTSCELMIPKGTGDILVDCSGGQQHFLQDNLIDLGCPNVPLLGKMAIYICRMSNHPKTTMAFLFWFSFGYVITCVVCKVLFYLLIVIGTLGKKLKQYRELKPQTCIVCESIPVNAIDAEMHELNCNYNICPYCASRLTSDGLVRHVTQCPKRKEKVEETELYLNLERIPWLVRRLLQVSESTGMALKRSCWMTTLLILLVVSLSPVQSAPVGQEKAIEVYQVRESYTSICLFVLGSVLFAVSWLVKGLIDGIGNSFFPGLSVCKTCSIGSINGFEIESHKCYCSLFCCPYCRACSSDKITHRMHLNICKRRKVGSNVMLAVCKRMCFKATVEASNSALLIRSIINSTFVICVLILVICVVSTSAVDMENLPAGIWEREEDLTNFCHQECQVTETECLCPYEALILRKPLFLDSIAKGKKSLLNSTNLETSLSIEAPWGAINVQSTFKPTVSAANIALSWSSVEHRGNKILVSGRSESIMKLEERTGISWSLGVEDASESKTLTVSVMDLSQMYSPVFEYLSGDRQVEEWPKATCTGDCPERCGCTSSTCLHKEWPHSRNWRCNPTWCWGVGTGCTCCGLDVRDLFTDYMMVKWKVEYVKTEAIMCVELTSQERQCSLIEAGTRFNLGPVTITLSEPRNVQQRLPSEIVTLHPKIEEGFFDLMHVQKVLFCKYSLQATSCTHGVPGDLQVYHVGNLLKGDKVNGHSIHKIESHFNTSWMSWDGCDLDYFCNMGDWPSCTYTGVTQHNRAAFVNMLNIETDYTKTFHFHSKRVTAHGDTPQLDLKARPTYGAGEVTVLVEVADLELHTKKIEVSGLKFASLTCSGCYACSSGISCKVRIHVNEPDEFTVHVKSNDPDVVAAGSSLMARKIEFGADSTFKAFSSMPKNSLCFYIVERDYCSSCTDDDTQKCVNIKLEHPQSILIEHKGTIIGKQNDTCPTKTSCWLESVKSFFYGLKNMLGGIFGNVFLGIFLFLAPFALLILFFFFGWRLLFCLKCCRRTRGLLKYKQLKDEEEAGYKKIIERLNDKKGKSRLFDGERLADRKIAKLFSTKTHIG

SEQ ID NO: 1379 - protein, 1165 aa, Artificial Sequence
  derived and/or modified protein sequence (wt) from CCHVF(CCHVF SPU128/81/7)__DQ157174.1__Gn-NSm-Gc
SEEPSDDCISRTQLLRTETAEIHGDNYGGPGDKITICNGSTIVDQRLGSELGCYTINRVKSFKLCENSATGKSCEIESVPVKCRQGYCLRITQEGRGHVKLSRGSEVVLDACDTSCEIMIPKGTGDILVDCSGGQQHFLKDNLIDLGCPKIPLLGKMAIYICRMSNHPKTTMAFLFWFSFGYVITCILCKAIFYLLIIIGTLGKRFKQYRELKPQTCTICETTPVNAIDAEMHDLNCSYNICPYCASRLTSDGLARHVTQCPKRKEKVEETELYLNLERIPWVVRKLLQVSESTGVALKRSSWLIVLLVLFTVSLSPVQSAPIGHGKTIEAYRAREGYTSICLFVLGSILFIVSCLMKGLVDSVGNSFFPGLSICKTCSISSINGFEIESHKCYCSLFCCPYCRHCSADKEIHKLHLSICKKRKTGSNVMLAVCKRMCFRATMEVSNRALFIRSIINTTFVLCILILAVCVVSTSAVEMENLPAGTWEREEDLTNFCHQECQVTETECLCPYEALVLRKPLFLDSIVKGMKNLLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFVNLLNIETDYTKNFHFHSKRVTAHGDTPQLDLKARPTYGAGEITVLVEVADMELHTKKIEISGLKFASLTCTGCYACSSGISCKVRIHVDEPDELTVHVKSDDPDVVAASSSLMARKLEFGTDSTFKAFSAMPKTSLCFYIVEREHCKSCSEEDTKKCVNTKLEQPQSILIEHKGTIIGKQNSTCTAKASCWLESVKSFFYGLKNMLSGIFGNVFIGIFLFLGPFILLILFFMFGWRILFCFKCCRRTRGLLKYRHLKEDEETGYRRIIERLNNKKGKNKLLDGERLADRRIAELFSTKTHIG

SEQ ID NO: 1380 - protein, 1165 aa, Artificial Sequence
  derived and/or modified protein sequence (wt) from CCHVF(CCHVF ROS/HUVLV-100)__DQ206448.1__Gn-NSm-Gc
SEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVGHGKTIETYQTREGFTSICLFMLGSILFLVSCLVKGLVDSVSDSFFPGLSVCKTCSIGSINGFEIESHKCYCSLFCCPYCRHCSADREIHQLHLSICKKRKTGSNVMLAVCKRMCFRATIEASRRALLIRSIINTTFVICILTLTICVVSTSAVEMENLPSGTWEREEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEEDTQKCVDTKLEQPQSILIEHKGTIIGKQNDTCTAKASCWLESVKSFFYGLKNMLGSVFGNFFIGILLFLAPFVLLVLFFMFGWKILFCFKCCRRTRGLLKYRLLKDDEETGYRRIIERLNNKKGKNRLLDGERLADRKIAELFSTKTHIG

SEQ ID NO: 1381 - protein, 1165 aa, Artificial Sequence
  derived and/or modified protein sequence (wt) from CCHVF(CCHVF AP92)__DQ211625.1__Gn-NSm-Gc
SEGGDGGCISRTQLIKTETAEVHGDDYGGPGEKITICNGSTIVDQRLGSELGCYTINRIKSFKLCENSAQGKNCEIDSAPVQCRQGYCLKISQEGRGHVKLSRGSEIVLDVCDTSCEIMIPKGTGDILVDCSGGQQHFLQSNLVDLGCPNIPLLGKMAIYICRMSNHPKTTMAFLFWFSFGYVITCILCKTLFYILIIIGTLGKKLKQYRELKPQTCTICESVPVNAIDAEMHDLNCSYNICPYCASRLTSEGLTRHVNQCPKRKEKVEETELYLNLERIPWIVRKLLQVSESTGVALKRSSWMIVLLILLIVSMSPVQSAPISQERTVALYQSREDYMGICLVIMGSVLLAVSLLVRGLIDSISSTFFPGLSVCRTCHIGSINGFEIESHKCYCGLLCCPYCRACSTDQDAHQFHLSVCKKRKAGSNVMLAVCKRMCFKAIIEASNKVLFIRNVINTTFVVCILVMVACIASSAAVEMENLPAGTWEREEELTNFCHQECQVTETECLCPYESFILRKPLFLDSIAKGVKNLLNSTSLETSLSIEAPWGAINAQSTYKPTASSANIALTWSSVEHRGNKILVSGRSESIMKLEERTGISWNLGVEDASESRTLTISVMDLSQMYSPVFEYLSGDRQVEEWPKATCTGNCPERCGCTSSTCLYKEWPHSRNWRCNPTWCWGVGTGCTCCGLDVKELFTDHMLVKWKVEYIKTEAIVCVELTSQERQCSLIEAGTRFSLGPVTITLSEPRNIQQKLPPELITLHPKIEDGYFDLMHVQKVMSASTVCKLQSCTHGVPGDLQIYHVGNLLKGDRVNGHLIHKVEPHLNTSWMSWDGCDLDYFCNMGDWPSCTYTGVTQHNHAAFANLLNIETDYTKTFHFHSKRVTAHGDTPQLDLKARPRYGAGEITVLVEVADMELHTKKVEVTGLKFASLTCSGCYACSSGISCKVRIHVDEPDELTVHVKSSDPDIVAASSSLMARKIEFGVDSTFKAFSSMPKDSLCFYIVERDYCNSCKNEETQRCVNAKLEQPQSILIEHTGTIIGKQNDTCGSRTSCWLDSFKSFFYGLKSMLSGIFGNVFLGIFLFLAPFALLLFFFFFGWRILFCFKCCRRTRGLFKYRHIKDDEEVGYKKIIERLNNKKGKHRLLDGERLADRKIAELFSTKTHIG

SEQ ID NO: 1382 - protein, 1165 aa, Artificial Sequence
  derived and/or modified protein sequence (wt) from CCHVF(CCHVF ArD8194)__DQ211626.1__Gn-NSm-Gc
AEGGSNDCVSRTQLVKTEVAEIHEDSYGGPGEKITICNGSTIVDQRLGSELGCYTINRVRTYKLCENSATEKSCEIDSVPVKCKQGFCLKITQEGRGHVKLSRGTEIVLDVCDTSCELMIPKGTGDILVDCSGGQQHFLQDNLIDLGCPNIPLLGRTAIYVCRMSNHPKTTMAFLFWFSFGYVITCVVCKVLFYLLIVIGTLGKRLKQYRELKPQTCIVCESIPVNAIDAEMHDLNCNYNICPYCASRLTSDGLVRHVTQCPKRKEKVEETELYLNLERIPWLVRKLLQVSESTGVALKRSCWMITLLILLTVSMSPVQSAPVGHKRAVEVYQMRESYTGICLFVLGSVLFAVSWLVKALIDSIGNSFFPGLSICKTCSIGSINGFEIESHKCYCSLFCCPYCRACSSDKITHRMHLNVCKKRKVGSNVMLAVCKRMCFKATIEASNRATFIRNIINSTFVICILILVICVVSTSAVDMENLPAGIWEKEEDLTNFCHQECQVTETECLCPYEALMLRKPLFLDRIAKGMKSLLNSTSLETSLSIEAPWGAINVQSTFKPTVSAANIALSWSSVEHKGNKILVSGRSESIMKLEERTGISWCLGVEDASESKTLTVSVMDLSQMYSPVFEYLSGDRQVEEWPKATCTGDCPERCGCTSSTCLHKEWPHSRNWRCNPTWCWGVGTGCTCCGLDVKDLFTDYMLVKWKVEYIKTEAIICVELTSQERQCSLIEAGTRFNLGPVTITLSEPRNVQQRLPPEIITLHPKIEEGFFDLMHVQKVMSASTVCKLQSCTHGVPGDLQVYHVGNLLKGDKVNGHSIHKIESHLNTSWMSWDGCDLDYFCNMGDWPSCTYTGVTQHNHAAFINMLNIETDYTKTFHFHSKRVTAHGDTPQLDLKARPAYGAGEITVLVEVADLELHTKKIEVSGLKFASLSCSGCYACSSGISCKVRIHVNEPDEFTVHVKSNDPDVVAAGSSLMARKIESGADSTFKAFSSMPKNSLCFYIVERDYCSSCTDDDTQKCVDIKLEHPQSILIEHKGTIIGKQNDTCPTKTSCWLESIKSFFYGLKNMLSGIFGNVFLGMLLFLAPFILLILFFFFGWRLLFCLKCCRRTRKLLKYKHLRDEEESGYKKIIERLNDKKGKSRLFDGERLADRKIAELFSTKTHIG

SEQ ID NO: 1383 - protein, 1165 aa, Artificial Sequence
  derived and/or modified protein sequence (wt) from CCHVF(CCHVF ArD15786)__DQ211627.1__Gn-NSm-Gc
AEGGSNDCVSRTQLVKTEVTEIHEDSYGGPGEKITICNGSTIVDQRLGSELGCYTINRVRTYKLCENSATEKSCEIDSVPVKCKQGFCLKITQEGRGHVKLSRGTEIVLDVCDTSCELMIPKGTGDILVDCSGGQQHFLQDNLIDLGCPNIPLLGQTAIYVCRMSNHPKTTMAFLFWFSFGYVITCVVCKVLFYLLIVIGTLGKRLKQYRELKPQTCIVCESIPVNAIDAEMHDLNCNYNICPYCASRLTSDGLVRHVTQCPKRKEKVEETELYLNLERIPWLVRKLLQVSESTGVALKRSCWIITLLILLTVSMSPVQSAPVGHKRAVEVYQIRESYTGICLFVLGGVLFAVSWLVKALIDSIGNSFFPGLSICKTCSIGSINGFEIESHKCYCSLLCCPYCRACSSDKITHRMHLNVCKKRKVGSNVMLAVCKRMCFKATIEANNRATFIRNIINSTFVICILILVICVVSTSAVDMENLPAGIWEKEEDLTNFCHQECQVTETECLCPYEALMLRKPLSLDSIAKGMKSLLNSTSLETSLSIEAPWGAINVQSTFKPTISAANIALSWSSVEHKGNKILVSGRSESIMKLEERTGISWCLGVEDASESKTLTVSVMDLSQMYSPVFEYLSGDRQVEEWPKATCTGDCPERCGCTSSTCLHKEWPHSRNWRCNPTWCWGVGTGCTCCGLDVKDLFTDYMLVKWKVEYIKTEAIICVELTSQERQCSLIEAGTRFNLGPVTITLSEPRNVQQRLPPEIITLHPKIEEGFFDLMHVQKVMSASTVCKLQSCTHGVPGDLQVYHVGNLLKGDKVNGHSIHKIESHLNTSWMSWDGCDLDYFCNMGDWPSCTYTGVTQHNRAAFINMLNIETDYTKTFHFHSKRVTAHGDTPQLDLKARPTYGAGEITVLVEVADLELHTKKIEVSGLKFASLTCSGCYACSSGISCKVRIHVNEPDEFTVHVKSNDPDVVAAGSSLMARKIESGADSTFKAFSSMPKNSLCFYIVERDYCSSCTDDDTQKCVDIKLEHPQSILIEHKGTIIGKQNDTCPTKTSCWLESIKSFFYGLKNMLSGIFGNIFLGMLLFLAPFVLLILFFFFGWRLLFCLKCCRRTRKLLKYKHLRDEEESGYKKIIERLNDKKGKSRLFDGERLADRKIAELFSTKTHVG

SEQ ID NO: 1384 - protein, 1165 aa, Artificial Sequence
  derived and/or modified protein sequence (wt) from CCHVF(CCHVF ArD39554)__DQ211628.1__Gn-NSm-Gc
SESNNNDCVSRTQLIKTENAEIHGDDYGGPGEKITICNGSTIVEQRLGSELGCYTINRIKSFKLCENSASGKGCEIDSTPVKCKQGFCLKITQEGRGHVKLSRGSEIILDVCDSSCEMMIPKGSGDILVDCSGGQQHFLQDNLVDLGCPNVPLLGKMAIYICRMSNHPKTTMAFLFWFSFGYVITCIFCKVIFYVLIIIGTLGKRIKQYRELKPQTCTICEATPVNAIDAEMHDLNCSYNICPYCASRLTSEGLVRHVTQCPKRKEKIEETELYLNLERIPWFVRKLLQVSESTGVALKRSSWLVTLLVLLTVSLSPVQSAPIGQERTVVTYQVRESYTGMCLFILGSVLFAISWLTKGLVDSVGNIFFPGLSVCKTCSIGSINGFEIESHKCYCSLFCCPYCRYCSADRGAHQSHLSVCKKRKTGSNVMLAVCKRMCFRATLKVSSEALIIRSIINTTFVVCILILVVCVVSTSAVEMENLPAGTWEKEEDLTNFCHQECQVTETECLCPYEAFVLRKPLFLDSTAKSMKSLLNSTSLETSLSIEAPWGAINVQSTFKPTASTANIALSWSSVEHRGNKILVTGRSESIMKLEERTGISWNLGVEDASESKTLTVSVMDLSQMYSTVFEYLSGDRQVEEWPKATCTGDCPERCGCTSSTCLHKAWPHSRNWRCNPTWCWGVGTGCTCCGLDVKNLFTDYMLIKWKVEFIKTEAIVCVELTSQERQCSLIEAGTRFNLGPVTITLSEPRNIQQKLPPELVTLHPRVEEGFFDLMHVQKVLSASTVCKLQSCTHGVPGDLQVYHVGNLLKGDKINGNSFHKIEPNLNTSWMSWDGCDLDYYCNMGDWPSCTYTGVTQHNHAAFVNLLNIETDYTKNFHFHSKRVTAHGETPQLDLKARPKYGAGEVTVLVEVADMELHTKKIEISGLKFASLTCTGCYACSSGISCKVRLHVDEPDELTVHVKSDDPDVVAASSSLMARKIEFGTDSTFKAFSSMPKDKLCFYIVERDYCSSCSKEDTQKCVNAKLEQPQSILIEHKGTIIGKQNDTCTVKASCWLESVKSFFYGLKNMLGGIFGNVILGIIMFLAPFALLLLFFLFGWRILFCLRCCRRTRGLFKYKHIKDDEESGYKRIIERLNNKKGKNKLFDGERLADKKIAELFSTKTHIG

SEQ ID NO: 1385 - protein, 1165 aa, Artificial Sequence
  derived and/or modified protein sequence (wt) from CCHVF(CCHVF C-68031)__DQ211629.1__Gn-NSm-Gc
SEESGDDCISRTQLSRTETAEIHSDNYGGPGDKITICNGSTIVDQRLGSELGCYTINRVKSFKLCENSATGKSCEIDSTPIKCRQGFCLKITQEGRGHVKLSRGSEVVLDACDSSCEIMIPKGTGDILVDCSGGQQHFLKDNLIDLGCPNIPLLGKMAIYICRMSNHPKTTMAFLFWFSFGYVITCILCKVIFYLLIVVGTLGKKFKQYRELKPQTCTICETTPVNAIDAEMHDLNCSYNICPYCASRLTSDGLARHVMQCPKRKEKVEETELYLNLERIPWVVRKLLQVSESTGVALKRSSWLVVLLVLLTVSLSPVQSAPIGHGKTVETYQTREGYTSICLFVLGSILFIVSCLMKGLVDSVGNSFFPGLSICKTCSIGSINGFETESHKCYCSLFCCPYCRHCSADREIHKLHLSICKKRKTGSNVMLAVCKRMCFRATVEVSNKALLIRNIINTTFVVCILILAVCVVSTSAVEMESLPAGTWEREEDLTNFCHQECQVTETECLCPYEALVLRKPLFSDSIVKGMKNLLNSTSLETSLSIEAPWGAINVQSTFKPTVSAANIALSWSSVEHRGNKILVSGRSESIMKLEERTGISWDLGVEDASESKLLTVSIMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIVTLHPRIEEGFFDLMHVKKVLSASTVCKLQSCTHGVPGDLQVYHIGNLLKGDKVNGHLIHKIEPHFNTSWMSWDGCDLDYYCNMGDWPSCSYTGVTQHNHAAFVNMLNIETDYTKIFHFHSKRVTAHGDTPQLDLKARPTYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSKEDTQKCVNTKLEQPQSILIEHKGTIIGKQNDTCTSKAGCWLESVKSFFYGLKNMLSGIFGNVFIGIFLFLAPFILLILFFMFGWRILFCFKCCRRTRGLFKYRHLKDDEETGYRKIIERLNNKKGKNKLLDGERLADRKIAELFSTKTHIG

SEQ ID NO: 1386 - protein, 1165 aa, Artificial Sequence
  derived and/or modified protein sequence (wt) from CCHVF(CCHVF Drosdov)__DQ211630.1__Gn-NSm-Gc
SEEPGDDCISRTQLLKTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLKCSYNICPYCASRLTSDGLARHVTQCPKRKEKVEETELYLNLERIPWIVRKLLQVSESTGVALKRSSWLIVLLVLLTVSLSPVQSAPVGHGKTIETYQTREGFTSICLFMLGSILFIVSCLVKGLVDSVSDSFFPGLSVCKTCSIGSINGFEIESHKCYCSLFCCPYCRHYSADREIHQLHLSICKKRKTGSNVMLAVCKRMCFKATIEASRRALLIRSIINTTFVICILILAICVVSTSAVEMENLPAGTWEREEDLTNFCHQECQVTETECLCPYEALVLRKPLFLDSTVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYMKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRVNGHLIHKIEPHFNTSWMSWDGCDLDYYCNMGNWPSCTYTGVTQHNHAAFVNLLNIETDYTKTFHFHSKRVTAHGDTPQLDLKARPTYGAGEITVLVEVADMELHTKKVEISGLKFASLVCTGCYACSSGISCKVRIHVDEPDELTVHVKSSDPDVVAASTSLMARKLEFGTDSIFKAFSAMPKTSLCFYIVEREYCKSCSEDDTKKCVDTKLEQPQSILIEHKGTIIGKQNDTCTAKASCWLESVKSFFYGLKNMLGSVFGNFFVGILLFLAPFVLLVLFFMFGWKILFCFKCCRRTRGLFKYRHLKDDEETGYRRIIERLNSKKGKNRLLDGERLADRKIAELFSTKTHIG

SEQ ID NO: 1387 - protein, 1165 aa, Artificial Sequence
  derived and/or modified protein sequence (wt) from CCHVF(CCHVF Kashmanov)__DQ211631.1__Gn-NSm-Gc
SEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVGHGKTIETYQTREGFTSICLFMLGSILFLVSCLVKGLVDSVSDSFFPGLSVCKTCTIGSINGFEIESHKCYCSLFCCPYCRHCSADREIHQLHLSICKKRKTGSNVMLAVCKRMCFRATIEASRRALLIRSIINTTFVICILTLTICVVSTSAVEMENLPSGTWEREEDLTNFCHQECQVTETECLCPYEALVLRKPLFLDSIVKGMKNSLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRINGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEEDTQKCVDTKLEQPQSILIEHKGTIIGKQNDTCTAKASCWLESVKSFFYGLKNMLGSVFGNFFIGILLFLAPFVLLVLFFMFGWKILFCFKCCRRTRGLLKYRHLKDDEETGYRRIIERLNNKKGKNRLLDGERLADRKIAELFSTKTHIG

SEQ ID NO: 1388 - protein, 1165 aa, Artificial Sequence
  derived and/or modified protein sequence (wt) from CCHVF(CCHVF Oman)__DQ211632.1__Gn-NSm-Gc
SEESGEDCISRTQLLRTETAEIHGDNYGGPGDKITICNGSTIVDQRLGSELGCYTINRVKSFKLCENSATGKSCEIDNTPVKCKQGFCLKITQEGRGHVKLSRDSEVVLDACDSSCEIMIPKGTGDILVDCSGGQQHFLKDNLIDLGCPNIPLLGKMAIYICRMSNHPKTTMAFLFWFSFGYVITCILCKVIFYLLIVVGTLGKKFKQYRELKPQTCTICETTPVNAIDAEMHDLNCSYNICPYCASRLTSDGLARHVMQCPKRKEKIEETELYLNLERIPWVVRKLLQVSESTGVALKRSSWLIVLLVLLTVSLSPVQSAPIGHGKTIETYQTREGYTSICLFVLGSILFIVSHLMKGLVDSVGNSFFPGLSICKTCSIGSINGFEIESHKCFCSLFCCPYCRHCSADKEIHKLHLSICKKRKAGSNVMLAVCKRMCFRATMEVSNKALLIRSVINTTFVVCILILAVCVVSTSAVEMESLPAGTWEREEDLTNFCHQECQVTETECLCPYEALVLRKPLFLDSIAKGMKNLLNSTSLETSLSIEAPWGAINVQSTFKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIVTLHPRIEEGFFDLMHVQKVLSASTVCKLQSCTHGVPGDLQVYHIGNLLKGDKVNGHLIHKVEPHFNTSWMSWDGCDLDYYCNMGDWPSCTYTGVTQHNHAAFVNLLNIETDYTKNFHFHSKRVTAHGDTPQLDLKARPNYGAGEVTVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSKEDTQKCVNAKLERPQSILIEHKGTIIGKQNDTCTAKASCWLESVKSFFYGLKNMLSGIFGNVFIGIFLFLAPFILLILFFMFGWRILFCFKCCRRTRGLFKYRHLKDDEETGYRKIIERLNNKKGKNKLLDGERLADRKIAELFSTKTHIG

SEQ ID NO: 1389 - protein, 1165 aa, Artificial Sequence
  derived and/or modified protein sequence (wt) from CCHVF(CCHVF SPU97/85)__DQ211633.1__Gn-NSm-Gc
SEESDGDCISRTQLLRTETAEIHSDNYGGPGDKITICNGSTIVDQRLGSELGCYTINRVKSFKLCENSATGKSCEIDSTPVKCRQGFCLKITQEGRGHVKLSRGSEIVLDACDSSCEIMIPKGTGDILVDCSGGQQHFLKDNLIDLGCPNIPLLGRMAIYICRMSNHPKTTMAFLFWFSFGYVITCILCKVIFYLLIVAGTVGKKFKQYRELRPQTCTICETTPVNAIDAEMHDLNCSYNICPYCASRLTSDGLARHVMQCPKRKEKIEETELYLNLERIPWVVRKLLQVSESTGVALKRSSWLTVLLVLLIVSLSPVQSAPIGHGKTIETYQAREGYTSFCLFILGSILFIVSCLVKGLIDSVGNSFFPGLSICKTCSIGSVNGFEIESHKCYCSLFCCPYCRHCSADREIHKLHLSICKKRKTGSNVMLAVCKRMCFRATIEVSNRALLIRSIINTTFAVCILTLAVCVVSTSAVEMESLPAGTWEREEDLTNFCHQECQVTETECLCPYEALVLRKPLFLDSIVKGKKNLLNSTSLETSLSIEAPWGAINVQSTFKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHAAFVNLLNIETDYTKNFHFHSKRVTAHGDTPQLDLKARPTYGAGEVTVLVEVADMELHTKKIEISGLKFASLSCTGCYACSSGISCKVRIHVDEPDELTVHVKSEDPDIVAAGSSLMARKLEFGADSTFKAFSAMPKTSLCFYIVEREYCKSCSREDTQKCVNTKLERPQSILIEHKGTIIGKQNDTCTAKASCWLESVKSFFYGLKSMLSGIFGNVFIGIFLFIAPFVLLILFFMFGWRILFCFKCCRRTRGLFKYRHLKDDEETGYRKIIERLNNKKGKNKLLDGERLADRKIAELFSTKSHIG

SEQ ID NO: 1390 - protein, 1165 aa, Artificial Sequence
  derived and/or modified protein sequence (wt) from CCHVF(CCHVF SPU103/87)__DQ211634.1__Gn-NSm-Gc
SEESSDDCISRTQLLRTETAEIHGDNYGGPGDKITICNGSTIVDQRLGSELGCYTINRVKTFKLCENSATGKSCEIDSVPVKCRQGYCLKITQEGRGHVKLSRGSEVVLDACDTSCEVMIPKGTGDILVDCSGGQQHFLKDNLIDLGCPKIPLLGKMAIYICRMSNHPKTTMAFLFWFSFGYVITCVLCKAIFYLLIIVGTLGKRLKQYRELKPQTCTICETTPVNAIDAEMHDLNCSYNICPYCASRLTSDGLARHVTQCPKRKEKVEETELYLNLERIPWVVRRLLQVSESTGVALKRSSWLIVLLVLFTVSLSPVQSAPISHGKTVEAYQAREGYTGMCLFVLGSILFLVSCLMKGLVDSVGNTFFPGLSICKTCSISSINGFEIESHRCYCSLFCCPYCRHCSANKEIHQLHLSICKKRKTGSNVMLAVCKRMCFRATMEVSNRALFIRSIINTTFVLCILILAVCVVSTSAVEMESLPAGTWEREEDLTNFCHQECQVTDTECLCPYEALVLRRPLFLDNIVKGMKNLLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKIEYIKTEAIVCVELTSQERQCSLIEAGTRFNLGPVTITLSEPRNIQQKLPSEIITLHPRIEEGFFDLMHVQKVLSASTVCKLQSCTHGVPGDLQVYHIGNLLKGDKVNGHLVHKIEPHFNTSWMSWDGCDLDYYCNMGDWPSCTYTGVTQHNHASFVNLLNIETDYTKNFHFHSKRVTAHGDTPQLDLKARPTYGAGEITVLVEVADMELHTKKIEISGLKFTSLTCTGCYACSSGISCKVRIHVDEPDELTVHVKSDDPDVVAASSSLMARKLEFGTDSTFKAFSAMPKTSLCFYIVEREYCKSCSEEDTQKCVNTKLEQPQSILIEHKGTIIGKQNNTCKARAGCWLESVKSFFYGLKNMLSGIFGNVFIGIFLFLAPFILLILFFMFGWRILFCFKCCRRTRGLFKYRHLKDDEETGYRKIIERLNNKKGKNKLLDGERLADRRIAELFSTKTHIG

SEQ ID NO: 1391 - protein, 1165 aa, Artificial Sequence
  derived and/or modified protein sequence (wt) from CCHVF(CCHVF SPU415/85)__DQ211635.1__Gn-NSm-Gc
SEESDGDCISRTQLLRTETTEIHSDNYGGPGDKITICNGSTIVDQRLGSELGCYTINRVKSFKLCENSATGKSCEIDSTPVKCRQGFCLKITQEGRGHVKLSRGSEIVLDACDSNCEIMIPKGTGDILVDCSGGQQHFLKDNLIDLGCPNIPLLGKMAIYICRMSNHPKTTMAFLFWFSFGYVITCILCKVIFYLLIVAGTVGKKFKQYRELRPQTCTICETIPVNAIDAEMHDLNCSYNICPYCASRLTSDGLARHVMQCPKRKEKVEETELYLNLERIPWVVRKLLQVSESTGVALKRSSWLTVLLVLLIVSLSPVQSAPIGHGKTIETYQAREGYTSFCLFILGSILFVVSCLVKGLIDSVGNSFFPGLSICKTCSIGSINGFEIESHKCYCSLFCCPYCRHCSADREIHKLHLSICKKRKTGSNVMLAVCKRMCFRATIEVSNRALLIRNIINTTFVVCILTLAVCVVSTSAVEMESLPAGTWEKEEDLTNFCHQECQVTETECLCPYEALVLRKPLFLDSIVKGMKNLLNSTSLETSLSIEAPWGAINVQSTFKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQRVLSASTVCKLQSCTHGVPGDLQVYHIGNLLKGDKVNGHLIHKIEPHFNTSWMSWDGCDLDYYCNMGDWPSCTYTGVTQHNHAAFVNLLNIETDYTKNFHFHSKRVTAHGDTPQLDLKARPTYGAGEVTVLVEVADMELHTKKIEISGLKFASLTCTGCYACSSGISCKVKIHVDEPDELTVHVKSEDPDIVAAGSSLMARKLEFGADSTFKAFSAMPKTSLCFYIVEREYCKSCSREDTRKCVNTKLDRPQSILIEHKGTIIGKQNNTCTAKASCWLESVKSFFYGLKNMLSGIFGNVFIGIFLFIAPFVLLILFFMFGWRILFCFKCCRRTRGLFKYRHLKDDEETGYRKIIERLNNKKGKNKLLDGERLADRKIAELFSTKSHIG

SEQ ID NO: 1392 - protein, 1165 aa, Artificial Sequence
  derived and/or modified protein sequence (wt) from CCHVF(CCHVF Turkey200310849)__DQ211636.1__Gn-NSm-Gc
SEEPGDDCISRTQLLRTETAEIHDDNYGGPGDKITICNGSTIVDQRLGSELGCYTINRVKSFKLCENSATGKTCEVDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCISCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLTVSLSPVQSAPVGHGKTIEIYQTREGFASICLFMLGSILFIVSCLVKGLVDSVSDSFFPGLSVCKTCSIGSVNGFEIESHKCYCSLFCCPYCRHCSADREIHQLHLSICKKRKTGSNVMLAVCKRMCFRATIEASRRALLIRSIINTTFVICILTLTICVVSTSAVEMENLPAGTWEREEDLTNFCHQECQVTETECLCPYEALVLRKPLFLDSIVKGMKNLLNSTSLETSLSIEAPWGAINVQSTFKPAVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQVYHIGNLLKGDRVNGHLIHKIESHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEDDTQKCVDTRLEQPQSILIEHKGTIIGKQNDTCTAKASCWLESVKSFFYGLKNMLGSVFGNLFIGILLFLAPFVLLVLFFMFGWKILFCFKCCRRTRGLFKYRHLKDDEETGYRRIIERLNSKKGKNRLLDGDRLADRKIAELFSTKTHIG

SEQ ID NO: 1393 - protein, 1165 aa, Artificial Sequence
  derived and/or modified protein sequence (wt) from CCHVF(CCHVF Iran-52)__DQ446215.1__Gn-NSm-Gc
SEESGDDCISRTQLLRTETAEVHGDNYGGPGDKITICNGSTVVDQRLGSELGCYTINRVRSFKLCENSATGKSCEIDSIPVKCKQGYCLKITQEGRGHVKLSRGSEVVLDVCDSSCEVMIPKGTGDILVDCSGGQQHFLKDNLVDLGCPKIPLLGKMAIYICRMSNHPKTTMAFLFWFSFGYVITCILCKAIFFLLIIFGTLGKRFKQYRELKPQTCTICETTPVNAIDAEMHDLNCSYNICPYCASRLTSDGLARHVTQCPRRKEKVEETELYLNLERIPWVVRKLLQVSESTGTVLKRSSWLIVLLVLFTVSLSPVQSAPIGHGKTIETYRVREEYTSICLFVLGSILFIVSFLMKGLVDGVGNIFFPGLSVCKTCSIGSINGFEIESHKCYCSLFCCPYCRHCSADGEIHQLHLSICKKRKTGSNVMLAVCKRMCFRATMEVSNKALFIRSIINTTFVVCILILAVCVVSTSAVEMESLPAGTWEREEDLTNFCHQECQVTETECLCPYEALVLRRPLFLDSIVKGMKNLLNSTSLETSLSIEAPWGAINVQSTYKPTVSTANIALSWSSVEHRGNKVLVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGSVTITLSEPRNIQQKLPPEIITLHPKIEEGFFDLMHVQKVLSASTVCKLQSCTHGVPGDLQVYHIGNLLKGDRVNGHLIHKIEQHFNTSWMSWDGCDLDYYCNMGDWPSCTYTGVTQHNHASFVNLLNIETDYTKTFHFHSKRVTAHGDTPQLDLKARPTYGAGEITVLVEVADMELHTKKIEISGLKFAGLTCTGCYACSSGISCKVRIHVEEPDELTVHVKSDDPDVVAASSSLMARKLEFGTDSTFKAFSAMPKTSLCFYIVEREYCKSCSKEDTQKCVNTKLEQPQSILIEHKGTIIGKQNNTCTAKASCWLESVKSFFYGLKNMLGGIFGNVFIGIFTFLTPFILLILFFMFGWRILFCFKCCRRTRGLFKYRHLKDDEETGYRKIIERLNNKKGKNRLLDGERLADRKIAELFSTKTHIG

SEQ ID NO: 1394 - protein, 1165 aa, Artificial Sequence
  derived and/or modified protein sequence (wt) from CCHVF(CCHVF Iran-53)__DQ446216.1__Gn-NSm-Gc
SEESGDDCISRTQLLRTETAEVHGDNYGGPGDKITICNGSTVVDQRLGSELGCYTINRVRSFKLCENSATGKSCEIDSIPVKCKQGYCLKITQEGRGHVKLSRGSEVVLDVCDSSCEVMIPKGTGDILVDCSGGQQHFLKDNLVDLGCPKIPLLGKMAIYICRMSNHPKTTMAFLFWFSFGYVITCILCKAIFFLLIIFGTLGKRFKQYRELKPQTCTICETTPVNAIDAEMHDLNCSYNICPYCASRLTSDGLARHVTQCPRRKEKVEETELYLNLERIPWVVRKLLQVSESTGTVLKRSSWLIVLLVLFTVSLSPVQSAPIGHGKTIETYRVREEYTSICLFVLGSILFIVSFLMKGLVDGVGNIFFPGLSVCKTCSIGSINGFEIESHKCYCSLFCCPYCRHCSADGEIHQLHLSICKKRKTGSNVMLAVCKRMCFRATMEVSNKALFIRSIINTTFVVCILILAVCVVSTSAVEMESLPAGTWEREEDLTNFCHQECQVTETECLCPYEALVLRRPLFLDSIVKGMKNLLNSTSLETSLSIEAPWGAINVQSTYKPTVSTANIALSWSSVEHRGNKVLVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGSVTITLSEPRNIQQKLPPEIITLHPKIEEGFFDLMHVQKVLSASTVCKLQSCTHGVPGDLQVYHIGNLLKGDRVNGHLIHKIEQHFNTSWMSWDGCDLDYYCNMGDWPSCTYTGVTQHNHASFVNLLNIETDYTKTFHFHSKRVTAHGDTPQLDLKARPTYGAGEVTVLVEVADMELHTKKIEISGLKFAGLTCTGCYACSSGISCKVRIHVDEPDELTVHVKSDDPDVVAASSSLMARKLEFGTDSTFKAFSAMPKTSLCFYIVEREYCKSCSKEDTQKCVNTKLEQPQSILIEHKGTIIGKQNNTCTAKASCWLESVKSFFYGLKNMLGGIFGNVFIGIFTFLTPFILLILFFMFGWRILFCFKCCRRTRGLFKYRHLKDDEETGYRKIIERLNNKKGKNRLLDGERLADRKIAELFSTKTHIG

SEQ ID NO: 1395 - protein, 1165 aa, Artificial Sequence
  derived and/or modified protein sequence (wt) from CCHVF(CCHVF Kosova Hoti)__EU037902.1__Gn-NSm-Gc
SEEPGDDCISRTQLLRTETAEIHDDNYGGPGDKITICNGSTIVDQRLGSELGCYTINRVKSFKLCENSATGKTCEIDSTPVKCRQGFCLKITQKGRGHVKLSRGSEVVLDACDSNCEVMIPKGTGDILVDCSGGQQHFLKDNLIDLGCPHIPLLGKMAIYICRMSNHPKTTMAFLFWFSFGYVITCIFCKALFYSLIIIGTLGKKIKQYRELKPQTCTICETAPVNAIDAEMHDLNCSYNICPYCASRLTSDGLARHVKQCPKRKEKVEETELYLNLERIPWVVRKLLQVSESTGVALKRSSWLIVLLVLLTVSLSPVQSAPVGHGKTIETYQTREGFTSICLFMLGSILFIVSCLVKGLVDSVSDSFFPGLSVCKTCSIGSINGFEIESHKCYCSLFCCPYCRHCSADREIHQLHLNICKKRKTGSNVMLAVCKRMCFRATIEASRRALLIRSIINTTFVICILTLTICVVSTSAVEMENLPAGTWEREEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGISWDLGVEDASESKLLTVSIMDLSQMYSPVFEYLSGDRQVEEWPKATCTGDCPQRCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAAGTSLMARKLEFGTDSTFKAFSAMPKTSLCFYIVEKEYCKSCSEDDTKKCVDTKLEQPQSILIEHRGTIIGKQNDTCTAKASCWLESVKSFFYGLKNMLGSVFGNFFIGILLFLAPFVLLVLFFMFGWKILFCFKCCRRTRGLFKYRHLKDDEETGYRRIIERLNNKKGKNRLLDGERLADRKIAELFSTKTHIG

SEQ ID NO: 1396 - protein, 1165 aa, Artificial Sequence
  derived and/or modified protein sequence (wt) from CCHVF(CCHVF YL04057)__FJ562094.1__Gn-NSm-Gc
AEGGSSDCISRTQLVKTEVAEIHEDSYGGPGEKITICNGSTIVDQRLGRELGCYTINRVRSYKLCENSASGKSCEIDSIPVKCKQGFCLKITQEGRGHVKLSRGTEIVLDVCDSSCELMIPKGTGDILVDCSGGQQHFLQNNLIDLGCPNVPLLGKMAIYVCRMSNHPKTTMAFLFWFSFGYVITCIACRVLFYLLIAIGTVGKKLKQYRELKPQTCIVCESVPVNAIDAEMHELNCSYNICPYCASRLSTDGLIRHVTQCPKRREKVEETELFLNLERIPWLVRKLLQVSESTGMALKRSCWMITLLILLLVSISPVQSAPVGKERAIETYQARETYTGICLFVLGSVLFAVSWLTKALIDGIGNSFFPGLSVCKTCSIGSINGFEIESHKCYCSLFCCPYCRACSSDKNTHRMHLNVCKKRKMGSNVMLAVCKRMCFRATIEASNKALLIRSIINSTFVICILILTICVVSTSAVDMENLPAGIWEKEEDLTNFCHQECQVTETECLCPYEAMVLRKPLFLDSIAKGKKSLLNSTSLETSLSIEAPWGAINVQSTFKPTVSAANIALSWSSVEHRGNKILVSGRSESIMKLEERTGVSWNLGVEDASESKTLTVSVMDLSQMYSPVFEYLSGDRQVEEWPKATCTGDCPERCGCTSSTCLHKEWPHSRNWRCSPTWCWGVGTGCTCCGLDVKDFFTDYMLVKWKVEYIKTEAIVCVELTSQERQCSLIEAGTRFNLGPVTITLSEPRNVQQRLPPEIVTLHPKIEEGFFDLMHVQKILSASTVCKLQSCTHGVPGDFQVYHVGNLLRGDKVNGHSIHKIEPHFNTSWMSWDGCDLDYFCNMGDWPSCTYTGVTQHNRAAFINMLNIETDYTKTFHFHSKRVTAHGDTPQLDLKARPAYGAGEVTVLVEVADLELHTKKLEVSGLKIASLTCSGCYACSSGISCKVRIHVNEPDEFTVHVRSSDPDVVAAGSSLMARKIEFGADSTFKAFSSMPKDSLCFYIVEKDYCSSCTDDDTQKCVNTKLDHPQSILIEHKGTIIGKQNDTCSTKTSCWLESVKGFFYGLKNMLSGIFGNVFLGILLFLAPFVLLIFFFFFGWRLLFCLKCCRRTRGLLKYKHLKDEEEAGYKKIIERLNGKKGKSQLFDGERLADRKIAELFSTKIHIG

SEQ ID NO: 1397 - protein, 1165 aa, Artificial Sequence
  derived and/or modified protein sequence (wt) from CCHVF(CCHVF V42/81)__GU477490.1__Gn-NSm-Gc
SKEPGDDCISRTQLMRTETAEIHDDNYGGPGDKITICNGSTIVDQRLGSELGCYTINRVKSFKLCENSATGKACEVDSTPVKCRQGFCLKITQEGRGHVKLSRGSEVVLDACDSSCEVMIPKGTGDILVDCSGGQQHFLKDNLIDLECPHIPLLGKLAIYICRMSNHPRTTMAFLFWFGFGYVITCILCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVVLKRSSWLIVLLVLLTVSLSPVQSAPVGHGKTIETYQTREGFTSICLFMLGSILFIVSCIVKGLVDSVSDSFFPGLSVCKTCSISSINGFEIESHKCYCSLFCCPYCRHCSADREIHQLHLSICRKRRTGSNVMLAVCKRMCFRATIEVSRRALLIRSIINTTFVICILTLTICVVSTSAVEMENLPAGTWEREEDLTNFCHQECQVTETECLCPYEALVLRKPLFLDSIVKGKKNLLNSTSLETSLSIEAPWGAINIQSTFKPTVSAANIALSWSSVEHRGNKILVSGRSESIMKLEERTGVSWNLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFIDHMFVKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGETPQLDLKARPAYGAGEITVLVEVADMELHTKKVEISGLKFASLACTGCYACSSGISCKVRIHVDEPDELTVHVKSNDPDVVAASTSLMARKLESGTDSTFKAFSAMPKTSLCFYIVEREYCKSCSEDDTQKCVETKLEQPQSILIEHKGTIIGKQNDTCTAKASCWLESVKSFFYGLKNMLGSVFGNFFIGILLFLAPFVLLVLFFMFGWKILFCFKCCRRTRGLFKYRHLKEDEETGYRRIIERLNSKKGKNRLLDGERLADRKIAELFSTKTHIG

SEQ ID NO: 1398 - protein, 1165 aa, Artificial Sequence
  derived and/or modified protein sequence (wt) from CCHVF(CCHVF 79121M18)__GU477493.1__Gn-NSm-Gc
AEGGSSDCISRTQLVKTEVAEIHEDSYGGPGEKITICNGSTIVDQGLGSELGCYTINRVRSYKLCENSASGKSCEIDSIPVKCKQGFCLKITQEGRGHVKLSRGTEIVLDVCDSSCELMIPKGTGDILVDCSGGQQHFLQNNLIDLGCPNVPLLGKMAIYVCRMSNHPKTTMAFLFWFSFGYVITCIACRVLFYLLIAIGTVGKKLKQYRELKPQTCIVCESVPVNAIDAEMHELNCSYNICPYCASRLSTDGLIRHVTQCPKRREKVEETELFLNLERIPWLVRKLLQVSESTGMALKRSCWMITLLILLLVSISPVQSAPVGKERAIETYQARETYTGICLFVLGSVLFAVSWLTKALIDGIGNSFSPGLSVCKTCSIGSINGFEIESHKCYCSLFCCPYCRACSSDKNTHRMHLNVCKKRKMGSNVMLAVCKRMCFRATIEASNKALLIRSIINSTFVICILILTICVVSTSAVDMENLPAGIWEKEEDLTNFCHQECQVTETECLCPYEAMVLRKPLFLDSTAKGMKSLLNSTSLETSLSIEAPWGAINVQSTFKPTVSAANIALSWSSVEHRGNKILVSGRSESIMKLEERTGVSWNLGVEDASESKTLTVSVMDLSQMYSPVFEYLSGDRQVEEWPKATCTGDCPERCGCTSSTCLHKEWPHSRNWRCNPTWCWGVGTGCTCCGLDVKDFFTDYMLVKWKVEYIKTEAIVCVELTSQERQCSLIEAGTRFNLGPVTITLSEPRNVQQRLPPEIVTLHPKIEEGFFDLMHVQKILSASTVCKLQSCTHGVPGDFQIYHVGNLLRGDKVNGHSIHKIEPHFNTSWMSWDGCDLDYFCNMGDWPSCTYTGVTQHNRAAFINMLNIETDYTKTFHFHSKRVTAHGDTPQLDLKARPAYGAGEVTVLVEVADLELHTKKLEVSGLKIASLTCSGCYACSSGISCKVRIHVNEPDEFTVHVRSSDPDVVAAGSSLMARKIEFGADSTFKAFSSMPKDSLCFYIVEKDYCSSCTDDDTQKCVNTKLDHPQSILIEHKGTIIGKQNDTCSTKTSCWLESVKGFFYGLKNMLSGIFGNVFLGIFLFLAPFVLLIFFFFFGWRLLFCLKCCRRTRGLLKYKHLKDEEEAGYKKIIERLNGKKGKSQLFDGERLADRKIAELFSTKIHIG

SEQ ID NO: 1399 - protein, 1165 aa, Artificial Sequence
  derived and/or modified protein sequence (wt) from CCHVF(CCHVF Afg09-2990)__HM452306.1__Gn-NSm-Gc
SEESGDDCISRTQLLRTETAEVHGDNYGGPGDKITICNGSTVVDQRLGSELGCYTINRVRSFKLCENSATGKSCEIDSIPVKCKQGYCLKITQEGRGHVKLSRGSEVVLDVCDSSCEVMIPKGTGDILVDCSGGQQHYLKDNLVDLGCPKIPLLGKMAIYICRMSNHPKTTMAFLFWFSFGYVITCILCKAIFFLLIIFGTLGKRFKQYRELKPQTCTICETTPVNAIDAEMHDLNCSYNICPYCASRLTSDGLARHVTQCPRRKEKVEETELYLNLERIPWVVRKLLQVSESTGTVLKRSSWLIVLLVLFTVSLSPVQSAPIGHGKTIETYRVREEYTSICLFVLGSILFIVSFLMKGLVDGVGNIFFPGLSVCKTCSIGSINGFEIESHKCYCSLFCCPYCRHCSADGEIHQLHLSICKKRKTGSNVMLAVCKRMCFRATMEVSNKALFIRSIINTTFVVCILILAVCVVSTSAVEMESLPAGTWEREEDLTNFCHQECQVTETECLCPYEALVLRRPLFLDSIVKGMKNLLNSTSLETSLSIEAPWGAINVQSTYKPTVSTANIALSWSSVEHRGNKVLVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGSVTITLSEPRNIQQKLPPEIITLHPKIEEGFFDLMHVQKVLSASTVCKLQSCTHGVPGDLQVYHIGNLLKGDRVNGHLIHKIEQHFNTSWMSWDGCDLDYYCNMGDWPSCTYTGVTQHNHASFVNLLNIETDYTKTFHFHSKRVTAHGDTPQLDLKARPTYGAGEITVLVEVADMELHTKKIEISGLKFAGLTCTGCYACSSGISCKVRIHVDEPDELTVHVKSDDPDVVAASSSLMARKLEFGTDSTFKAFSAMPKTSLCFYIVEREYCKSCSKEDTQKCVNTKLEQPQSILIEHKGTIIGKQNNTCTAKASCWLESVKSFFYGLKNMLGGIFGNVFIGIFTFLTPFILLILFFMFGWRILFCFKCCRRTRGLFKYRHLKDDEETGYRKIIERLNNKKGKNRLLDGERLADRKIAELFSTKTHIG

SEQ ID NO: 1400 - protein, 1165 aa, Artificial Sequence
  derived and/or modified protein sequence (wt) from CCHVF(CCHVF Sudan Al-Fulah 3-2008)__HQ378184.1__Gn-NSm-Gc
SEEPSDDCISRTQLLRTETAEIHGDNYGGPGDKITICNGSTIVDQRLGSELGCYTINRVKSFKLCENSATGKSCVIDSVPVKCRQGYCLRITQEGRGHVKLSRGSEVVLDACDTSCEIMIPKGTGDILVDCSGGQQHFLKDNLVDLGCPKIPLLGKMAIYICRMSNHPKTTMAFLFWFSFGYVITCILCKAIFYLLIIIGTLGKRFRQYRELKPQTCTICETTPVNAIDAEMHDLNCSYNICPYCASRLTSDGLARHVTQCPKRKEKVEETELYLNLERIPWVVRKLLQVSESTGVALKRSSWLIVLLVLFTVSLSPVQSAPIGHGKTIEAYRAREGYTSICLFVLGSILFIVSCLMKGLVDSVGNSFFPGLSICKTCSISSINGFEIESHKCYCSLFCCPYCRHCSADKEIHKLHLSICKKRKTGSNVMLAVCKRMCFRATMEVSNRALFIRSIINTTFVLCILILAVCVVSTSAVEMENLPAGTWEREEDLTNFCHQECQVTETECLCPYEALVLRRPLFLDSIVKGMKNLLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFVNLLNIETDYTKNFHFHSKRVTAHGDTPQLDLKARPTYGAGEITVLVEVADMELHTKKIEISGLKFASLTCTGCYACSSGISCKVRIHVDEPDELTVHVKSDDPDVVAASSSLMARKLEFGTDSTFKAFSAMPKTSLCFYIVEKEYCKSCSEEDTKKCVNTKLEQPQSILIEHKGTIIGKQNSTCTAKVSCWLESAKSFFYGLKDMLSGIFGNVFIGIFLFLAPFVLLVLFFMFGWRILLCFRCCRRTRGLFKYRHLKDDEETGYRRIIERLNNKKGKNKLLDGERLADRKIAELFSTKTHIG

SEQ ID NO: 1401 - protein, 1165 aa, Artificial Sequence
  derived and/or modified protein sequence (wt) from CCHVF(CCHVF Sudan AB1-2009)__HQ378187.1__Gn-NSm-Gc
SEEPSDDCISRTQLLRTETAEIHGDNYGGPGDKITICNGSTIVDQRLGSELGCYTINRVKSFKLCENSATGKNCEIDSVPVKCRQGYCLRITQEGRGHVKLSRGSEVVLDACDTSCEIMIPKGTGDILVDCSGGQQHFLKDNLIDLGCPKIPLLGKMAIYICRMSNHPKTTMAFLFWFSFGYLITCILCKAIFYLLIIIGTLGKRLKQYRELKPQTCTICETTPVNAIDAEMHDLNCSYNICPYCASRLTSDGLARHVIQCPKRKEKVEETELYLNLERIPWVVRKLLQVSESTGVALKRSSWLIVLLVLFTVSLSPVQSAPIGQGKTIEAYRAREGYTSICLFVLGSILFIVSCLMKGLVDSVGNSFFPGLSICKTCSISSINGFEIESHKCYCSLFCCPYCRHCSTDKEIHKLHLSICKKRKTGSNVMLAVCKRMCFRATMEVSNRALFIRSIINTTFVLCILILAVCVVSTSAVEMENLPAGTWEREEDLTNFCHQECQVTETECLCPYEALVLRKPLFLDSIAKGMKNLLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFVNLLNIETDYTKNFHFHSKRVTAHGDTPQLDLKARPTYGAGEITVLVEVADMELHTKKIEISGLKFASLTCTGCYACSSGISCKVRIHVDEPDELTVHVKSDDPDVVAASSSLMARKLEFGTDSTFKAFSAMPKTSLCFYIVEREHCKSCNEEDTKKCVNTKLEQPQSILIEHKGTIIGKQNSTCTARASCWLESVKSFFYGLKNMLSGIFGNVFMGIFLFLAPFILLILFFMFGWRILFCFKCCRRTRGLFKYRHLKDDEETGYRRIIERLNNKKGKNKLLDGERLADRRIAELFSTKTHIG

SEQ ID NO: 1402 - protein, 1165 aa, Artificial Sequence
  derived and/or modified protein sequence (wt) from CCHVF(CCHVF NIVA 118595)__JN572083.1__Gn-NSm-Gc
SEESGDDCISRTQLLRTETAEVHGDNYGGPGDKITICNGSTVVDQRLGSELGCYTINRVKSFKLCENSATGKSCEIDSIPVKCRQGYCLKITQEGRGHVKLSRGSEVVLDACDSSCEVMIPKGTGDILVDCSGGQQHFLKDNLIDLGCPKIPLLGKMAIYICRMSNHPKTTMAFLFWFSFGYVITCILCKVIFYLLIIFGTLGKRFKQYRELKPQTCTICETTPVNAIDAEMHDLNCSYNICPYCASRLTSDGLARHVTQCPKRKEKVEETELYLNLERIPWVVRKLLQVSESTGIALKRSSWLIVLLVLFTVSITPVQSAPIGHGKTIEAYRAREEYTSICLFVLGSVLFVVSCLMKGLVDSVGNIFFPGLFICKTCSIGSINGFEIESHKCYCSLFCCPYCRHCSADREIHQLHLSICKKRKTGSNVMLAVCKRMCFRTTMEVSNKALFVRSIINTTFVVCILILAVCVVSTSAVEMESLPAGTWEREEDLTNFCHQECQVTETECLCPYEALVLRRPLFLDSIVKGMKNLLNSTSLETSLSIEAPWGAINVQSTYKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGSVTITLSEPRNIQQKLPPEIITLHPRIEEGFFDLMHVQKVLSASTVCKLQSCTHGVPGDLQVYHIGNLLKGDRVNGHLIHKIEQHLNTSWMSWDGCDLDYYCNMGDWPSCTYTGVTQHNHASFVNLLNIETDYTKTFHFHSKRVTAHGDTPQLDLKARPTYGAGEITVLVEVADMELHTKKIEISGLKFASLSCTGCYACSSGISCKVRIHVDEPDELTVHVKSDDPDVVAASSSLMARKLESGTDSTFKAFSAMPKTSLCFYIVEREYCKGCSKEDTQKCVNTKLEQPQSILIEHKGTIIGKQNNTCTAKASCWLESVKSFFYGLKNMLSGIFGNVFLGIFSFLAPFVLLILFFMFGWRILFCFKCCRRTRGLFKYRHLKDDEETGYRKIIERLNNKKGKNKLLDGERLADRKIAELFSTKTHIG

SEQ ID NO: 1403 - protein, 1165 aa, Artificial Sequence
  derived and/or modified protein sequence (wt) from CCHVF(CCHVF NIV 112143)__JN572085.1__Gn-NSm-Gc
SEESGDDCISRTQLLRTETAEVHGDNYGGPGDKITICNGSTVVDQRLGSELGCYTINRVKSFKLCENSATGKSCEIDSIPVKCRQGYCLKITQEGRGHVKLSRGSEVVLDACDSSCEVMIPKGTGDILVDCSGGQQHFLKDNLIDLGCPKIPLLGKMAIYICRMSNHPKTTMAFLFWFSFGYVITCILCKVIFYLLIIFGTLGKRFKQYRELKPQTCTICETTPVNAIDAEMHDLNCSYNICPYCASRLTSDGLARHVTQCPKRKEKVEETELYLNLERIPWVVRKLLQVSESTGIALKRSSWLIVLLVLFTVSITPVQSAPIGHGKTIEAYRAREEYTSICLFVLGSVLFVVSCLMKGLVDSVGNIFFPGLFICKTCSIGSINGFEIESHKCYCSLFCCPYCRHCSADREIHQLHLSICKKRKTGSNVMLAVCKRMCFRATMEVSNKALFVRSIINTTFVVCILILAICVVSTSAVEMESLPAGTWEREEDLTNFCHQECQVTETECLCPYEALVLRRPLFLDSIVKGMKNLLNSTSLETSLSIEAPWGAINVQSTYKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGSVTITLSEPRNIQQKLPPEIITLHPRIEEGFFDLMHVQKVLSASTVCKLQSCTHGVPGDLQVYHIGNLLKGDRVNGHLIHKIEQHLNTSWMSWDGCDLDYYCNMGDWPSCTYTGVTQHNHASFVNLLNIETDYTKTFHFHSKRVTAHGDTPQLDLKARPTYGAGEITVLVEVADMELHTKKIEISGLKFASLSCTGCYACSSGISCKVRIHVDEPDELTVHVKSDDPDVVAASSSLMARKLEFGTDSTFKAFSAMPKTSLCFYIVEREYCKGCSKEDTQKCVNTKLEQPQSILIEHKGTIIGKQNNTCTAKASCWLESVKSFFYGLKNMLSGIFGNVFLGIFSFLAPFVLLILFFMFGWRILFCFKCCRRTRGLFKYRHLKDDEETGYRKIIERLNNKKGKNKLLDGERLADRKIAELFSTKTHIG

SEQ ID NO: 1404 - protein, 1165 aa, Artificial Sequence
  derived and/or modified protein sequence (wt) from CCHVF(CCHVF SCT ex Afghanistan)__KC344856.1__Gn-NSm-Gc
SEESGDDCISRTQLLRTETAEVHNDNYGGPGDKITICNGSTIVDQRLGSELGCYTINRVKSFKLCENSATGKSCKIDSTPVKCRQGFCLKITQEGRGHVKLSRGSEVVLDACDSSCEIMIPKGTGDILVDCSGGQQHFLKDNLIDLGCPNIPLLGKMAIYICRMSNHPKTTMAFLFWFSFGYVITCIFCKVIFYLLIVVGTLGKKFKQYRELKPQTCTICETTPTNAIDAEMHDLNCSYNICPYCASRLTSDGLARHVTQCPKRKEKVEETELYLNLERIPWIVRKLLQVSESTGVALKRSSWLIVLLVLLTVSLSPVQSAPIGHGKTIETYQTREGYISVCLFVLGGILFVVSCLIKGLVDSVGNSFFPGLSICKTCSIGSVNGFEIESHKCYCSLLCCPYCRHCSTDREIHQLHLSICKKRRTGGNVMLAVCKRMCFRATMEVSNKVLFIRNIINTTFVICILILAVCVVSTSAVEMESLPAGTWEREEDLTNFCHQECQVTETECLCPYEALVLRKPLFLNSIVKGMKNLLNSTNLETSLSIEAPWGAINVQSTFKPTVSTANIALSWSSVEHRGNKILVSGRSESIMKLEERTGISWDLGVEDASESKSLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKLNGHMIHKIEPHFNTSWMSWDGCDLDYYCNMGDWPSCTYTGVTQHNHAAFVNLLNIETDYTKNFHFHSKRVTAHGDTPQLDLKARPTYGAGEITVLVEVADMELHTKKIDISGLKFASLTCAGCYACSSGISCKVRIHVDEPDELTVHVKSEDPDIVAASTSLIARKLELGTDSTFKAFSAMPKTSLCFYIVEREYCKSCSKEDTQKCVNTKLEHPQGILIEHKGTIIGKQNDTCTAKAGCWLESVKSFFYGLKNMLSGIFGNVFIGIFLFLAPFVLLILFFMFGWRLLFCFKCCRRTRGLFKYRHLKEDEESGYRRIIERLNNKKGKNKLLDGERLADRRIAELFSTKTHIG

SEQ ID NO: 1405 - protein, 1165 aa, Artificial Sequence
  derived and/or modified protein sequence (wt) from CCHVF(CCHVF Zahedan 2007)__KC867273.1__Gn-NSm-Gc
SEESGDDCISRTQLLRTETAEVHGDNYGGPGDKITICNGSTVVDQRLGSELGCYTINRVRSFKLCENSATGKSCEIDSIPVKCKQGFCLKITQEGRGHVKLSRGSEVVLDVCDSSCEVMIPKGTGDILVDCSGGQQHFLKDNLVDLGCPKIPLLGKMAIYICRMSNHPKTTMAFLFWFSFGYVITCILCKAIFFLLIIFGTLGKRFKQYRELKPQTCTICETTPVNAIDAEMHDLNCSYNICPYCASRLTSDGLARHVTQCPRRKEKVEETELYLNLERIPWVVRKLLQVSESTGTVLKRSSWLIVLLVLFTVSLSPVQSAPIGHGKTIETYRVREEYTSICLFVLGSILFIVSFLMKGLVDGVGNIFFPGLSVCKTCSIGSINGFEIESHRCYCSLFCCPYCRHCSADGEIHQLHLSICKKRKTGSNVMLAVCKRMCFRATMEVSNKVLFIRSIINTTFVVCILILAVCVVSTSAVEMESLPAGTWEREEDLTNFCHQECQVTETECLCPYEALVLRRPLFLDSIVKDMKNLLNSTSLETSLSIEAPWGAINVQSTYKPTVSTANIALSWSSVEHRGNKVLVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGSVTITLSEPRNIQQKLPPEIITLHPKIEEGFFDLMHVQKVLSASTVCKLQSCTHGVPGDLQVYHIGNLLKGDRVNGHLIHKIEQHFNTSWMSWDGCDLDYYCNMGDWPSCTYTGVTQHNHASFVNLLNIETDYTKTFHFHSKRVTAHGDTPQLDLKARPTYGAGEITVLVEVADMELHTKKIEISGLKFAGLTCTGCYACSSGISCKVRIHVDEPDELTVHVKSDDPDVVAASSSLMARKLEFGTDSTFKAFSAMPKTSLCFYIVEREYCKSCSKEDTQKCVNTKLEQPQSILIEHKGTIIGKQNNTCTAKASCWLESVKSFFYGLKNMLGGIFGNVFIGIFTFLTPFILLIFFFMFGWRILFCFKCCRRTRGLFKYRHLKDDEETGYRKIIERLNNKKGKNRLLDGERLADRKIAELFSTKTHIG

SEQ ID NO: 1406 - protein, 1165 aa, Artificial Sequence
  derived and/or modified protein sequence (wt) from CCHVF(CCHVF SPU 44/08)__KJ682805.1__Gn-NSm-Gc
SEESNDDCLSRTQLLRTENAEIHSDNYGGPGDKITICNGSTIVDQRLGSELGCYTINRVKSFKLCENSATGKSCEIDSTPVRCRQGFCLKITQEGRGHVKLSRGSEVVLDACDSSCEIMIPKGTGDILVDCSGGQQHFLKDNLVDLGCPNIPLLGKMAIYICRMSNHPKTTMAFLFWFSFGYVITCILCKAIFYLLIVVGTLGKKFKQYRELKPQTCTICETNPVNAIDAEMHDLNCSYNICPYCASRLTSDGLARHVMQCPKRKEKIEETELYLNLERIPWVVRKLLQVSESTGVALKRSSWLVILLVLLTVSLSPVQSAPISHGETVEVYQTREGYTSICLFVLGSILFLVSCLMRGLVDSVSNSFFPGLSICKTCSIGSINGFEIESHKCYCSLFCCPYCRHCSADIEIHKLHLSICKKRKTGSNVMLAVCKRMCFRATVEVSNKALLIRNIINTTFVVCILILAVCVVSTSAVEMENLPAGTWEKEEDLTNFCHQECQVTETECLCPYEALVLRKPLFLDSIVKGMKNLLNSTSLETSLSIEAPWGAINVQSTFKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVDYIKTEAIVCVELTSQERQCSLIEAGTRFNLGPVTITLSEPRNIQQKLPPEIVTLHPRIEEGFFDLMHIQKVLSASTVCKLQSCTHGVPGDLQIYHIGNLLKGDKVNGHLIHKIEPHFNTSWMSWDGCDLDYYCNMGDWPSCSYTGVTQHNHAAFVNMLNIETDYTKNFHFHSKRVTAHGDTPQLDLKARPTYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSKEDTQKCVNTKLEQPQSILIEHKGTIIGKQNDTCTAKASCWLESIKSFFYGLKNMLSGIFGNVFIGIFLFLAPFIMLILFFMFGWRILFCFKCCRRTRGLFKYRHLKDDEEIGYRKIIERLNNKKGKNKLLDGERLADRKIAELFSTKTHIG

SEQ ID NO: 1407 - protein, 1165 aa, Artificial Sequence
  derived and/or modified protein sequence (wt) from CCHVF(CCHVF SPU 383/87)__KJ682806.1__Gn-NSm-Gc
SEESNDDCLSRTQLLRTENAEIHSDNYGGPGDKITICNGSTIVDQRLGSELGCYTINRVKSFKLCENSATGKSCEIDSTPVRCRQGFCLKITQEGRGHVKLSRGSEVVLDACDSSCEIMIPKGTGDILVDCSGGQQHFLKDNLVDLGCPNIPLLGKMAIYICRMSNHPKTTMAFLFWFSFGYVITCILCKVIFYLLVVVGTLGKKFKQYRELKPQTCTICETNPVNAIDAEMHDLNCSYNICPYCASRLTSDGLARHVIQCPKRKEKIEETELYLNLERIPWVVRKLLQVSESTGVALKRSSWLVILLVLLTVSLSPVQSAPISHGETVEVYQTREGYTSICLFVLGSILFLVSCLMKGLVDSVGNSFFPGLSICKTCSIGSINGFEIESHKCYCSLFCCPYCRHCSADIEIHRLHLSICKKRKTGSNVMLAVCKRMCFRATVEVSNKALLIRNIINTTFVVCILILAVCVVSTSAVEMENLPAGTWEKEEDLTNFCHQECQVTETECLCPYEALVLRKPLFLDSIVKGMKNLLNSTSLETSLSIEAPWGAINVQSTFKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVDYIKTEAIVCVELTSQERQCSLIEAGTRFNLGPVTITLSEPRNIQQKLPPEIVTLHPRIEEGFFDLMHIQKVLSASTVCKLQSCTHGVPGDLQIYHIGNLLKGDKVNGHLIHKIEPHFNTSWMSWDGCDLDYYCNMGDWPSCSYTGVTQHNHAAFVNMLNIETDYTKNFHFHSKRVTAHGDTPQLDLKARPTYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSKEDTQKCVNTKLEQPQSILIEHKGTIFGKQNDTCTAKASCWLESVKSFFYGLKNMLSGIFGNVFIGVFLFLAPFIMLILFFMFGWRILFCFKCCRRTRGLFKYRHLKDDEEIGYRKIIERLNNKKGKNKLLDGERLADRKIAELFSTKTHIG

SEQ ID NO: 1408 - protein, 1165 aa, Artificial Sequence
  derived and/or modified protein sequence (wt) from CCHVF(CCHVF SPU 130/89)__KJ682807.1__Gn-NSm-Gc
SEEPNYDCLSRTQLLRTENAEIHSDNYGGPGDKITICNGSTIVDQRLGSELGCYTINRVKSFKLCENSATGKSCEIDSTPVRCRQGFCLKITQEGRGHVKLSRGSEVVLDACDSSCEIMIPKGTGDILVDCSGGQQHFLKDNLVDLGCPNIPLLGKMAIYICRMSNHPKTTMAFLFWFSFGYVITCILCKVIFYLLIVVGTLGKKFKQYRELKPQTCTICETNPVNAIDAEMHDLNCSYNICPYCASRLTSDGLARHVMQCPKRKEKIEETELYLNLERIPWVVRKLLQVSESTGVALKRSSWLVVLLVLLTVSLSPVQSAPISHGETVEVYQTREGYTSICLFVLGSILFLVSCLMKGLVDSVGNSFFPGLSICKTCSIGSINGFEIESHKCYCSLFCCPYCRHCSADIEIHKLHLSICKKRKTGSNVMLAVCKRMCFRATVEVSNKALLIRNIINTTFVVCILILAVCVVSTSAVEMENLPAGTWEKEEDLTNFCHQECQVTETECLCPYEALVLRKPLSLDSIVKGMKNLLNSTSLETSLSIEAPWGAINVQSTFKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVDYIKTEAIVCVELTSQERQCSLIEAGTRFNLGPVTITLSEPRNIQQKLPPEIVTLHPRIEEGFFDLMHIQKVLSASTVCKLQSCTHGVPGDLQIYHIGNLLKGDKVNGHLIHKIEPHFNTSWMSWDGCDLDYYCNMGDWPSCSYTGVTQHNHAAFVNMLNIETDYTKNFHFHSKRVTAHGDTPQLDLKARPTYGAGEITVLVEVADMELHTKKVEISGLKFASLTCTGCYACSSGISCKVRIHVDEPDELTVHVKSEDPDIVAASSSLMARKLEFGTDSTFKAFSAMPKTSLCFYIVEREHCKSCSKEDTQRCVNTKLEQPQSILIEHKGTIIGKQNDTCTAKASCWLESIKSFFYGLKNMLSGIFGNVFIGVFLFLAPFIILILFFMFGWRILFCFKCCRRTRGLLKYRHLKDDEEIGYRKIIERLNNKKGKNKLLDGERLADRKIAELFSTKTHIG

SEQ ID NO: 1409 - protein, 1165 aa, Artificial Sequence
  derived and/or modified protein sequence (wt) from CCHVF(CCHVF SPU 497/88)__KJ682808.1__Gn-NSm-Gc
SEESNDDCLSRTQLLRTENAEIHSDNYGGPGDKITICNGSTIVDQRLGSELGCYTINRVKSFKLCENSATGKSCEIDSTPVRCRQGFCLKITQEGKGHVKLSRGSEVVLDACDSSCEIMIPKGTGDILVDCSGGQQHFLKDNLVDLGCPNIPLLGKMAIYICRMSNHPKTTMVFLFWFSFGYVITCILCKVIFYLLIVVGTLGKKFKQYRELKPQTCTICETNPVNAIDAEMHDLNCSYNICPYCASRLTSDGLARHVMQCPKRKEKIEETELYLNLERIPWVVRKLLQVSESTGVALKRSSWLVILLVLLTVSLSPVQSAPISHGETVEVYQTREGYTSICLFVLGGILFLVSCLMKGLVDSVGNSFFPGLSICKTCSIGSINGFEIESHKCYCSLFCCPYCRHCSADIEIHKLHLSICKKRKTWSNVMLAVCKRMCFRATVEVSNKALLIRNIINTTFVVCILILAICVVSTSAVEMENLPAGTWEKEEDLTNFCHQECQVTETECLCPYEALVLRKPLFLDSIVKGMRNLLNSTSLETSLSIEAPWGAINVQSTFKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVDYIKTEAIVCVELTSQERQCSLIEAGTRFNLGPVTITLSEPRNIQQKLPPEIVTLHPRIEEGFFDLMHIQKVLSASTVCKLQSCTHGVPGDLQIYHIGNLLKGDKVNGHLIHKIEPHFNTSWMSWDGCDLDYYCNMGDWPSCSYTGVTQHNHAAFVNMLNIETDYTKNFHFHSKRVTAHGDTPQLDLKARPTYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSKEDTQKCVNTKLEQPQSILIEHKGTIIGKQNDTCTARASCWLESIKSFFYGLKNMLSGIFGNVFIGIFLFFAPFIMLILFFMFGWRILFCFKCCRRTRGLFKYRHLKDDEEVGYRKIIERLNNKKGKNKLLDGERLADRKIAELFSTKTHIG

SEQ ID NO: 1410 - protein, 1165 aa, Artificial Sequence
  derived and/or modified protein sequence (wt) from CCHVF(CCHVF SPU 18/88)__KJ682810.1__Gn-NSm-Gc
SEESNDDCLSRTQLLRTENAEIHSDNYGGPGDKITICNGSTIVDQRLGSELGCYTINRVKSFKLCENSATGKSCEIDSTPVRCRQGFCLKITQEGRGHVKLSRGSEVVLDACDSSCEIMIPKGTGDILVDCSGGQQHFLKDNLVDLGCPNIPLLGKMAIYICRMSNHPKTTMGFLFWFSFGYVITCILCKVIFYLLIVVGTLGKKFKQYRELKPQTCTICETNPVNAIDAEMHDLNCSYNICPYCASRLTSDGLARHVMQCPKRKEKIEETELYLNLERIPWVVRKLLQVSESTGVALKRSSWLVILLVLLTVSLSPVQSAPISHGETVEVYQTREGYTSICLFVLGSILFLVSCLMKGLVDSVGNSFSPGLSICKTCSIGSINGFEIESHKCYCSLFCCPYCRHCSADIEIHKLHLSICKKRKTGSNVMLAVCKRMCFRATVEVSNKALLIRNIINTTFVVCILILAVCVVSTSAVEMENLPAGTWEKEEDLTNFCHQECQVTETECLCPYEALVLRKPLFLDSIVKGKKNLLNSTSLETSLSIEAPWGAINVQSTFKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVDYIKTEAIVCVELTSQERQCSLIEAGTRFNLGPVTITLSEPRNIQQKLPPEIVTLHPRIEEGFFDLMHIQKVLSASTVCKLQSCTHGVPGDLQIYHIGNLLKGDKVNGHLIHKIEPHFNTSWMSWDGCDLDYYCNMGDWPSCSYTGVTQHNHAAFVNMLNIETDYTKNFHFHSKRVTAHGDTPQLDLKARPTYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSKEDTQKCVNTKLEQPQSILIEHKGTIIGKQNDTCTGKAGCWLESIKSFFYGLKNMLSGIFGNVFIGIFLFLAPFIMLILFFMFGWRILFCFKCCRRTRGLFKYRHLKDDEEIGYRKIIERLKNKKGKNKLLDGERLADRKIAELFSTKTHIG

SEQ ID NO: 1411 - protein, 1165 aa, Artificial Sequence
  derived and/or modified protein sequence (wt) from CCHVF(CCHVF SPU 556/87)__KJ682811.1__Gn-NSm-Gc
SEESDGDCISRTQLLRTETAEIHSDNYGGPGDKITICNGSTIVDQRLGSELGCYTINRVKSFKLCENSATGKSCEIDSTPVKCRQGFCLKITQEGRGHVKLSRGSEIVLDACDSSCEIMIPKGTGDILVDCSGGQQHFLKDNLIDLGCPNIPLLGRMAIYICRMSNHPKTTMAFLFWFSFGYVITCILCKVIFYLLIVAGTVGKKFKQYRELRPQTCTICETTPVNAIDAEMHDLNCSYNICPYCASRLTSDGLARHVMQCPKRKEKIEETELYLNLERIPWVVRKLLQVSESTGVALKRSSWLTVLLVLLIVSLSPVQSAPIGHGKTIETYQAREGYTSFCLFILGSILFIVSCLVKGLIDSVGNSFFPGLSICKTCSIGSVNGFEIESHKCYCSLFCCPYCRHCSADREIHKLHLSICKKRKTGSNVMSAVCKRMCFRATIEVSNRALLIRSIINTTFAVCILTLAVCVVSTSAVEMESLPAGTWEREEDLTNFCHQECQVTETECLCPYEALVLRKPLFLDSIVKGKKNLLNSTSLETSLSIEAPWGAINVQSTFKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHAAFVNLLNIETDYTKNFHFHSKRVTAHGDTPQLDLKARPTYGAGEVTVLVEVADMELHTKKIEISGLKFASLSCTGCYACSSGISCKVRIHVDEPDELTVHVKSEDPDIVAAGSSLMARKLEFGADSTFKAFSAMPKTSLCFYIVEREYCKSCSREDTQKCVNTKLERPQSILIEHKGTIIGKQNDTCTAKASCWLESVKSFFYGLKSMLSGIFGNVFIGIFLFIAPFVLLILFFMFGWRILFCFKCCRRTRGLFKYRHLKDDEETGYRKIIERLNNKKGKNKLLDGERLADRKIAELFSTKSHIG

SEQ ID NO: 1412 - protein, 1165 aa, Artificial Sequence
  derived and/or modified protein sequence (wt) from CCHVF(CCHVF SPU 431/85)__KJ682812.1__Gn-NSm-Gc
SEESDGDCISRTQLLRTETTEIHSDNYGGPGDKITICNGSTIVDQRLGSELGCYTINRVKSFKLCENSATGKSCEIDSTPVKCRQGFCLKITQEGRGHVKLSRGSEIVLDACDSNCEIMIPKGTGDILVDCSGGQQHFLKDNLIDLGCPNIPLLGKMAIYICRMSNHPKTTMAFLFWFSFGYVITCILCKVIFYLLIVAGTVGKKFKQYRELRPQTCTICETIPVNAIDAEMHDLNCSYNICPYCASRLTSDGLARHVMQCPKRKEKVEETELYLNLERIPWVVRKLLQVSESTGVALKRSSWLTVLLVLLIVSLSPVQSAPIGHGKTIETYQAREGYTSFCLFILGSILFVVSCLVKGLIDSVGNSFFPGLSICKTCSIGSINGFEIESHKCYCSLFCCPYCRHCPADREIHKLHLSICKKRKTGSNVMLAVCKRMCFRATIEVSNRALLIRNIINTTFVVCILTLAVCVVSTSAVEMESLPAGTWEKEEDLTNFCHQECQVTETECLCPYEALVLRKPLFLDSIVKGRKNLLNSTSLETSLSIEAPWGAINVQSTFKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQRVLSASTVCKLQSCTHGVPGDLQVYHIGNLLKGDKVNGHLIHKIEPHFNTSWMSWDGCDLDYYCNMGDWPSCTYTGVTQHNHAAFVNLLNIETDYTKNFHFHSKRVTAHGDTPQLDLKARPTYGAGEVTVLVEVADMELHTKKIEISGLKFASLTCTGCYACSSGISCKVKIHVDEPDELTVHVKSEDPDIVAAGSSLMARKLEFGADSTFKAFSAMPKTSLCFYIVEREYCKSCSREDTRKCVNTKLDRPQSILIEHKGTIIGKQNNTCTAKASCWLESVKSFFYGLKNMLSGIFGNVFIGIFLFIAPFVLLILFFMFGWRILFCFKCCRRTRGLFKYRHLKDDEETGYRKIIERLNNKKGKNKLLDGERLADRKIAELFSTKSHIG

SEQ ID NO: 1413 - protein, 1165 aa, Artificial Sequence
  derived and/or modified protein sequence (wt) from CCHVF(CCHVF SPU 48/90)__KJ682813.1__Gn-NSm-Gc
SEEPSDDCISRTQLLRTETAEIHGDNYGGPGDKITICNGSTIVDQRLGSELGCYTINRVKSFKLCENSATGKSCVIDSVPVKCRQGYCLRITQEGRGHVKLSRGSEVVLDACDTSCEIMIPKGTGDILVDCSGGQQHFLKDNLIDLGCPKIPLLGKMAIYICRMSNHPTTTMAFLFWFSFGYVITCILCKAIFYLLIIIGTLGKRFRQYRELKPQTCTICETTPVNAIDAEMHDLNCSYNICPYCASRLTSDGLARHVTQCPKRKEKVEETELYLNLERIPWVVRKLLQVSESTGVALKRSSWLIVLLVLFTVSLSPVQSAPIGHGKTIEAYRAREGYTSICLFVLGSILFVVSCLMKRLVDSVGNSFFPGLSICKTCSISSINGFEIESHKCYCSLFCCPYCRHCSADKEIHKLHLSICKKRKTGSNVMLAVCKRMCFRATMEVSDRALFIRSIINTTFVLCILILAVCVVSTSAVEMENLPAGTWEREEDLTNFCHQECQVTETECLCPYEALVLRKPLFRDSIVKGMKNLLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNRASFVNLLNIETDYTKNFHFHSKRVTAHGDTPQLDLKARPTYGAGEITVLVEVADMELHTKKIEISGLKFASLTCTGCYACSSGISCKVRIHVDEPDELTVHVKSDDPDVVAASSSLMARKLEFGTDSTFKAFSAMPKTSLCFYIVEKEYCKSCSEEDTKKCVNTKLEQPQSILIEHKGTIIGKQNSTCTAKVSCWLESAKSFFYGLKDMLSGIFGNVFIGIFLFLAPFILLILFFMFGWRILLCFKCCRRTRGLFKYRHLKDDEETGYRRIIERLNNKKGKNKLLDGERLADRRIAELFSTKTHIG

SEQ ID NO: 1414 - protein, 1165 aa, Artificial Sequence
  derived and/or modified protein sequence (wt) from CCHVF(CCHVF SPU 187/90)__KJ682814.1__Gn-NSm-Gc
SEEPSDDCISRTQLLRTETAEIHGDNYGGPGDKITICNGSTIVDQRLGSELGCYTINRVKSFKLCENSATGKSCEIDSVPVKCRQGYCLRITQEGRGHVKLSRGSEVVLDACDTSCEIMIPKGTGDILVDCSGGQQHFLKDNLIDLGCPKIPLLGKMAIYICRMSNHPKTTMAFLFWFSFGYVITCILCKAIFYLLIIIGTLGKRFKQYRELKPQTCTICETTPVNAIDAEMHDLNCSYNICPYCASRLTSDGLARHVTQCPKRKEKVEETELYLNLERIPWVVRKLLQVSESTGVALKRSSWLIVLLVLFTVSLSPVQSAPIGHGKTIEAYRAREGYTSICLFVLGSILFVVSCLMKGLVDSVGNSFFPGLSICKTCSIGSINGFEIESHKCYCSLFCCPYCRHCSADKEIHKLHLSICKKRKTGSNVMLAVCKRMCFRATMEVSNRALFIRSIINTTFVLCILILAVCVVSTSAVEMENLPAGTWEREEDLTNFCHQECQVTETECLCPYEALVLRRPLFLDSIVKGMKNLLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFVNLLNIETDYTKNFHFHSKRVTAHGDTPQLDLKARPTYGAGEITVLVEVADMELHTKKIEISGLKFASLTCTGCYACSSGISCKVRIHVDEPDELTVHVKSDDPDVVAASSSLMARKLEFGTDSIFKAFSAMPKTSLCFYIVEREHCKSCSEEDTKKCVNTKLEQPQSILIEHKGTIIGKQNSTCTAKTSCWLESVKSFFYGLKNMLSGIFGNVFIGIFLFLAPFILLILFFMFGWRILFCFKCCRRTRGLFKYRHLKDDEETGYRRIIERLNNKKGKNKLLDGERLADRRIAELFSTKTHIG

SEQ ID NO: 1415 - protein, 1165 aa, Artificial Sequence
  derived and/or modified protein sequence (wt) from CCHVF(CCHVF Haskovo-V46/13)__KR092379.1__Gn-NSm-Gc
SEELGDDCISRTQLLRTETAEIHDDNYGGPGDKITICNGSTIVDQRLGSELGCYTINRGKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETTPVNAIDAEMHDLNCSYNICPYCASRLTSDGLARHVTQCPKRKEKVEETELYLNLERIPWIVRKLLQVSESTGVALKRSSWLIVLLVLLPVSLSPVQSAPVGHGKTIETYQTREGFTSICLFMLGSILFIVSCLVKGLVDSVGDSFFPGLSVCKTCSIGSINGFEIESHKCYCSLFCCPYCRHCSADREIHQLHLSICKKRKTGSNVMLAVCKRMCFRATIEASRRALLIRSIINTTFAMCILTLTICVVSTSAVEMENLPAGTWEREEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLTCTGCYACSSGISCKVRIHVDEPDELTVHVKSSDPDVVAAGTSLMARKLEFGTDSTFKAFSAMPKTSLCFYIVEREYCKSCSEDDTQKCVDTKLEQPQSILIEHKGTIIGKQNDTCTARASCWLESVKSFFYGLKNMLGSVFGNFLIGILLFLAPFVLLVLFFMFGWKILFCFKCCRRTRGLFKYRHLKDDEETGYRRIIERLNSKKGKNRLLDGERLADRKIAELFSTKTHIG

SEQ ID NO: 1416 - protein, 1165 aa, Artificial Sequence
  derived and/or modified protein sequence (wt) from CCHVF(CCHVF 24-R-2012)__KR814856.1__Gn-NSm-Gc
SEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDTSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVGHGKTIETYQTREGFTSVCLFMLGSILFLVSCLVKGLVDSVSDSFFPGLSVCKTCSIGSINGFEIESHKCYCSLFCCPYCRHCSADREIHQLHLSICKKRKMGSNVMLAVCKRMCFRATIEASRRALLIRSIINTTFVICILTLTICVVSTSAVEMENLPSGTWEREEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSNDPDVVAASTSLMARKLEFGTDSTFKAFSAMPKTSLCFYIVEREYCKSCSEEDTQKCVDTKLEQPQSILIEHKGTIIGKQNDTCTAKASCWLESVKSFFYGLKNMLGSVFGNFFIGILLFLAPFVLLVLFFMFGWKILFCFKCCRRTRGLLKYRLLKDDEETGYRRIIERLNNKKGKNRLLDGERLADRKIAELFSTKTHIG

SEQ ID NO: 1417 - protein, 1165 aa, Artificial Sequence
  derived and/or modified protein sequence (wt) from CCHVF(CCHVF 36-ST-2014)__KR814857.1__Gn-NSm-Gc
SEEPGDDCISRTQLLKTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEIMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLTVSLSPVQSAPVGHGKTIETYQTREGFTNICLFMLGSILFIVSCLVKGLVDSVSDSFFPGLSVCKTCSIGSINGFEIESHKCYCSLFCCPYCRHCSADREIHQLHLGICKKRKTGSNVMLAVCKRMCFKATIEASRRALLIRSIINTTFVICILTLAICVVSTSAVEMENLPAGTWEREEDLTNFCHQECQVSETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRLNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEDDTKKCVDTKLDQPQSILIEHKGTIIGKQNDTCTAKASCWLESVKSFFYGLKNMLGSVFGNFFVGILLFLAPFVLLVLFFMCGWKFLFCFKCCRRTRGLFKYRHLKDDEETGYRRIIERLNSKKGKNRLLDGERLADRKIAELFSTKSHIG

SEQ ID NO: 1418 - protein, 1165 aa, Artificial Sequence
  derived and/or modified protein sequence (wt) from CCHVF(CCHVF 37-R-2013)__KR814858.1__Gn-NSm-Gc
SEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDTSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVGHGKTIETYQTREGFTSVCLFMLGSILFLVSCLVKGLVDSVSDSFFPGLSVCKTCSIGSINGFEIESHKCYCSLFCCPYCRHCSADREIHQLHLSICKKRKMGSNVMLAVCKRMCFRATIEASRRALLIRSIINTTFVICILTLTICVVSTSAVEMENLPSGTWEREEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVDDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSNDPDVVAASTSLMARKLEFGTDSTFKAFSAMPKTSLCFYIVEREYCKSCSEEDTQKCVDTKLEQPQSILIEHKGTIIGKQNVTCTAKASCWLESVKSFFYGLKNMLGSVFGNFFIGILLFLAPFVLLVLFFMFGWKILFCFKCCRRTRGLLKYRLLKDDEETGYRRIIERLNNKKGKNRLLDGERLADRKIAELFSTKTHIG

SEQ ID NO: 1419 - protein, 1165 aa, Artificial Sequence
  derived and/or modified protein sequence (wt) from CCHVF(CCHVF 44-ST-2010)__KR814859.1__Gn-NSm-Gc
SEEPGDDCISRTQLLKTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEIMIPKGTGDILVDCSGGQQHFLKDNLIDLGCPHIPLLGKMAIYICRMSNHPRTTMAFLLWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLTVSLSPVQSAPVGHGKTIETYQTREGFTNICLFMLGSILFIVSCLVKGLVDSVSDSFFPGLSVCKTCSFGSINGFEIESHKCYCSLFCCPYCRHCSADREIHQLHLGICKKRKTGSNVMLAVCKRMCFKATIEASRRALLIRSIINTTFVICILTLAICVVSTSAVEMENLPAGTWEREEDLTNFCHQECQVSETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRLNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEDDTKKCVDTKLDQPQSILIEHKGTIIGKQNDTCTAKASCWLESVKSFFYGLKNMLGSVFGNFFVGILLFLAPFVLLVLFFMCGWKILFCFKCCRRTRGLFKYRHLKDDEETGYRRIIERLNSKKGKNRLLDGERLADRKIAELFSTKSHIG

SEQ ID NO: 1420 - protein, 1165 aa, Artificial Sequence
  derived and/or modified protein sequence (wt) from CCHVF(CCHVF 46-ST-2012)__KR814860.1__Gn-NSm-Gc
SEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVGHGKTIETYQTREGFTSICLFMLGSILFLVSCLVKGLVDSVSDSFFPGLSVCKTCSIGSINGFEIESHKCYCSLFCCPYCRHCSADREIHQLHLSICKKRKTGSNVMLAVCKRMCFRATIEASRRALLIRSIINATFVICILTLTICVVSTSAVEMESLPAGTWEREEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRINGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEEDTQKCVDTRLEQPQSILIEHKGTIIGKQNDTCTAKASCWLESVKSFFYGLKNMLGSVFGNFFIGILLFLAPFVLLVLFFMFGWKILFCFKCCRRTRGLLKYRHLKDDEETGYRRIIERLNNKKGKNRLLDGERLADRKIAELFSTKTHIG

SEQ ID NO: 1421 - protein, 1165 aa, Artificial Sequence
  derived and/or modified protein sequence (wt) from CCHVF(CCHVF 47-ST-2013)__KR814861.1__Gn-NSm-Gc
SEEPGDDCISRTQLLKTETAEIHDDNYGGPGDKITICNGSTIVDQRLGSELGCYTINRVKSFKLCKNSATGKTCEIDSTPVKCRQGFCLKITQEGRGHVKLSRGSEVVLDACDSSCEIMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLTVSLSPVQSAPVGHGKTIETYQTREGFTSICLFMLGSILFIVSCLVKGLVDSVSDSFFPGLSVCRTCSIGSINGFEIESHKCYCSLFCCPYCRHCSADREIHQLHLSICKKRKTGSNVMLAVCKRMCFKATIEASRRALFIRSIINTTFVTCILTLAICVVSTSAVEMEDLPAGTWEREEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGECPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEVSGLKFASLACTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGNFFVGILLFLAPFVLLVLFFMFGWKILFCFKCCRRTRGLFKYRHLKDDEETGYRRIIERLNSKKGKNRLLDGERLADRKIAELFSTKTHIG

SEQ ID NO: 1422 - protein, 1165 aa, Artificial Sequence
  derived and/or modified protein sequence (wt) from CCHVF(CCHVF 52-R-2014)__KR814862.1__Gn-NSm-Gc
SEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDTSCEVMIPKGTGDILVDCSGGQQHFLKDNLIDLGCPHVPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVGHGKTIETYQTREGFTSVCLFMLGSILFLVSCLVKGLVDSVSDSFFPGLSVCKTCSIGSINGFEIESHKCYCSLFCCPYCRHCSADREIHQLHLSICKKRKMGSNVMLAVCKRMCFRATIEASRRALLIRSIINTTFVICILTLTICVVSTSAVEMENLPSGTWEREEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVDDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSNDPDVVAASTSLMARKLEFGTDSTFKAFSAMPKTSLCFYIVEREYCKSCSEEDTQKCVDTKLEQPQSILIEHKGTIIGKQNDTCTAKAGCWLESVKSFFYGLKNMLGSVFGNFFIGILLFLAPFVLLVLFFMFGWKILFCFKCCRRTRGLLKYRLLKDDEETGYRRIIERLNNKKGKNRLLDGERLADRKIAELFSTKTHIG

SEQ ID NO: 1423 - protein, 1165 aa, Artificial Sequence
  derived and/or modified protein sequence (wt) from CCHVF(CCHVF 75-R-2012)__KR814863.1__Gn-NSm-Gc
SEEPGDDCISRTQLLRTETAEIHDDNYGGPGDKITICNGSTIVDQRLGSELGCYTINRVKSFKLCENSATGKTCEIDSAPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVGHGKTIETYQTREGFTSICLFMLGSILFLVSCLVKGLVNSVSDSFFPGLSVCKTCSIGSINGFEIESHKCYCSLFCCPYCRHCSADREIHQLHLSICKKRKTGSNVMLAVCKRMCFRATIEASRRALLIRSIINTTFVICILTLTICVVSTSAVEMENLPSGTWEREEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEEDTQKCVDTKLEQPQSILIEHKGTIIGKQNDTCTAKASCWLESVKSFLYGLKNMLGSVFGNFFIGILLFLAPFVLLVLFFMFGWKILFCFKCCRRTRGLLKYRLLKDDEETGYRRIIERLNNKKGKNRLLDGERLADRKIAELFSTKTHIG

SEQ ID NO: 1424 - protein, 1165 aa, Artificial Sequence
  derived and/or modified protein sequence (wt) from CCHVF(CCHVF 75-ST-2010)__KR814864.1__Gn-NSm-Gc
SEESGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCLFCKALFYSLIIIGTLGKKIKQYRELRPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVGHGKTIETYQTREGFTSICLFMLGSILFLVSCLVKGLVDSVSDSFFPGLSVCKTCSIGSINGFEIESHKCYCSLLCCPYCRHCSADREIHQLHLSICKKRKTGSNVMLAVCKRMCFRATIEASRRALLIRSIINTTFVICILTLTICVVSTSAVEMENLPSGTWEKEEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEEDTQKCVDTKLEQPQSILIEHKGTIIGKQNDTCTAKASCWLESVKSFFYGLKNMLGSVFGNFFIGILLFLAPFVLLVLFFMFGWKILFCFKCCRRARGLLKYRHLKDDEETGYRKIIERLNNKKGKNRLLDGERLADRKIAELFSTKTHIG

SEQ ID NO: 1425 - protein, 1165 aa, Artificial Sequence
  derived and/or modified protein sequence (wt) from CCHVF(CCHVF 81-R-2014)__KR814865.1__Gn-NSm-Gc
SEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVGHGKTIETYQTREGFTSICLFMLGSILFLVSCLVKGLVDSVSDSFFPGLSVCKTCSIGSINGFEIESHKCYCSLFCCPYCRHCSADREIHQLHLSICKKRKTGSNVMLAVCKRMCFRATIEASRRALLIRSIINTTFVICILTLTICVVSTSAVEMENLPAGTWEREEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRINGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEEDTQKCVDTRLEQPQSILIEHKGTIIGKQNDTCTAKASCWLESVKSFFYGLKNMLGSVFGNFFIGILLFLAPFVLLVLFFMFGWKILFCFKCCRRTRGLLKYRHLKDDEETGYRRIIERLNNKKGKNRLLDGERLADRKIAELFSTKTHIG

SEQ ID NO: 1426 - protein, 1165 aa, Artificial Sequence
  derived and/or modified protein sequence (wt) from CCHVF(CCHVF 3756-ST-2007)__KR814866.1__Gn-NSm-Gc
SEEPGDDCISRTQLLKTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEIMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLTVSLSPVQSAPVGHGKTIETYQTREGFTSICLFMLGSILFIVSCLVKGLVDSVSDSFFPGLSVCKTCSIGSINGFEIESHKCYCSLFCCPYCRHCSADREIHQLHLSICKKRKTGSNVMLAVCKRMCFKATIEASRRALLIRSIINTTFVICILTLAICVVSTSAVEMEDLPAGTWEREEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLTCTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGSFFVGILLFLTPFVLLVLFFMFGWKILFCFKCCRRTRGLFKYRHLKDDEETGYRRIIERLNSKKGKNRLLDGERLADRKIAELFSTKTHIG

SEQ ID NO: 1427 - protein, 1165 aa, Artificial Sequence
  derived and/or modified protein sequence (wt) from CCHVF(CCHVF 3809-ST-2007)__KR814867.1__Gn-NSm-Gc
SEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVGHGKTIETYQTREGFTSICLFMLGSILFLVSCLVKGLVDSVSDSFFPGLSVCKTCSIGSVNGFEIESHKCYCSLFCCPYCRHCSADREIHQLHLSVCKKRKTGSNVMLAVCKRMCFRATIEASRRALLIRSIINTTFVICILTLTICVVSTSAVEMENLPAGTWEREEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEKEYCRSCSEEDTQKCVDTKLEQPQSILIEHKGTIIGKQNDTCTAKASCWLESVKSFFYGLKNMLGSVFGNFFIGILLFLTPFVLLVLFFMFGWKILFCFKCCRRTRGLLKYRHLKDDEETGYRRIIERLNNKKGKNRLLDGERLADRKIAELFSTKTHIG

SEQ ID NO: 1428 - protein, 1165 aa, Artificial Sequence
  derived and/or modified protein sequence (wt) from CCHVF(CCHVF 3820-ST-2007)__KR814868.1__Gn-NSm-Gc
SEEPGDDCISRTQLLKTETAEIHDDNYGSPGDKITICNGSTIVDQRLGSELGCYTINRVKSFKLCENSATGKTCEIDSTPVKCRQGFCLKITQEGRGHVKLSRGSEVVLDACDSSCEIMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLAVSLSPVQSAPVGHGKTIETYQTREGFTSICLFMLGSILFIVSCLVKGLVDSVSDSFFPGLSVCKTCSIGSINGFEIESHKCYCSLFCCPYCRHCSADREIHQLHLSICKKRKTGSNVMLAVCKRMCFKATIEASRRALLIRSIINTTFVMCILTLAICVVSTSAVEMEDLPAGTWEREEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLTCTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGSFFVGILLFLAPFVLLVLFFMFGWKILFCFKCCRRTRGLFKYRHLKDDEETGYRRIIERLNSKKGKNRLLDGERLADRKIAELFSTKTHIG

SEQ ID NO: 1429 - protein, 1165 aa, Artificial Sequence
  derived and/or modified protein sequence (wt) from CCHVF(CCHVF 4495-ST-2008)__KR814869.1__Gn-NSm-Gc
SEESGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCLFCKALFYSLIIIGTLGKKIKQYRELRPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVGHGKTIETYQTREGFTSICLFMLGSILFLVSCLVKGLVDSVSDSFFPGLSVCKTCSIGSINGFEIESHKCYCSLLCCPYCRHCSADREIHQLHLSICKKRKTGSNVMLAVCKRMCFRATIEASRRALLIRSIINTTFVICILTLTICVVSTSAVEMENLPSGTWEKEEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGISWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEEDTQRCVDTKLEQPQSILIEHKGTIIGKQNDTCTAKASCWLESVKSFFYGLKNMLGSVFGNFFIGILLFLAPFVLLVLFFMFGWKILFCFKCCRRARGLLKYRHLKDDEETGYRKIIERLNNKKGKNRLLDGERLADRKIAELFSTKTHIG

SEQ ID NO: 1430 - protein, 1165 aa, Artificial Sequence
  derived and/or modified protein sequence (wt) from CCHVF(CCHVF 4691-ST-2009)__KR814871.1__Gn-NSm-Gc
SEEPGDDCISRTQLLKTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEIMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLTVSLSPVQSAPVGHGKTIETYQAREGFTSICLFMLGSILFIVSCLVKGLVDSVSDSFFPGLSVCKTCSIGSINGFEIESHKCYCSLFCCPYCRHCSADREIHQLHLSICKKRRTGSNVMLAVCKRMCFKATIEASRRALLIRSIINTTFVICILTLAICVVSTSAVEMENLPAGTWEREEDLTNFCHQECQVTETECLCPYEALVLRKPLFLDSIVKGMKNLLNSTSLETSLSIEAPWGAINVQSTFKPAVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGNFFVGILLFLAPFVLLVLFFMFGWKILFCFKCCRRTRGLFKYRHLKDDEETGYRRIIERLNSKKGKNRLLDGERLADRKIAELFSTKTHIG

SEQ ID NO: 1431 - protein, 1165 aa, Artificial Sequence
  derived and/or modified protein sequence (wt) from CCHVF(CCHVF 4701-ST-2009)__KR814872.1__Gn-NSm-Gc
SEEPGDDCISRTQLLKTETAEIHDDNYGGPGDKITICNGSTVVDQRLGSELGCYTINRVKSFKLCENSATGKTCEIDSTPVKCRQGFCLKITQEGRGHVKLSRGSEVVLDACDSSCEIMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLTVSLSPVQSAPVGHGKTIETYQTREGFTSICLFMLGSILFIVSCLVKGLVDSVSDSFFPGLSVCKTCSIGSINGFEIESHKCYCSLFCCPYCRHCSADREIHQLHLSICKKRKTGSNVMLAVCKRMCFKATIEASRRALLIRSIINTTFVMCILTLAICVVSTSAVEMEDLPAGTWEREEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLTCTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGGFFVGILLFLAPFVLLVLFFMFGWKILFCFKCCRRTRGLFKYRHLKDDEETGYRRIIERLNSKKGKNRLLDGERLADRKIAELFSTKTHIG

SEQ ID NO: 1432 - protein, 1165 aa, Artificial Sequence
  derived and/or modified protein sequence (wt) from CCHVF(CCHVF 5170-R-2011)__KR814873.1__Gn-NSm-Gc
SEEPGDDCISRTQLLKTETAEIHDDNYGGPGDKITICNGSTIVDQRLGSELGCYTINRVKSFKLCENSATGKTCEIDSTPVKCRQGFCLKITQEGRGHVKLSRGSEVVLDVCDSSCEIMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSEGLARHVTQCPKRKEKVEETELYLNLERIPWIVRKLLQVSESTGVALKRSSWLIVLLVLLTVSLSPVQSAPVGHGKTIETYQTREGFTSICLFMLGSILFIVSCLVKGLVDSVSDSFFPGLSVCKTCSIGSINGFEIESHKCYCSLFCCPYCRHCSADREIHQLHLSICKKRKTGSNVMLAVCKRMCFKATIEASRRALLIRSIINTTFVICILTLAICVVSTSAVEMEDLPAGTWEREEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLTCTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGSFFVGILLFLAPFVLLVLFFMFGWKILFCFKCCRRTRGLFKYRHLKDDEETGYRRIIERLNSKKGKNRLLDGERLADRKIAELFSTKTHIG

SEQ ID NO: 1433 - protein, 1165 aa, Artificial Sequence
  derived and/or modified protein sequence (wt) from CCHVF(CCHVF Oman-199809166)__KR864901.1__Gn-NSm-Gc
SEESGEDCISRTQLLRTETAEIHGDNYGGPGDKITICNGSTIVDQRLGSELGCYTINRVKSFKLCENSATGKSCEIDNTPVKCKQGFCLKITQEGRGHVKLSRDSEVVLDACDSSCEIMIPKGTGDILVDCSGGQQHFLKDNLIDLGCPNIPLLGKMAIYICRMSNHPKTTMAFLFWFSFGYVITCILCKVIFYLLIVVGTLGKKFKQYRELKPQTCTICETTPVNAIDAEMHDLNCSYNICPYCASRLTSDGLARHVMQCPKRKEKIEETELYLNLERIPWVVRKLLQVSESTGVALKRSSWLIVLLVLLTVSLSPVQSAPIGHGKTIETYQTREGYTSICLFVLGSILFIVSHLMKGLVDSVGNSFFPGLSICKTCSIGSINGFEIESHKCYCSLFCCPYCRHCSADKEIHKLHLSICKKRKAGSNVMLAVCKRMCFRATMEVSNKALLIRSVINTTFVVCILILAVCVVSTSAVEMESLPAGTWEREEDLTNFCHQECQVTETECLCPYEALVLRKPLFLDSIAKGMKNLLNSTSLETSLSIEAPWGAINVQSTFKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIVTLHPRIEEGFFDLMHVQKVLSASTVCKLQSCTHGVPGDLQVYHIGNLLKGDKVNGHLIHKVEPHFNTSWMSWDGCDLDYYCNMGDWPSCTYTGVTQHNHAAFVNLLNIETDYTKNFHFHSKRVTAHGDTPQLDLKARPNYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSKEDTQKCVNAKLERPQSILIEHKGTIIGKQNDTCTAKASCWLESVKSFFYGLKNMLSGIFGNVFIGIFLFLAPFILLILFFMFGWRILFCFKCCRRTRGLFKYRHLKDDEETGYRKIIERLNNKKGKNKLLDGERLADRKIAELFSTKTHIG

SEQ ID NO: 1434 - protein, 1165 aa, Artificial Sequence
  derived and/or modified protein sequence (wt) from CCHVF(CCHVF 200406546-Turkey)__KR864902.1__Gn-NSm-Gc
SEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDVCDSSCEVMIPKGTGDILVDCSGGQQHFLKDNLIDLGCPHVPLLGRMAIYICRMSNHPRTTMAFLFWFSFGYVITCIFCKALFYSLIIIGTLGKKFKQYRELKPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVGHGKTIETYQTREGFTSICLFMLGSILFIVSCLVKGLVDSVSDSFFPGLSVCKTCSIGSINGFEIESHKCYCSLFCCPYCRHCSADREIHQLHLSICKKRKTGSNVMLAVCKRMCFRATIEASRRALLIRSIINTTFVICILTLTICVVSTSAVEMENLPAGTWEREEDLTNFCHQECQVTETECLCPYEALVLRKPLFLDSIVKGMKNLLNSTSLETSLSIEAPWGAINVQSTFKPTVSTANIALSWSSIEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLTARKLEFGTDSTFKAFSAMPKTSLCFYIVEKEYCKSCNEDDTQKCVDTKLEQPQSILIEHKGTIIGKQNDTCTAKASCWLESVKSFFYGLKNMLGSVFGNFFIGILLFLAPFVLLVLFFMFGWKILFCFKCCRRTRGLFKYRHLKDDEETGYKRIIERLNNKKGKNRLLDGERLADRKIAELFSTKTHIG

SEQ ID NO: 1435 - protein, 1165 aa, Artificial Sequence
  derived and/or modified protein sequence (wt) from CCHVF(CCHVF 1-CR/HU-2015)__KU161584.1__Gn-NSm-Gc
SEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLTVSLSPVQSAPVGHGKTIETYQTREGFTSICLFMLGSILFIVSCLVKGLVDSVSDSFFPGLSVCRTCSIGSINGFEIESHKCYCSLFCCPYCRHCSADREIHQLHLSICKKRKTGSNVMLAVCKRMCFRATMEASRRALLIRSIINTTFVICILTLTICVVSTSAVEMENLPAGTWEREEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGNFFIGILLFLAPFVLLVLFFMFGWKILFCFKCCRRTRGLFKYRHLKDDEETGYRRIIERLNNKKGKNRLLDGERLADRKIAELFSTKTHIG

SEQ ID NO: 1436 - protein, 1165 aa, Artificial Sequence
  derived and/or modified protein sequence (wt) from CCHVF(CCHVF 1231-CR/TI-2015)__KU161585.1__Gn-NSm-Gc
SEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLTVSLSPVQSAPVGHGKTIETYQTREGFTSICLFMLGSILFIVSCLVKGLVESVSDSFFPGLSVCRTCSIGSINGFEIESHKCYCSLFCCPYCRHCSADREIHQLHLSICKKRKTGSNVMLAVCKRMCFRATMEASRRALLIRSIINTTFVICILTLTICVVSTSAVEMENLPAGTWEREEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGNFFIGILLFLAPFVLLVLFFMFGWKILFCFKCCRRTRGLFKYRHLKDDEETGYRRIIERLNNKKGKNRLLDGERLADRKIAELFSTKTHIG

SEQ ID NO: 1437 - protein, 1165 aa, Artificial Sequence
  derived and/or modified protein sequence (wt) from CCHVF(CCHVF Gaib)__KX013445.1__Gn-NSm-Gc
SEESSDDCISRTQLLRTETAEIHNDNYGGPGDKITICNGSTIVDQRLGSELGCYTINRVKSFKLCENSATGKSCEIDSIPVKCRQGFCLKITQEGRGHVKLSRGSEVVLDACDSSCEIMIPKGTGDILVDCSGGQQHFLKDNLIDLGCPNIPLLGKMAIYICRMSNHPKTTMAFLFWFSFGYVITCIFCKAIFYLLIIVGTLGKKFKQYRELKPQTCTICETTPVNAIDAEMHDLNCSYNICPYCASRLTSDGLARHVVHCPKRKEKIEETELYLNLERVPWVVRKLLQVSESTGVALKRSSWLIVLLVLLTVSLSPVQSAPIGHGKTIETYQTREGYTSICLFVLGGILFIVSCLMKGLVDSVGNNFFPGLTICKTCSISSINGFEIESHKCYCSLLCCPYCRHCSADREIHQLHLSICKKRKTGSNVMLAVCKRMCLRVTTEVSNRALFIRSIINTTFVICILILAVCVISTSAVEMENLPAGTWEREEDLTNFCHQECQVTETECLCPYEALVLRKPLFSDSIVKGMKNLLNSTSLETSLSIEAPWGAINVQSTFKPTVSTANIALSWSSIEHRGNKILVSGRSESIMKLEERTGISWDLGVEDASESRLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHAAFVNLLNIETDYTKNFHFHSKRVTAHGDTPQLDLKARPTYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSREDTQKCVSTKLEQPQSILIEHKGTIIGKQNNTCTTKTTCWLESVKSFFYGLKNMLSSIFGNVFVGIFSFLAPFILLILFFMFGWRILFCFKCCRRTRGLFKYRHLKDDEETGYRRIIERLNNKKGKSKLLDGERLADRKIAELFSTKTHIG

SEQ ID NO: 1438 - protein, 1165 aa, Artificial Sequence
  derived and/or modified protein sequence (wt) from CCHVF(CCHVF Hodzha)__KX013448.1__Gn-NSm-Gc
SEESGDDCISRTQLLRTETAEIHGDDYGGPGDKITICNGSTIVDQRLGSELGCYTINRVKSFKLCENSATGKSCEIDSTPVKCRQGYCLKITQEGRGHVKLSRGSEVVLDACDSSCEVMIPKGTGDILVDCSGGQQHFLKDNLIDLGCPRIPLLGKMAIYICRMSNHPETTMAFLFWFSFGYVITCILCKAIFYLLIIVGTLGKRFKQYRELKPQTCTICETTPANAIDAEMHDLNCSYNICPYCASRLTSDGLARHVTQCPKRKEKVEETELYLNLERIPWIVRKLLQVSESTGVALKRSSWLIVLLVLFAVSLSPVQSAPIGHGKTIETYQAREEYTSICLFVLGSILFIVSCLMKGLVDSIGNIFFPGLTICKTCSIGSINGFEIESHKCYCSLLCCPYCRHCPADREIHQLHLSICKKRKTGSNVMLAVCKRMCFRATMEVSNKALLIRSIINTTFVVCILILAVCVVSTSAVEMESLPAGTWEREEDLTNFCHQECQVTETECLCPYEALVLRRPLFLDSIVKGKKNLLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCSERCGCTSSTCLHKEWPHSRNWRCNPTWCWGVGTGCTCCGLDVKDLFTDYMFVKWKVDYIKTEAIVCVELTSQERQCSLVEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFVNLLNIETDYTKSFHFHSKRVTAHGDTPQLDLKARPTYGAGEITVLVEVADMELHTKKIEITGLKFASLTCTGCYACSSGISCKVRIHVDEPDELTVHVKSDDPDVVAASSSLMARKLEFGTDSTFKAFSAMPKTSLCFYIVEREYCKSCSKEDTQKCVNTKLEQPQSILIEQKGTIIGKQNNTCTAKASCWLESVKSFFYGLKNMLSGIFGNVFVGIFLFLAPFILLILFFMFGWRILFCFKCCRRTRGLFKYKHLKDDEETGYRRIIERLNNKKGKNKLLDGERLADRRIAELFSTKTHIG

SEQ ID NO: 1439 - protein, 1165 aa, Artificial Sequence
  derived and/or modified protein sequence (wt) from CCHVF(CCHVF IbAn7620)__KX013451.1__Gn-NSm-Gc
SEEPSDDCISRTQLLRTETAEIHGDNYGGPGDKITICNGSTIVDQRLGSELGCYTINRVKSFKLCENSATGKNCEIDSVPVKCRQGYCLRITQEGRGHVKLSRGSEIVLDACDTSCEIMIPKGTGDILVDCSGGQQHFLKDNLIDLGCPKIPLLGKMAIYICRMSNHPKTTMAFLFWFSFGYVITCILCKAIFYLLIIIGTLGKRLKQYRELKPQTCTICETTPVNAIDAEMHDLNCSYNICPYCASRLTSDGLARHVIQCPKRKEKVEETELYLNLERIPWVVRKLLQVSESTGVALKRSSWLIVLLVLFTVSLSPVQSAPIGQGKTTEAYRAREGYTSICLFVLGSILFIVSCLMKGLVDSVGNSFFPGLSICKTCSISSINGFEIESHKCYCSLFCCPYCRHCSTDKEIHKLHLSICKKRKTGSNVMLAVCKRMCFRATMEVSNRALFIRSIINTTFVLCILILAVCVVSTSAVEMENLPAGTWEREEDLTNFCHQECQVTETECLCPYEALVLRKPLFLDSIAKGMKNPLNSTSLETSLSIEAPWGAIDVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFVNLLNIETDYTKNFHFHSKRVTAHGDTPQLDLKARPTYGAGEITVLVEVANMELHTKKIEISGLKFASLTCTGCYACSSGISCKVRIHVDEPDELTVHVKSDDPDVVAASSSLMARKLEFGTDSTFKAFSAMPKTSLCFYIVEREHCKSCSEEDTKKCVNTKLEQPQSILIEHKGTIIGKQNSTCTAKASCWLESVKSFFYGLKNMLSGIFGNVFMGIFLFLAPFILLILFFMFGWRILFCFKCCRRTRGLFKYRHLKDDEETGYRRIIERLNNKKGKNKLLDGERLADRRIAELFSTKTHIG

SEQ ID NO: 1440 - protein, 1165 aa, Artificial Sequence
  derived and/or modified protein sequence (wt) from CCHVF(CCHVF K128_76)__KX013454.1__Gn-NSm-Gc
SDESGDDCISRTQLLRTETAEIHGDNYGGPGDKITICNGSTIVDQRLGSELGCYTINRVKSFKLCENSATGKSCEIDSIPVKCRQGYCLKITQEGRGHVKLSRGSEVVLDACDSSCEVMIPKGTGDILVDCSGGQQHFLKDNLIDLGCPKIPLLGKMAIYICRMSNHPKTTMAFLFWFSFGYVITCIVCKAIFYLLIIVGTLGKRFKQYRELKPQTCTICETTPTNAIDAEMHDLNCSYNICPYCASRLTSDGLARHVTHCPKRKEKVEETELYLNLERIPWVVRKLLQVSESTGVALKRSSWLIVLLVLFAVSLSPVQSAPISHGKTIETYQVREEYTSICLFVLGSILFIVSCLMKGLVNSVGNIFFPGLSICKTCSIGSINGFEIESHKCYCSLLCCPYCRHCSADREIHQLHLSICKKRKTGSNVMLAVCKRMCFRATMEVSNKALFIRSIINTTFVVCILILAVCVVSTSAVEMESLPAGTWEREEDLTNFCHQECQVTETECLCPYEALVLRRPLFQDSIVKGMKNLLNSTSLETSLSIEAPWGAINVQSTYKPAVSAANIALSWSSVEHRGSKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDRVNGHLIHKIEPHFNTSWMSWDGCDLDYYCNMGDWPSCTYTGVTQHNHASFVNLLNIETDYTKSFHFHSKRVTAHGDTPQLDLKARPNYGAGEITVLVEVADMELHTKKIEISGLKFASLTCTGCYACSSGISCKVRIHVDEPDELTVHVKSDDPDVVAASSSLMARKLEFGTDSTFKAFSAMPKTSLCFYIVEREYCKSCSKEDTQKCVNTKLEQPQSILIEHKGTIIGKQNNTCTAKTSCWLESVKSFFYGLKNMLSGIFGNVFVGIFLFLAPFILLILFFMFGWRILFCFKCCRRTRGLFRYKHLENDEETGYRRIIERLNNKKGKNKLLDGERLADRRIAELFSTKTHIG

SEQ ID NO: 1441 - protein, 1165 aa, Artificial Sequence
  derived and/or modified protein sequence (wt) from CCHVF(CCHVF K168_40)__KX013457.1__Gn-NSm-Gc
SDESGDDCISRTQLLRTETAEIHGDNYGGPGDKITICNGSTIVDQRLGSELGCYTINRVKSFKLCENSATGKSCEVDSIPVKCRQGYCLKITQEGRGHVKLSRGSEVVLDACDSSCEVMIPKGTGDILVDCSGGQQHFLKDNLIDLGCPKIPLLGKMAIYICRMSNHPKTTMAFLFWFSFGYVITCIVCKAIFYLLIIVGTLGKRFKQYRELKPQTCTICETTPTNAIDAEMHDLNCSYNICPYCASRLTSDGLARHVTHCPKRKEKVEETELYLNLERIPWVVRKLLQVSESTGVALKRSSWLIVLLVLFAVSLSPVQSAPIGHGKTIETYQVREEYTSICLFVLGSILFIVSCLMKGLVNSVGNIFFPGLSICKTCSIGSINGFEIESHKCYCSLLCCPYCRHCSADREIHQLHLSICKKRKTGSNVMLAVCKRMCFRATVEVSNKALSIRSIINTTFVVCILILAVCVVSTSAVEMESLPAGTWEREEDLTNFCHQECQVTETECLCPYEALVLRRPLFLDGIVKGMKNLLNSTSLETSLSIEAPWGAINVQSTYKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFINLLNIETDYTKSFHFHSKRVTAHGDTPQLDLKARPNYGAGEITVLVEVADMELHTKKIEISGLKFASLTCTGCYACSSGISCKVRIHVDEPDELTVHVKSDDPDVVAASSSLMARKLEFGTDSTFKAFSAMPKTSLCFYIVEREYCKSCSKEDTQKCVNTKLEHPQSILIEHKGTIIGKQNNTCTAKTSCWLESVKSFFYGLKNMLSGIFGNVFVGIFLFLAPFILLILFFMFGWRILFCFKCCRRTRGLFRYKHLEDDEETGYRRIIERLNNKKGKNKLLDGERLADRRIAELFSTKTHIG

SEQ ID NO: 1442 - protein, 1165 aa, Artificial Sequence
  derived and/or modified protein sequence (wt) from CCHVF(CCHVF K168_125)__KX013460.1__Gn-NSm-Gc
SDESGDDCISRTQLLRTETAEIHGDNYGGPGDKITICNGSTIVDQRLGSELGCYTINRVKSFKLCENSATGKSCEVDSIPVKCRQGYCLKITQEGRGHVKLSRGSEVVLDACDSSCEVMIPKGTGDILVDCSGGQQHFLKDNLIDLGCPKVPLLGKMAIYICRMSNHPKTTMAFLFWFSFGYVITCIVCKAIFYLLIIVGTLGKRFKQYRELKPQTCTICETTPTNAIDAEMHDLNCSYNICPYCASRLTSDGLARHVTHCPKRKEKVEETELYLNLERIPWVVRKLLQVSESTGVALKRSSWLIVLLVLFAVSLSPVQSAPIGHGKTIETYQVREEYTSICLFVLGSILFIVSCLMKGLVNSVGNIFFPGLSICKTCSIGSINGFEIESHKCYCSLLCCPYCRHCSADREIHQLHLSICKKRKTGSNVMLAVCKRMCFRATVEVSNKALSIRSIINTTFVVCILILAVCVVSTSAVEMESLPAGTWEREEDLTNFCHQECQVTETECLCPYEALVLRRPLFLDSIVKGKKNLLNSTSLETSLSIEAPWGAINVQSTYKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFINLLNIETDYTKSFHFHSKRVTAHGDTPQLDLKARPNYGAGEITVLVEVADMELHTKKIEISGLKFASLTCTGCYACSSGISCKVRIHVDEPDELTVHVKSDDPDVVAASSSLMARKLEFGTDSTFKAFSAMPKTSLCFYIVEREYCKSCSKEDTQKCVNTKLEHPQSILIEHKGTIIGKQNNTCTAKTSCWLESVKSFFYGLKNMLSGIFGNVFVGIFLFLAPFILLILFFMFGWRILFCFKCCRRTRGLFRYKHLEDDEETGYRRIIERLNNKKGKNKLLDGERLADRRIAELFSTKTHIG

SEQ ID NO: 1443 - protein, 1165 aa, Artificial Sequence
  derived and/or modified protein sequence (wt) from CCHVF(CCHVF K229_194)__KX013463.1__Gn-NSm-Gc
SEEPGDDCISRTQLLKTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEIMIPKGTGDILVDCSGGQQHFLKGNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLTVSLSPVQSAPVGHGKTIETYQTREGFTNICLFMLGSILFIVSCLVKGLVDSVSDSFFPGLSVCKTCSIGSINGFEIESHKCYCSLFCCPYCRHCSADREIHQLHLGICKKRKTGSNVMLAVCKRMCFKATIEASRRALLIRSIINTTFVICILTLAICVVSTSAVEMENLPAGTWEREEDLTSFCHQECQVTETECLCPYEALVLRKPLFLDSIVKGKKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRLNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYSCSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGNFFVGILLFLAPFVLLVLFFMFGWKILFCFKCCRRTRGLFKYRHLKDDEETGYRKIIERLNSKKGKNRLLDGERLADRKIAELFSTKTHIG

SEQ ID NO: 1444 - protein, 1165 aa, Artificial Sequence
  derived and/or modified protein sequence (wt) from CCHVF(CCHVF K229_243)__KX013466.1__Gn-NSm-Gc
SEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVGHGKTIETYQTREGFTSICLFMLGSILFLVSCLVKGLVDSVSDSFFPGLSVCKTCSIGSINGFEIESHKCYCSLFCCPYCRHCSADREIHQLHLSICKKRKTGSNVMLAVCKRMCFRATIEASRRALLIRSIINTTFVICILTLTICVVSTSAVEMENLPAGTWEREEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEKEYCKSCSEEDTQKCVDTKLEQPQSILIEHKGTIIGKQNDTCTAKASCWLESVKSFFYGLKNMLGSVFGNFFIGILLFLTPFVLLVLFFMFGWKILFCFKCCRRTRGLLKYRHLKDDEETGYRRIIERLNNKKGKNRLLDGERLADRKIAELFSTKTHIG

SEQ ID NO: 1445 - protein, 1165 aa, Artificial Sequence
  derived and/or modified protein sequence (wt) from CCHVF(CCHVF K315_14)__KX013469.1__Gn-NSm-Gc
SEEPGDDCISRTQLLKTETAEIHDDNYGGPGDKITICNGSTVVDQRLGSELGCYTINRVKSFKLCKNSATGKTCEIDSTPVKCRQGFCLKITQEGRGHVKLSRGSEVVLDVCDSSCEIMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSEGLARHVTQCPKRKEKVEETELYLNLERIPWIVRKLLQVSESTGVALKRSSWLIVLLVLLTVSLSPVQSAPVGHGKTIETYQTREGFTSICLFMLGSILFIVSCLVKGLVYSVSDSFFPGLSVCKTCSIGSINGFEIESHKCYCSLFCCPYCRHCSADREIHQLHLSICKKRKTGSNVMLAVCKRMCFKATIEASRRALLIRSIINTTFVICILTLAICVVSTSAVEMEDLPAGTWEREEDLTNFCHQECQVTETECLCPYEALVLRKPLFLDSIVKGMKKLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLTCTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGSFFVGILLFLAPFVLLVLFFMFGWKILFCFKCCRRTRGLFKYRHLKDDEETGYRRIIERLNSKKGKNRLLDGERLADRKIAELFSTKTHIG

SEQ ID NO: 1446 - protein, 1165 aa, Artificial Sequence
  derived and/or modified protein sequence (wt) from CCHVF(CCHVF K323_27)__KX013472.1__Gn-NSm-Gc
SEEPGDDCISRTQLLKTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEIMIPKGTGDILVDCSGGQQHFLKDNLIDLGCPHIPLLGKMAIYICRMSNHPRTTMAFLFWFSFGYVITCIFCKALFYLLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLTVLLVLLTVSLSPVQSAPVGHGNTIETYQTREGFTSICLFMLGSILFIVSCLVKGLVDSVSDSFFPGLSVCKTCSIGSINGFEIESHKCYCSLFCCPHCRHRSADREIHQLHLSICKKRKTGSNVMLAVCKRMCPKATIEASRRALPIRSIINTTLVMCILTLAICVVSTSAVEMEDLPAGTWEREEDLTNFCHQECQVTETECLCPYEALVLRKPLFLDSIAKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTGQERQCSLIEAGTRFNLGPVTITLSEPRNIQQKLPPEIITLHPKIEEGFFDLMHVQKVLSASTVCKLQSCTHGIPGDLQIYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLTCTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGSFFVGILLFLAPFVLLVLFFMFGWKILFCFKCCRRTRGLFKYRHLNDDEETGYRRIIERLNSKKGKNRLLDGERLADRKIAELFSTKTHIG

SEQ ID NO: 1447 - protein, 1165 aa, Artificial Sequence
  derived and/or modified protein sequence (wt) from CCHVF(CCHVF K340_6)__KX013475.1__Gn-NSm-Gc
SEEPGDDCISRTQLLKTETAEIHDDNYGGPGDKITICNGSTIVDQRLGSELGCYTINRVKSFKLCENSTTGKTCEIDSTPVKCRQGFCLKITQEGRGHVKLSRGSEVVLDACDSSCEIMIPKGTGDILVDCSGGQQHFLKDNLIDLGCPHIPPLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLTVSLSPVQSAPVGHGKTIETYQTREGFTSICLFMLGSILFIVSCLVKGLVDSVSDSFFPGLSVCKTCSIGSINGFEIESHKCYCSLFCCPYCRHCSADREIHQLHLSICKKRKTGSNVMLAVCKRMCFKATIEASRRALLIRSIINTTFVMCILTLAICVVSTSAVEMEDLPAGTWEREEDLTNFCHQECQVTETECLCPYEALVLRKPLSLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVTDMELHTKKVEISGLKFASLTCTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGSFFVGILLFLAPFVLLVLFFMFGWKILFCFKCCRRTRGLFKYRHFKDDEETGYRRIIERLNSKKGKNRLLDGERLADRKIAELFSTKTHIG

SEQ ID NO: 1448 - protein, 1165 aa, Artificial Sequence
  derived and/or modified protein sequence (wt) from CCHVF(CCHVF Mamon)__KX013478.1__Gn-NSm-Gc
SEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVSDACDSSCEVMIPKGTGDILVDCSGGQQHFLKDNLIDLGCPHIPLLGKMAIYICRMSNHPRTTVAFLFWFSFGYVITCIFCKALFYSLIIIGTLGKKIKQYRELKPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVGHGKTIETYQTREGFTSICLFMLGSILFLVSCLVKGLVDSVSDSFFPGLSVCKTCSIGSINGFEIESHKCYCSLFCCPYCRHCSADREIHQLHLSICKKRKTGSNVMLAVCKRMCFRATIEASRRALLIRSIINTTFVICILTLTICVVSTSAVEMENLPSGTWEREEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEEDTQKCVDTKLEQPQSILIEHKGTIIGKQNDTCTAKTSCWLESVKSFFYGLKNMLGSVFGNFFIGILLFLAPFVLLVLFFMFGWKILFCFKCCRRTRGLLKYRHLKDDEETGYRRIIERLNNKKGKNRLLDGERLADRKIAELFSTKTHIG

SEQ ID NO: 1449 - protein, 1165 aa, Artificial Sequence
  derived and/or modified protein sequence (wt) from CCHVF(CCHVF Min)__KX013481.1__Gn-NSm-Gc
SEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVGHGKTIETYQTREGFTSICLFMLGSILFLVSCLVKGLVDSVSDSFFPGLSVCKTCTIGSINGFEIESHKCYCSLFCCPYCRHCSADREIHQLHLSICKKRKTGSNVMLAVCKRMCFRATIEASRRALLIRSIINTTFVICILTLTICVVSTSAVEMENLPSGTWEREEDLTNFCHQECQVTETECLCPYEALVLRKPLFLDSIVKGTKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRINGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEEDTQKCVDTKLEQPQSILIEHKGTIIGKQNDTCTAKASCWLESVKSFFYGLKNMLGSVFGNFFIGILLFLAPFVLLVLFFMFGWKILFCFKCCRRTRGLLKYRHLKDDEETGYRRIIERLNNKKGKNRLLDGERLADRKIAELFSTKTHIG

SEQ ID NO: 1450 - protein, 1165 aa, Artificial Sequence
  derived and/or modified protein sequence (wt) from CCHVF(CCHVF Nakiwogo)__KX013484.1__Gn-NSm-Gc
AEGVSNDCVSRTQLIKTEVAEIHEDSYGGPGEKITICNGSTIVDQRLGSELGCYTINRVKTYKLCENSATEKGCEIDSVPVKCKQGFCLKVTQEGRGHVKLSRGTEIVLDVCDTSCELMIPKGTGDILVDCSGGQQHFLQDNLIDLGCPNVPLLGKMAIYICRMSNHPKTTMAFLFWFSFGYVITCVVCKVLFYLLIVIGTLGKKLKQYRELKPQTCIVCESIPVNVIDAEMHELNCNYNICPYCASRLTSDGLVRHVTQCPKRKEKVEETELYLNLERIPWLVRRLLQVSESTGMALKRSCWMTTLLILLVVSLSPVQSAPVGQEKAIEVYQVRESYTSMCLFVLGSVLFAVSWLVKGLIDGIGNSFFPGLSVCKTCSIGSINGFEIESHKCYCSLFCCPYCRACSSDKITHRMHLNICKRRKVGSNVMLAVCKRMCFKATVEASNSALLIRSIINSTFVICVLILVICVVSTSAVDMENLPAGIWEREEDLTNFCHQECQVTETECLCPYEALILRKPLYLDSIAKGMKSLLNSTNLETSLSIEAPWGAINVQSTFKPTVSAANIALSWSSVEHRGNKILVSGRSESIMKLEERTGISWSLGVEDASESKTLTVSVMDLSQMYSPVFEYLSGDRQVEEWPKATCTGDCPERCGCTSSTCLHKEWPHSRNWRCNPTWCWGVGTGCTCCGLDVRDLFTDYMMVKWKVEYVKTEAIMCVELTSQERQCSLIEAGTRFNLGPVTITLSEPRNVQQRLPSEIVTLHPKIEEGFFDLMHVQKVLFCKHSLQATSCTHGVPGDLQVYHVGNLLKGDKVNGHSIHKIESHFNTSWMSWDGCDLDYFCNMGDWPSCTYTGVTQHNRAAFVNMLNIETDYTKTFHFHSKRVTAHGDTPQLDLKARPTYGAGEVTVLVEVADLELHTKKIEVSGLKFASLTCSGCYACSSGISCKVRIHVNEPDEFTVHVKSNDPDVVAAGSSLMARKIELGADSTFKAFSSMPKNSLCFYIVERDYCSSCTDDDTQKCVNTKLEHPQSILIEHKGTIIGKQNDTCPTKTSCWLESVKSFFYGLKNMLGGIFGNVFLGIFLFLAPFALLILFFFFGWRLLFCLKCCRRTRGLLKYKQLKDEEEAGYKKIIERLNDKKGKSRLFDGERLADRKIAELFSTKTHIG

SEQ ID NO: 1451 - protein, 1165 aa, Artificial Sequence
  derived and/or modified protein sequence (wt) from CCHVF(CCHVF Saf)__KX013487.1__Gn-NSm-Gc
SEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHYLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVGHGKTIETYQTREGFTSICLFMLGSILFLVSCLVKGLVDSVSDSFFPGLSVCKTCSIGSINGFEIESHKCYCSLFCCPYCRHCSADREIHQLHLSICKKRKTGSNVMLAVCKRMCFRATIEASRRALLIRSIINTTFVICILTLTICVVSTSAVEMENLPSGTWEREEDLTNFCHQECQVTETECLCPYEALVLRKPLFSDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYMKTFHFHSKRVTAHGDTPQLDLKARPTYGAGEITVLVEVADMELHTKKVEISGLKFVSLACTGCYACSSGISCKVRIHVDEPDELTVHVKSSDPDVVAASTSLMARKLEFGTDSTFKAFSAMPKTSLCFYIVEREYCKSCSEEDTQKCVDTKLEQPQSILIEHKGTIIGKQNDTCTAKASCWLESVKSFFYGLKNMLGSVFGNFFIGILLFLAPFVLLVLFFMFGWKILFCFKCCRRTRGLLKYRHLKDDEETGYRRIIERLNNKKGKNRLLDGERLADRKIAELFSTKTHIG

SEQ ID NO: 1452 - protein, 1165 aa, Artificial Sequence
  derived and/or modified protein sequence (wt) from CCHVF(CCHVF Ast199)__KX056051.1__Gn-NSm-Gc
SEEPGDDCISRTQLLKTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEIMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRCSWLIVLLVLLTVSLSPVQSAPVGHGKTIETYQTREGFTNICLFMLGSILFIVSCLVKGLVDSVSDSFFPGLSVCKTCSIGSINGFEIESHKCYCSLFCCPYCRHCSADREIHQLHLGICKKRKTGSNVMLAVCKRMCFKATIEASRRALLIRSIINTTFVICILTLAICVVSTSAVEMENLPAGTWEREEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRLNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEVSGLKFASLACTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGNFFVGILLFLAPFVLLVLFFIFGWKILFCFKCCRRTRGLFKYRHLKDDEETGYRKIIERLNSKKGKNRLLDGERLADRKIAELFSTKTHIG

SEQ ID NO: 1453 - protein, 1165 aa, Artificial Sequence
  derived and/or modified protein sequence (wt) from CCHVF(CCHVF Ast149)__KX056054.1__Gn-NSm-Gc
SEEPGDDCISRTQLLKTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEIMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLTVSLSPVQSAPVGHGKTIETYQTREGFTNICLFMLGSILFIVSCLVKGLVDSVSDSFFPGLSVCKTCSIGSINGFEIESHKCYCSLFCCPYCRHCSADREIHQLHLGICKKRKTGSNVMLAVCKRMCFKATIEASRRALPIRSIINTTFVICILTLAICVVSTSAVEMENLPAGTWEREEDLTNFCHQECQVTETECLCPYEALVLRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRLNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEVSGLKFASLACTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGNFFVGILLFLAPFVLLALFFIFGWKILFCFKCCRRTRGLFKYRHLKDDEETGYRKIIERLNSKKGKNRLLDGERLADRKIAELFSTKTHIG

SEQ ID NO: 1454 - protein, 1165 aa, Artificial Sequence
  derived and/or modified protein sequence (wt) from CCHVF(CCHVF Ast137)__KX056057.1__Gn-NSm-Gc
SEEPGDDCISRTQLLKTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEIMIPKGTGDILVDCSGGQQHFLKDNLIDLGCPHIPLLGKMAIHICRMSNHPRTTMAFLFWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLTVSLSPVQSAPVGHGKTIETYQTREGFTNICLFMLGSILFIVSYLVKGLVDSVSDSFFPGLSVCKTCSIGSINGFEIESHKCYCSLFCCPYCRHCSADREIHQLHLGICKKRKTGSNVMLAVCKRMCFKATIEASRRALLIRSIINTTFVICILTLAICVVSTSAVEMENLPAGTWEREEDLTNFCHQECQVTETECLCPYEALVLRKPLFLDSIVKGTKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRLNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEVSGLKFASLACTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGNFFVGILLFLAPFVLLVLFFIFGWKILFCFKCCRRTRGLFKYRHLKDDEETGYRKIIERLNSKKGKNRLLDGERLADRKIAELFSTKTHIG

SEQ ID NO: 1455 - protein, 1165 aa, Artificial Sequence
  derived and/or modified protein sequence (wt) from CCHVF(CCHVF Ast133)__KX056060.1__Gn-NSm-Gc
SEEPDDDCISRTQLLKTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEIMIPKGTGDILVDCSGGQQHFLKDNLIDLGCPHIPLLGKMAIYICRMSNHPRTTMAFLFWFSFGYVITCIFCKALFYLLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLTVSLSPVQSAPVGHGKTIETYQTREGFTSICLFMLGSILFIVSCLVKGLVDSVSDSFFPGLSVCKTCSIGSINGFEIESHKCYCSLFCCPYCRHCSADREIHQLHLSICKKRKTGSNVMLAVCKRMCFKATIEASRRALLIRSIINTTFVMCILTLAICVVSTSAVEMEDLPAGTWEREEDLTNFCHQECQVTETECLCPYEALVLRKPLFSDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLTCTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGSFFVGILLFLAPFVLLVLFFMFGWKILFCFKCCRRTRGLFKYRHLKDDEETGYRRIIERLNSKKGKNRLLDGERLADRKIAELFSSKTHIG

SEQ ID NO: 1456 - protein, 1165 aa, Artificial Sequence
  derived and/or modified protein sequence (wt) from CCHVF(CCHVF SK/2015/human)__KX458183.1__Gn-NSm-Gc
SEESGDDCISRTRLLRTETAEIHGDSYGGPGDKITICNGSTIVDQRLGSEMGCYTINRVKSFKLCENSATGKSCEIDSIPVRCRQGYCLKITQEGRGHVKLSRGSEVVLDACDSSCEVMIPKGTGDILVDCSGGQQHFLKDNLIDLGCPNIPLLGKMAIYICRMSNHPKTTMAFLFWFSFGYVITCILCKAIFYLLIIVGTLGKRFKQYRELKPQTCTICETTPANAIDAEMHDLNCSYTICPYCASRLTSDGLARHVTQCPKRKEKVEETELYLNLERIPWVVRKLLQVSESTGVALKRSSWLIVLLVLFTVSLSPVQSAPIGHGKTIETYQAREEYTGICLFVLGSILFIVSCLVKGLVDGVGNIFFPGLSICKTCSIGSINGFEIESHKCYCSLLCCPYCRHCSADREIHQLHLSICKKRKTGSNVMLAVCKRMCFRATMEVSNKALLIRSIINTTFVVCILILAVCVVSTSAVEMESLPAGTWEREEDLTNFCHQECQVTETECLCPYEALVLRRPLFLDSIVRGMKNLLNSTSLETSLSIEAPWGAINVQSTYKPTVSTANIALSWSSVEHRGNKILVSGRSESIMKLEERTGVSWDLGVEDASESKLLTVSVMDLSQMYSPVFEYLSGDRQVEEWPKATCTGDCPERCGCTTSTCLHKEWPHSRNWRCNPTWCWGVGTGCTCCGLDVKDLFTDYMFVKWKVEYIKTEAIVCVELTSQGRQCSLIEAGTRFNLGSVTITLSEPRNIQHKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFVNLLNIETDYTKNFHFHSKRVTAHGDTPQLDLKARPTYGAGEITVLVEVADMELHTKKIEISGLKFASLTCTGCYACSSGISCKVRIHVDEPDELTVHVKSDDPDVVAASSSLMARKLEFGTDSTFKAFSAMPKTSLCFYIVEREYCKSCSKEDTQKCVNTKLEQPQSILIEHRGTIIGKQNNTCIAKASCWLESVKSFFYGLKNMLSGIFGNLFLGIFLFLAPFILLILFFMFGWRILFCFKCCRRTRGLFKYRHLKDDEETGYRRIIERLNNKKGKNKLLDGERLADRRIAELFSTKTHIG

SEQ ID NO: 1457 - protein, 1165 aa, Artificial Sequence
  derived and/or modified protein sequence (wt) from CCHVF(CCHVF YL16070)__KY354081.1__Gn-NSm-Gc
AEGGSSDCISRTQLVKTEVAEIHEDSYGGPGEKITICNGSTIVDQRLGSELGCYTINRVKSYKLCENSASGKSCEIDSIPVKCKQGFCLKITQEGRGHVKLSRGTEIVLDVCDSSCELMIPKGTGDILVDCSGGQQHFLQNNLIDLGCPNVPLLGKMAIYVCRMSNHPKTTMAFLFWFSFGYVITCIVCRVLFYLLIAIGTVGKKLKQYRELKPQTCIVCESVPVNAIDAEMHELNCSYNICPYCASRLSTDGLIRHVTQCPKRREKVEETELFLNLERIPWLVRKLLQVSESTGMALKRSCWMITLLILLLVSMSPVQSAPVGKERAIETYQAREAYTGICLFVLGSVLFAVSWLTKALIDGIGNSFFPGLSVCKTCSIGSINGFEIESHKCYCSLFCCPYCRACSSDKNTHRMHLNVCKKRKMGSNVMLAVCKRMCFRATIEASNKALLIRSIINSTFVICILILTICVVSTSAVDMENLPAGIWEKEEDLTNFCHQECQVTETECLCPYEAMVLRKPLFLDSIAKGMKSLLNSTSLETSLSIEAPWGAINVQSTFKPTVSAANIALSWSSVEHRGNKILVSGRSESIMKLEERTGVSWNLGVEDASESKTLTVSVMDLSQMYSPVFEYLSGDRQVEEWPKATCTGDCPERCGCTSSTCLHKEWPHSRNWRCNPTWCWGVGTGCTCCGLDVKDFFTDYMLVKWKVEYIKTEAIVCVELTSQERQCSLIEAGTRFNLGPVTITLSEPRNVQQRLPPEIVTLHPKIEEGFFDLMHVQKILSASTVCKLQSCTHGVPGDFQVYHVGNLLRGDKVNGHSIHKIEPHFNTSWMSWDGCDLDYFCNMGDWPSCTYTGVTQHNRAAFINMLNIETDYTKTFHFHSKRVTAHGDTPQLDLKARPAYGAGEVTVLVEVADLELHTKKLEVSGLKIASLTCSGCYACSSGISCKVRIHVNEPDEFTVHVRSSDPDVVAAGSSLMARKIEFGADSTFKAFSSMPKDSLCFYIVEKDYCSSCTDDDTQKCVNTKLDHPQSILIEHKGTIIGKQNDTCSTKTSCWLKSFKGFFYGLKNMLSGIFGNVFLGILLFLAPFVLLIFFFFFGWRLLFCLKCCKKTKGLLKYKHLKDKEEAGYKKIIERLNGKKGKSQLFDGERLANRKIAELFSTKIHIG

SEQ ID NO: 1458 - protein, 1165 aa, Artificial Sequence
  derived and/or modified protein sequence (wt) from CCHVF(CCHVF Oman_812956)__KY362518.1__Gn-NSm-Gc
SEESGEDCISRTQLLRTETAEIHGDNYGGPGDKITICNGSTIVDQRLGSELGCYTINRVKSFKLCENSATGKSCEIDNTPVKCKQGFCLKITQEGRGHVKLSRDSEVVLDACDSSCEIMIPKGTGDILVDCSGGQQHFLKDNLIDLGCPNIPLLGKMAIYICRMSNHPKTTMAFLFWFSFGYVITCILCKVIFYLLIVVGTLGKKFKQYRELKPQTCTICETTPVNAIDAEMHDLNCSYNICPYCASRLTSDGLARHVMQCPKRKEKIEETELYLNLERIPWVVRKLLQVSESTGVALKRSSWLIVLLVLLTVSLSPVQSAPIGHGKTIETYQTREGYTSICLFVLGSILFIVSHLMKGLVDSVGNSFFPGLSICKTCSIGSINGFEIESHKCYCSLFCCPYCRHCSADKEIHKLHLSICKKRKAGSNVMLAVCKRMCFRATMEVSNKALLIRSVINTTFVVCILILAVCVVSTSAVEMESLPAGTWEREEDLTNFCHQECQVTETECLCPYEALVLRKPLFFDSIAKGMKNLLNSTSLETSLSIEAPWGAINVQSTFKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIVTLHPRIEEGFFDLMHVQKVLSASTVCKLQSCTHGVPGDLQVYHIGNLLKGDKVNGHLIHKVEPHFNTSWMSWDGCDLDYYCNMGDWPSCTYTGVTQHNHAAFVNLLNIETDYTKNFHFHSKRVTAHGDTPQLDLKARPNYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSKEDTQKCVNAKLERPQSILIEHKGTIIGKQNDTCTAKASCWLESVKSFFYGLKNMLSGIFGNVFIGIFLFLAPFILLILFFMFGWRILFCFKCCRRTRGLFKYRHLKDDEETGYRKIIERLNNKKGKNKLLDGERLADRKIAELFSTKTHIG

SEQ ID NO: 1459 - protein, 1165 aa, Artificial Sequence
  derived and/or modified protein sequence (wt) from CCHVF(CCHVF UCCR4405)__KY484029.1__Gn-NSm-Gc
SEEPGDDCISRTQLLKTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLKCSYNICPYCASRLTSDGLARHVTQCPKRKEKVEETELYLNLERIPWIVRKLLQVSESTGVALKRSSWLIVLLVLLTVSLSPVQSAPVGHGKTIETYQTREGFTSICLFMLGSILFIVSCLVKGLVDSVSDSFFPGLSVCKTCSIGSINGFEIESHKCYCSLFCCPYCRHYSADREIHQLHLSICKKRKTGSNVMLAVCKRMCFKATIEASRRALLIRSIINTTFVICILILAICVVSTSAVEMENLPAGTWEREEDLTNFCHQECQVTETECLCPYEALVLRKPLFLDSTVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRVNGHLIHKIEPHFNTSWMSWDGCDLDYYCNMGNWPSCTYTGVTQHNHAAFVNLLNIETDYTKTFHFHSKRVTAHGDTPQLDLKARPTYGAGEITVLVEVADMELHTKKVEISGLKFASLVCTGCYACSSGISCKVRIHVDEPDELTVHVKSSDPDVVAASTSLMARKLEFGTDSIFKAFSAMPKTSLCFYIVEREYCKSCSEDDTKKCVDTKLEQPQSILIEHKGTIIGKQNDTCTAKASCWLESVKSFFYGLKNMLGSVFGNFFVGILLFLAPFVLLVLFFMFGWKILFCFKCCRRTRGLFKYRHLKDDEETGYRRIIERLNSKKGKNRLLDGERLADRKIAELFSTKTHIG

SEQ ID NO: 1460 - protein, 1165 aa, Artificial Sequence
  derived and/or modified protein sequence (wt) from CCHVF(CCHVF UCCR4459)__KY484032.1__Gn-NSm-Gc
SEESGDDCISRTQLSRTETAEIHSDNYGGPGDKITICNGSTIVDQRLGSELGCYTINRVKSFKLCENSATGKSCEIDSTPIKCRQGFCLKITQEGRGHVKLSRGSEVVLDACDSSCEIMIPKGTGDILVDCSGGQQHFLKDNLIDLGCPNIPLLGKMAIYICRMSNHPKTTMAFLFWFSFGYVITCILCKVIFYLLIVVGTLGKKFKQYRELKPQTCTICETTPVNAIDAEMHDLNCSYNICPYCASRLTSDGLARHVMQCPKRKEKVEETELYLNLERIPWVVRKLLQVSESTGVALKRSSWLVVLLVLLTVSLSPVQSAPIGHGKTVETYQTREGYTSICLFVLGSILFIVSCLMKGLVDSVGNSFFPGLSICKTCSIGSINGFEIESHKCYCSLFCCPYCRHCSADREIHKLHLSICKKRKTGSNVMLAVCKRMCFRATVEVSNKALLIRNIINTTFVVCILILAVCVVSTSAVEMESLPAGTWEREEDLTNFCHQECQVTETECLCPYEALVLRKPLFSDSIVKGMKNLLNSTSLETSLSIEAPWGAINVQSTFKPTVSAANIALSWSSVEHRGNKILVSGRSESIMKLEERTGISWDLGVEDASESKLLTVSIMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIVTLHPRIEEGFFDLMHVKKVLSASTVCKLQSCTHGVPGDLQVYHIGNLLKGDKVNGHLIHKIEPHFNTSWMSWDGCDLDYYCNMGDWPSCSYTGVTQHNHAAFVNMLNIETDYTKIFHFHSKRVTAHGDTPQLDLKARPTYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSKEDTQKCVNTKLEQPQSILIEHKGTIIGKQNDTCTSKAGCWLESVKSFFYGLKNMLSGIFGNVFIGIFLFLAPFILLILFFMFGWRILFCFKCCRRTRGLFKYRHLKDDEETGYRKIIERLNNKKGKNKLLDGERLADRKIAELFSTKTHIG

SEQ ID NO: 1461 - protein, 1165 aa, Artificial Sequence
  derived and/or modified protein sequence (wt) from CCHVF(CCHVF UCCR4401)__KY484035.1__Gn-NSm-Gc
SEEPSDDCISRTQLLRTETAEIHGDNYGGPGDKITICNGSTIVDQRLGSELGCYTINRVRSFKLCENSATGKNCEIDSVPVKCRQGYCLRITQEGRGHVKLSRGSEVVLDACDTSCEIMIPKGTGDILVDCSGGQQHFLKDNLIDLGCPKIPLLGKMAIYICRMSNHPKTTMAFLFWFSFGYVITCILCKAIFYLLIIVGTLGKRLKQYRELKPQTCTICETTPVNAIDAEMHDLNCSYNICPYCASRLTSDGLARHVIQCPKRKEKVEETELYLNLERIPWVVRKLLQVSESTGVALKRSSWLIVLLVLFTVSLSPVQSAPIGQGKTIEAYRAREGYTSICLFVLGSILFIVSCLMKGLVDSVGNSFFPGLSICKTCSISSINGFEIESHKCYCSLFCCPYCRHCSTDKEIHKLHLSICKKRKTGSNVMLAVCKLMCFRATMEVSNRALFIRSIINTTFVLCILILAVCVVSTSAVEMENLPAGTWEREEDLTNFCHQECQVTETECLCPYEALVLRKPLFLDSTAKGMKNLLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFVNLLNIETDYTKNFHFHSKRVTAHGDTPQLDLKARPTYGAGEITVLVEVADMELHTKKIEISGLKFASLACTGCYACSSGISCKVRIHVDEPDELTVHVKSDDPDVVAASSSLMARKLEFGTDSTFKAFSAMPKTSLCFYIVEREHCKSCSEEDTKKCVNTKLEQPQSILIEHKGTIIGKQNSTCTAKASCWLESVKSFFYGLKNMLSGIFGNVFMGIFLFLAPFILLILFFMFGWRILFCFKCCRRTRGLFKYRHLKDDEETGYRRIIEKLNNKKGKNKLLDGERLADRRIAELFSTKTHIG

SEQ ID NO: 1462 - protein, 1165 aa, Artificial Sequence
  derived and/or modified protein sequence (wt) from CCHVF(CCHVF UCCR4448)__KY484042.1__Gn-NSm-Gc
SEETSDDCISRTQLLRTETAEIHGDNYGGPGDKITICNGSTIVDQRLGSELGCYTINRVKSFKLCENSATGKSCEIDSVPVKCRQGYCLRITQEGRGHVKLSRGSEVVLDACDTSCEIMIPKGTGDILVDCSGGQQHFLKDNLIDLGCPKIPLLGKMAIYICRMSNHPKTTMAFLFWFSFGYVITCILCKAIFYLLIIIGTLGKRFKQYRELKPQTCTICETTPVNAIDAEMHDLNCSYNICPYCASRLTSDGLARHVTQCPKRKEKVEETELYLNLERIPWVVRKLLQVSESTGVALKRSSWLIVLLVLFTISLSPVQSAPISHGKTIEAYRAREGYTSICLFVLGSILFIVSYLMKGLVDSVGNSFFPGLSICKTCSTSSINGFEIESHKCYCSLFCCPYCRHCSADKEIHKLHLSICKKRKTGSNVMLAVCKRMCFRATMEVSNRALFIRSIINTTFVLCILILAVCVVSTSAVEMENLPAGTWEREEDLTNFCHQECQVTETECLCPYEALVLRKPLFLDSIVKGMKNLLNSTSLETSLSIEAPWGAINVQSTYKPTVSTANIALSWSSVEHRGNKILVSGRSESIMKLEEKTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFVNLLNIETDYTKNFHFHSKRVTAHGDTPQLDLKARPTYGAGEITVLVEVADMELHTKKIEISGLKFASLTCTGCYACSSGISCKVRIHVDEPDELTVHVKSDDPDVVAASSSLMARKLEFGTDSTFKAFSAMPKTSLCFYIVEREHCKSCSEEDTKKCVNTKLEQPQSILIEHKGTIIGKQNSTCTAKASCWLESVKSFFYGLKNMLSGIFGNVFIGIFLFLAPFILLILFFMFGWKILFCFKCCRRTRGLFKYRHLKDDEETGYRRIIERLNNKKGKNKLLDGEILADRRIAELFSTKTHIG

SEQ ID NO: 1463 - protein, 1165 aa, Artificial Sequence; identical to SEQ ID NO: 1379
  derived and/or modified protein sequence (wt) from CCHVF(CCHVF SPU4/81 )__DQ157175.1__Gn-NSm-Gc

SEQ ID NO: 1464 - protein, 1165 aa, Artificial Sequence; identical to SEQ ID NO: 1400
  derived and/or modified protein sequence (wt) from CCHVF(CCHVF Sudan Al-Fulah 9-2008)__HQ378185.1__Gn-NSm-Gc

SEQ ID NO: 1465 - protein, 1165 aa, Artificial Sequence; identical to SEQ ID NO: 1394
  derived and/or modified protein sequence (wt) from CCHVF(CCHVF NIV161064)__KY213713.1__Gn-NSm-Gc

SEQ ID NO: 1466 - protein, 1165 aa, Artificial Sequence; identical to SEQ ID NO: 1416
  derived and/or modified protein sequence (wt) from CCHVF(CCHVF 5180-R-2011)__KR814874.1__Gn-NSm-Gc

SEQ ID NO: 1467 - protein, 1165 aa, Artificial Sequence; identical to SEQ ID NO: 1424
  derived and/or modified protein sequence (wt) from CCHVF(CCHVF 4574-ST-2008)__KR814870.1__Gn-NSm-Gc

SEQ ID NO: 1468 - protein, 1165 aa, Artificial Sequence; identical to SEQ ID NO: 1376
  derived and/or modified protein sequence (wt) from CCHVF(CCHVF 3010)__DQ019222.1__Gn-NSm-Gc

SEQ ID NO: 1469 - protein, 1165 aa, Artificial Sequence; identical to SEQ ID NO: 1376
  derived and/or modified protein sequence (wt) from CCHVF(CCHVF UG3010)__DQ211637.1__Gn-NSm-Gc

SEQ ID NO: 1470 - protein, 972 aa, Artificial Sequence
  derived and/or modified protein sequence (wt) from CCHFV(10200, Artificial)__U39455.2__Gn-4aa-Gc
SEEPSDDCVSRTQLLRTETAEIHGDNYGGPGDKITICNGSTIVDQRLGSELGCYTINRVRSFKLCENSATGKNCEIDSVPVKCRQGYCLRITQEGRGHVKLSRGSEVVLDACDTSCEIMIPKGTGDILVDCSGGQQHFLKDNLIDLGCPKIPLLGKMAIYICRMSNHPKTTMAFLFWFSFGYVITCILCKAIFYLLIIVGTLGRRLKQYRELKPQTCTICETTPVNAIDAEMHDLNCSYNICPYCASRLTSDGLARHVIQCPKRKEKVEETELYLNLERIPWVVRKLLQVSESTGVALKRSSWLIVLLVLFTVSLSPVQSAPIGRKPLFLDSTAKGMKNLLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFVNLLNIETDYTKNFHFHSKRVTAHGDTPQLDLKARPTYGAGEITVLVEVADMELHTKKIEISGLKFASLACTGCYACSSSISCKVRIHVDEPDELTVHVKSDDPDVVAASSSLMARKLEFGTDSTFKAFSAMPKTSLCFYIVEREHCKSCSEEDTKKCVNTKLEQPQSILIEHKGTIIGKQNSTCTAKASCWLESVKSFFYGLKNMLSGIFGNVFMGIFLFLAPFILLILFFMFGWRILFCFKCCRRTRGLFKYRHLKDDEETGYRRIIEKLNNKKGKNKLLDGERLADGRIAELFSTKTHIG

SEQ ID NO: 1471 - protein, 972 aa, Artificial Sequence
  derived and/or modified protein sequence (wt) from CCHFV(IbAr10200, Artificial)__AF467768.2__Gn-4aa-Gc
SEEPSDDCISRTQLLRTETAEIHGDNYGGPGDKITICNGSTIVDQRLGSELGCYTINRVRSFKLCENSATGKNCEIDSVPVKCRQGYCLRITQEGRGHVKLSRGSEVVLDACDTSCEIMIPKGTGDILVDCSGGQQHFLKDNLIDLGCPKIPLLGKMAIYICRMSNHPKTTMAFLFWFSFGYVITCILCKAIFYLLIIVGTLGKRLKQYRELKPQTCTICETTPVNAIDAEMHDLNCSYNICPYCASRLTSDGLARHVIQCPKRKEKVEETELYLNLERIPWVVRKLLQVSESTGVALKRSSWLIVLLVLFTVSLSPVQSAPIGRKPLFLDSTAKGMKNLLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVGEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFVNLLNIETDYTKNFHFHSKRVTAHGDTPQLDLKARPTYGAGEITVLVEVADMELHTKKIEISGLKFASLACTGCYACSSGISCKVRIHVDEPDELTVHVKSDDPDVVAASSSLMARKLEFGTDSTFKAFSAMPKTSLCFYIVEREHCKSCSEEDTKKCVNTKLEQPQSILIEHKGTIIGKQNSTCTAKASCWLESVKSFFYGLKNMLSGIFGNVFMGIFLFLAPFILLILFFMFGWRILFCFKCCRRTRGLFKYRHLKDDEETGYRRIIEKLNNKKGKNKLLDGERLADRRIAELFSTKTHIG

SEQ ID NO: 1472 - protein, 972 aa, Artificial Sequence
  derived and/or modified protein sequence (wt) from CCHFV(Turkey-Kelkit06, Artificial)__GQ337054.1__Gn-4aa-Gc
SEEPGDDCISRTQLLRTETAEIHDDNYGGPGDKITICNGSTIVDQRLGSELGCYTINRVKSFKLCKNSATGKTCEVDSTPVKCRQGFCLKITQEGRGHVKLSRGSEVVLDACDSSCEVMIPKGTGDILVDCSGGQQHFLKDNLIDLGCPHIPLLGRMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLTVSLSPVQSAPVGRKPLFLDSIVKGMKNLLNSTSLETSLSIEAPWGAINVQSTFKPTVSTANIALSWSSVVHRGNKILVTGRSESIMKLEERTGVSWDLGVEDASESKLLTVSIMDLSQMYSPVFEYLSGDRQVEEWPKATCTGDCPERCGCTSSTCLHKEWSHSRNWRCNPTWCWGVGTGCTCCGVDVKDLFTDHMFVKWKVEYIKTEAIVCVALTSQERQCSLIEAGTRFNLGPVTITLSEPRNIQQKLPPEIITLHPKIEEGFFDLMHVQKVLSASTVCKLQSCTHGIPGDLQVYHIGNLLKGDRVNGHLIHKIESHFNTSWMSWDGCDLDYYCNMGDWPSCTYTGVTQHNHAAFVNLLNIETDYTKTFHFHSKRVTAHGDTPQLDLKARPTYGAGGITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEDDTQKCVDTRLEQPQSILIEHKGTIIGKQNDTCTAKASCWLESVKSFFYGLKNMLGSVFGNLFIGILLFLAPFVLLVLFFMFGWKILFCFKCCRRTRGLFKYRHLKDDEETGYRRIIERLNSKKGKNRLLDGDRLADRKIAELFSTKTHIG

SEQ ID NO: 1473 - protein, 973 aa, Artificial Sequence
  derived and/or modified protein sequence (wt) from CCHFV(SR3, Artificial)__AJ538199.1__Gn-4aa-Gc
SEESGDDCISRTQLLRTETAEVHGDNYGGPGDKITICNGSTVVDQRLGSELGCYTINRVRSFKLCENSATGKSCEIDSIPVKCKQGYCLKITQEGRGHVKLSRGSEVVLDVCDSSCEVMIPKGTGDILVDCSGGQQHFLKDNLVDLGCPKIPLLGKMAIYICRMSNHPKTTMAFLFWFSFGYVITCILCKAIFFLLIIFGTLGKRFKQYRELKPQTCTICETTPVNAIDAEMHDLNCSYNICPYCASRLTSDGLARHVTQCPRRKEKVEETELYLNLERIPWVVRKLLQVSESTGTVLKRSSWLIVLLVLFTVSLSPVQSAPIGLRRPLFLDSIVKGMKNLLNSTSLETSLSIEAPWGAINVQSTYKPTVSTANIALSWSSVEHRGNKVLVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGSVTITLSEPRNIQQKLPPEIITLHPKIEEGFFDLMHVQKVLSASTVCKLQSCTHGVPGDLQVYHIGNLLKGDRVNGHLIHKIEQHFNTSWMSWDGCDLDYYCNMGDWPSCTYTGVTQHNHASFVNLLNIETDYTKTFHFHSKRVTAHGDTPQLDLKARPTYGAGEITVLVEVADMELHTKKIEISGLKFAGLTCTGCYACSSGISCKVRIHVDEPDELTVHVKSDDPDVVAASSSLMARKLEFGTDSTFKAFSAMPKTSLCFYIVEREYCKSCNKEDTQKCVNTKLEQPQSILIEHKGTIIGKQNNTCTAKASCWLESVKSFFYGLKNMLGGIFGNVFIGIFTFLTPFILLILFFMFGWRILFCFKCCRRTRGLFKYRHLKDDEETGYRKIIERLNNKKGKNRLLDGERLADRKIAELFSTKTHIG

SEQ ID NO: 1474 - protein, 973 aa, Artificial Sequence
  derived and/or modified protein sequence (wt) from CCHFV(UCCR4413, Artificial)__KY484038.1__Gn-4aa-Gc
SESSASGCISRTQMIKSETAEIHDDIYGGPGEKLTICNGTTVVDQRLGSELGCYTINRIKTYKLCENSVKEKTCEIDSVPVKCRQGLCLKITQEGRGHVKLSRGSEIVLDICDSSCELMIPKGTGDILVDCSGGQQHFLQDNLVDLGCPNIPLLGKVAIYICRMSNHPKTTMAFLFWFSFGYVITCILCKILFYLLIITGTLGKKLKQYRELKPQTCTICESTPVNAIDAEMHDLNCSYNICPYCASRLTSDGLIRHVNLCPKRKEKVEETELYLNLERIPWFVRKLLQVSESTGVALKRSSWLLILVILLTVSMSPVQSAPINRKPLFLSSIVKGKKNLLNSASLETSLSIEAPWGAINAQSTFKPTISTANIALSWSSVEHRGNKVLVSGRSESIMKLEERTGISWNLGVEDASESRMLTVSVMDLSQMYLPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPSEIVTLHPKIEEGFFDLMHVQKVLSASTVCKLQSCTHGVAGDLQVYHVGNLLKGDKINGHSIHKIEPHLNTSWMSWDGCDLDYYCNMGDWPSCTYTGVTQHNHAAFVNLLNIETDYTKSFHFHSKRVTAHGDTPQLDLKARPMYGAGEITVLVEVADMELHSKNIEISGLKFASLTCSGCYACSSGISCKVRIHVDEPDELAVHVKSDDLDVVAASSSLMARKIEFGTDSTFKAFSSMPKESLCFYIVERDFCKSCAAEDTQKCVKAKLEQPQSILIEHKGTIIGKQNDTCSTKTSCWLESFKSFFYGLKNMLSGVFGSAIMGILLFLAPFILLILFFFFGWRILFCLRCCRRTRGLFKYKHIKDDEEAGYKKIIEKLNNKKGGTSKLLDGERLADRKIAELFSTKAHIG

SEQ ID NO: 1475 - protein, 972 aa, Artificial Sequence
  derived and/or modified protein sequence (wt) from CCHFV(66019, Artificial)__AB069669.1__Gn-4aa-Gc
SEESGDDCISRTQLLRTETAEVHGDNYGGPGDKITICNGSTIVDQRLGSELGCYTINRVKSFKLCENSGTGKSCKIDNTPVKCRQGFCLKITQEGRGHVKLSRGSEVVLDACDSSCEIMIPKGTGDILVDCSGGQQHFLKDNLVDLGCPNIPLLGKMAIYICRMSNHPKTTMAFLFWFSFGYVITCIFCKIIFYLLIVVGTLGKKFKQYRELKPQTCTICETTPTNAIDAEMHDLKCSYNICPYCASRLTSDGLARHVTQCPKRKEKVEETELYLNLERIPWIVRKLLQVSESTGVALKRSSWLIVLLVLLTVSLSPVQSAPIGRKPLFSDSIVKGMKNLLNSTSLETSLSIEAPWGAINVQSTFKPTVSTANIALSWSSVEHRGNKILVSGRSESIMKLEERTGISWDLGVEDASESKLLTVSVMDLSQMYSPVFEYLSGDRQVEEWPKATCTGNCPDRCGCTSSTCLHKEWPHSRNWRCNPTWCWGVGTGCTCCGLDVKDLFTDYMFVKWKVEYIKTEAIVCVELNSQERQCSLIEAGTRFNLGPVTITLSEPRNIQQKLPSEIITLHPRIEEGFFDLMHVQKVLSASTVCKLQSCTHGVPGDLQIYHIGNLLKGDRVNGHLIHKIEPHFNTSWMSWDGCDLDYYCNMGDWPSCTYTGVTQHNHAAFVNLLNIETDYTKNFHFHSKRVTAHGDTPQLDLKARPTYGAGEITVLVEVADMELHTKKIAISGLKFASLTCTGCYACSSGISCKVRIHVDEPDELTVHVKSEDPDIVAASSSLMARKLEFGTDSTFKAFSAMPKTSLCFYIVEREYCESCSKEDTQKCVNTKLEQPQSILIEHKGTIIGKQNDTCTAKASCWLESVKSFFYGLKNMLSGIFGNVFIGIFLFLAPFILLILFFMFGWRILFCFKCCRRTRGLFKYRYLKDDEESGYRRIIERLNNKKGKNKLLDGERLADRRIAELFSTKTHIG

SEQ ID NO: 1476 - protein, 972 aa, Artificial Sequence
  derived and/or modified protein sequence (wt) from CCHFV(7001, Artificial)__AB069670.1__Gn-4aa-Gc
AEGGSSDCISRTQLVKTEVAEIHEDSYGGPGEKITICNGSTIVDQRLGSELGCYTINRVRSYKLCENSASGKSCEIDSIPVKCKQGFCLKITQEGRGHVKLSRGTEIVLDVCDSSCELMIPKGTGDILVDCSGGQQHFLQNNLIDLGCPNVPLLGKMAIYVCRMSNHPKTTMAFLFWFSFGYVITCIACRVLFYLLIAIGTVGKKLKQYRELKPQTCIVCESVPVNAIDAEMHELNCSYNICPYCASRLSTDGLIRHVTQCPKRREKVEETELFLNLERIPWLVRKLLQVSESTGMALKRSCWMITLLILLLVSISPVQSAPVGRKPLFLDNIAKGMKSLLNSTSLETSLSIEAPWGAINVQSTFKPTVSAANIALSWSSVEHRGNKILVSGRSESIMKLEERTGVSWNLGVEDASESKTLTVSVMDLSQMYSPVFEYLSGDRQVEEWPKATCTGDCPERCGCTSSTCLHKEWPHSRNWRCNPTWCWGVGTGCTCCGLDVKDFFTDYMLVKWKVEYIKTEAIVCVELTSQERQCSLIEAGTRFNLGPVTITLSEPRNVQQRLPPEIVTLHPKIEEGFFDLMHVQKILSASTVCKLQSCTHGVPGDFQVYHVGNLLRGDKVNGHSIHKIEPHFNTSWMSWDGCDLDYFCNMGDWPSCTYTGVTQHNRAAFINMLNIETDYTKTFHFHSKRVTAHGDTPQLDLKARPAYGAGEVTVLVEVADLELHTKKLEVSGLKIASLTCSGCYACSSGISCKVRIHVNEPDEFTVHVRSSDPDVVAAGSSLMARKIEFGADSTFKAFSSMPKDSLCFYIVEKDYCSSCTDDDTQKCVNTKLDHPQSILIEHKGTIIGKQNDTCSTKTSCWLESVKGFFYGLKNMLSGIFGNVFLGIFLFLAPFVLLIFFFFFGWRLLFCLKCCRRTRGLLKYKHLKDEEEAGYKKIIERLNGKKGKSQLFDGERLADRKIAELFSTKIHIG

SEQ ID NO: 1477 - protein, 972 aa, Artificial Sequence
  derived and/or modified protein sequence (wt) from CCHFV(75024, Artificial)__AB069671.1__Gn-4aa-Gc
SEESGDDCISRTQLLRTETAEIHGDNYGGPGDKITICNGSTIVDQRLGSEMGCYTINRVKSFKLCENSATGKSCEIDSIPVKCRQGYCLKITQEGRGHVKLSRGSEVVLDACDSSCEVMIPKGTGDILVDCSGGQQHFLKDNLIDLGCPSIPLLGKMAIYICRMSNHPKTTMAFLFWFSFGYVITCILCKAIFYLLIIVGTLGKRFKQYRELKPQTCTICETTPANAIDAEMHDLNCSYNICPYCASRLTSDGLARHVTQCPKRKEKVEETELYLNLERIPWVVRKLLQVSESTGVALKRSSWLIVLLVLFAISLSPVQSAPIGRRPLFLDSIVRGMKNQLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTTSTCLHKEWPHSRNWRCNPTWCWGVGTGCTCCGLDVKDLFTDYMIVKWKVEYIKTEAIVCVELTSQERQCSLIEAGTRFNLGSVTITLSEPRNIQQKLPPEIITLHPRIEEGFFDLMHVQKVLSASTVCKLQSCTHGVPGDLQVYHVGNLLKGDKVNGHLIHKIEPHLNTSWMSWDGCDLDYYCNMGDWPSCTYTGVTQHNHASFVNLLNIETDYTKSFHFHSKRVTAHGDTPQLDLKARPTYGAGEITVLVEVADMEFTPKKIEISGLKFASLTCTGCYACSSGISCKVRIHVDEPDELTVHVKSDDPDVVAASSSLMARKLEFGTDSTFKAFSAMPKTSLCFYIVEREYCKSCSKEDTQKCVNTKLEQPQSILIEHKGTIIGKQNNTCTAKASCWLESVKSFFYGLKNMLSGIFGNLFMGIFLFLAPFILLILFFMFGWRILFCFKCCRRTRGLFKYRHLKDDEETGYRRIIERLNNKKGKNKLLDGERLADRRIAELFSTKTHIG

SEQ ID NO: 1478 - protein, 972 aa, Artificial Sequence
  derived and/or modified protein sequence (wt) from CCHFV(7803, Artificial)__AB069672.1__Gn-4aa-Gc
SEESGDDCISRTQLLRTETAEIHGDNYGGPGDKITICNGSTIVDQRLGSEMGCYTINRVKSFKLCENSATGKSCEIDSIPVKCRQGYCLKITQEGRGHVKLSRGSEVILDACDSSCEVMIPKGTGDILVDCSGGQQHFLKDNLIDLGCPSIPLLGKMAIYICRMSNHPKTTMAFLFWFSFGYVITCILCKAIFYLLIIVGTLGKRFKQYRELKPQTCTICETTPANAIDAEMHDLNCSYNICPYCASRLTSDGLARHVTQCPKRKEKVEETELYLNLERIPWVVRKLLQVSESTGVALKRSSWLIVLLVLFAISLSPVQSAPISRRPLFLDSIVRGMKNPLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTTSTCLHKEWPHSRNWRCNPTWCWGVGTGCTCCGLDVKDLFTDYMIVKWKVEYIKTRGIVCVELTSQERQCSLIEAGTRFNLGSVTITLSEPRNIQQKLPPEIITLHPRIEEGFFDLMHVQKVLSASTVCKLQSCTHGVPGDLQVYHVGNLLKGDKVNGHLIHKIEPHLNTSWMSWDGCDLDYYCNMGDWPSCTYTGVTQHNHASFVNLLNIETDYTKSFHFHSKRVTAHGDTPQLDLKARPTYGAGEITVLVEVADMEFTPKKIEISGLKFASLTCTGCYACSSGISCKVRIHVDEPDELTVHVKSDDPDVVAASSSLMARKLEFGTDSTFKAFSAMPKTSLCFYIVEREYCKSCSKEDTQKCVNTKLEQPQSILIEHKGTIIGKQNNTCTAKASCWLESVKSFFYGLKNMLSGIFGNFFMGIFLFLAPFILLILFFMFGWRILFCFKCCRRTRGLFKYRHLKDDEETGYRRIIERLNNKKGKNKLLDGERLADRRIAELFSTKTHIG

SEQ ID NO: 1479 - protein, 972 aa, Artificial Sequence
  derived and/or modified protein sequence (wt) from CCHFV(79121, Artificial)__AB069673.1__Gn-4aa-Gc
AEGGSSDCISRTQLVKTEVAEIHEDSYGGPGEKITICNGSTIVDQGLGSELGCYTINRVRSYKLCENSASGKSCEIDSIPVKCKQGFCLKITQEGRGHVKLSRGTEIVLDVCDSSCELMIPKGTGDILVDCSGGQQHFLQNNLIDLGCPNVPLLGKMAIYVCRMSNHPKTTMAFLFWFSFGYVITCIACRVLFYLLIAIGTVGKKLKQYRELKPQTCIVCESVPVNAIDAEMHELNCSYNICPYCASRLSTDGLIRHVTQCPKRREKVEETELFLNLERIPWLVRKLLQVSESTGMALKRSCWMITLLILLLVSISPVQSAPVGRKPLFLDSTAKGMKSLLNSTSLETSLSIEAPWGAINVQSTFKPTVSAANIALSWSSVEHRGNKILVSGRSESIMKLEERTGVSWNLGVEDASESKTLTVSVMDLSQMYSPVFEYLSGDRQVEEWPKATCTGDCPERCGCTSSTCLHKEWPHSRNWRCNPTWCWGVGTGCTCCGLDVKDFFTDYMLVKWKVEYIKTEAIVCVELTSQERQCSLIEAGTRFNLGPVTITLSEPRNVQQRLPPEIVTLHPKIEEGFFDLMHVQKILSASTVCKLQSCTHGVPGDFQIYHVGNLLRGDKVNGHSIHKIEPHFNTSWMSWDGCDLDYFCNMGDWPSCTYTGVTQHNRAAFINMLNIETDYTKTFHFHSKRVTAHGDTPQLDLKARPAYGAGEVTVLVEVADLELHTKNLEVSGLKIASLTCSGCYACSSGISCKVRIHVNEPDEFTVHVRSSDPDVVAAGSSLMARKIEFGADSTFKAFSSMPKDSLCFYIVEKDYCSSCTDDDTQKCVNTKLDHPQSILIEHKGTIIGKQNDTCSTKTSCWLESVKGFFYGLKNMLSGIFGNVFLGIFLFLAPFVLLIFFFFFGWRLLFCLKCCRRTRGLLKYKHLKDEEEAGYKKIIERLNGKKGKSQLFDGERLADRKIAELFSTKIHIG

SEQ ID NO: 1480 - protein, 972 aa, Artificial Sequence
  derived and/or modified protein sequence (wt) from CCHFV(8402, Artificial)__AB069674.1__Gn-4aa-Gc
SEESGDDCISRTQLLRTETAEIHNDNYGGPGDKITICNGSTVVDQRLGSELGCYTINRVKSFKLCENSATGKSCEIDSTPVKCRQGFCLKITQEGRGHVKLSRGSEVVLDACDSSCEIMIPKGTGDILVDCSGGQQHFLKDNLIDLGCPNIPLLGKMAIYICRMSNHPKTTMAFLFWFSFGYVVTCILCKVIFYLLIVVGTLGKKFKQYRELKPQTCTICETTPVNAIDAEMHDLNCSYNICPYCASRLTSDGLARHVMQCPKRKEKIEETELYLNLERIPWVVRKLLQVSESTGVALKRSSWLVVLLVLLTVSLSPVQSAPIGRKPLFSDSIVKGMKNLLNSTSLETSLSIEAPWGAINVQSTFKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFIKWKVEYIKTEAIVCVELTSQERQCTLIEAGTRFNLGPVTITLSEPRNIQQKLPPEIVTLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHAAFVNMLNIETDYTKNFHFHSKRVTAHGDTPQLDLKARPTYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSKEDTQKCVNTKLEQPQSILIEHKGTIIGKQSNTCTAKASCWLESVKSFFYGLKNMLSGIFGNVFIGVFLFFAPFILLILFFMFGWRILFCFKCCRRTRGLFKYRHLKDDEETGYRKIIERLNNKKGKNKLLDGERLADRKIAELFSTKTHIG

SEQ ID NO: 1481 - protein, 972 aa, Artificial Sequence
  derived and/or modified protein sequence (wt) from CCHFV(88166, Artificial)__AB069675.1__Gn-4aa-Gc
SEESGDDCISRTQLLRTETAEIHSDNYGGPGDKITICNGSTVVDQRLGSELGCYTINRVKSFKLCENSATGKSCEIDSTPVKCRQGFCLKITQEGRGHVKLSRGSEVVLDACDSSCEIMIPKGTGDILVDCSGGQQHFLKDNLIDLGCPNIPLLGKMAIYICRMSNHPKTTMGFLFWFSFGYVVTCILCKVIFYLLIVVGTLGKKFKQYRELKPQTCTICETTPVNAIDAEMHDLNCSYNICPYCASRLTSDGLARHVMQCPKRKEKIEETELYLNLERIPWVVRKLLQVSESTGVALKRSSWLVVLLVLLTVSLSPVQSAPIGRKPLFSDSIVKGMKNLLNSTSLETSLSIEAPWGAINVQSTFKPTMSAANIALSWSSVEHRGNKILVSGRSESIMKLEERTGISWNLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFIKWKVEYIKTEAIVCVELTSQERQCTLIEAGTRFNLGPVTITLSEPRNIQQKLPPEIVTLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHAAFVNMLNIETDYTKNFHFHSKRVTAHGDTPQLDLKARPTYGAGEITVLVEVADMELHTKKIEISGLKFASLTCTGCYACSSGISCKVRIHVDEPDELTVHVKSEDPDLVAASSSLMARKLEFGTDSTFKAFSAMPKTSLCFYIVEREYCKSCSKEDTQKCVNTKLEQPQSILIEHKGTIIGKQNNTCTAKASCWLESVKSFFYGLKNMLSGIFGNVFIGVFLFFAPFILLILFFMFGWRILFCFKCCRRTRGLFKYRHLKDDEETGYRKIIERLNNKKGKNKLLDGERLADRKIAELFSTKTHIG

SEQ ID NO: 1482 - protein, 972 aa, Artificial Sequence
  derived and/or modified protein sequence (wt) from CCHFV(BA88166, Artificial)__AF338470.1__Gn-4aa-Gc
SEESGDDCISRTQLLRTETAEIHSDNYGGPGDKITICNGSTVVDQRLGSELGCYTINRVKSFKLCENSATGKSCEIDSTPVKCRQGFCLKITQEGRGHVKLSRGSEVVLDACDSSCEIMIPKGTGDILVDCSGGQQHFLKDNLIDLGCPNIPLLGKMAIYICRMSNHPKTTMGFLFWFSFGYVVTCILCKGIFYLLIVVGTLGKKFKQYRELKPQTCTICETTPVNAIDAEMHDLNCSYNICPYCASRLTSDGLARHVMQCPKRKEKIEETELYLNLERIPWVVRKLLQVSESTGVALKRSSWLVVLLVLLTVSLSPVQSAPIGRKPLYLDSIVKGMKNLLNSTSLETSLSIEAPWGAINVQSTFKPTMSAANIALSWSSVEHRGNKILVSGRSESIMKLEERTGISWNLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFIKWKVEYIKTEAIVCVELTSQERQCTLIEAGTRFNLGPVIITLSEPRNIQQKLPPEIVTLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHAAFVNMLNIETDYTKNFHFHSKRVTAHGDTPQLDLKARPTYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSKEDTQKCVNTKLEQPQSILIEHKGTIIGKQNNTCTAKASCWLESVKSFFYGLKNMLSGIFGNVFIGVFLFFAPFILLILFFMFGWRILFCFKCCRRTRGLFKYRHLKDDEETGYRKIIERLNNKKGKNKLLDGERLADRKIAELFSTKTHIG

SEQ ID NO: 1483 - protein, 972 aa, Artificial Sequence
  derived and/or modified protein sequence (wt) from CCHFV(BA66019, Artificial)__AF350448.1__Gn-4aa-Gc
SEESGDDCISRTQLLRTETAEVHGDNYGGPGDKITICNGSTIVDQRLGSELGCYTINRVKSFKLCENSGTGKSCKIDKHPVKCRQGFCLKITQEGRGHVKLSRGSEVVLDACDSSCEIMIPKGTGDILVDCSGGQQHFLKDNLVDLGCPNIPLLGKMAIYICRMSNHPKTTMAFLFWFSFGYVITCIFCKIIFYLLIVVGTLGKKFKQYRELKPQTCTICETTPTNAIDAEMHDLKCSYNICPYCASRLTSDGLARHVTQCPKRKEKVEETELYLNLERIPWIVRKLLQVSESTGVALKRSSWLIVLLVLLTVSLSPVQSAPIGRKPLFSDSIVKGMKNLLNSTSLETSLSIEAPWGAINVQSTFKPTVSTANIALSWSSVEHRGNKILVSGRSESIMKLEERTGISWDLGVEDASESKLLTVSVMDLSQMYSPVFEYLSGDRQVEEWPKATCTGDCPDRCGCTSSTCLHKEWPHSRNWRCNPTWCWGVGTGCTCCGLDVKDLFTDYMFVKWKVEYIKTEAIVCVELNSQERQCSLIEAGTRFNLGPVTITLSEPRNIQQKLPPEIITLHPRIEEGFFDLMHVQKVLSASTVCKLQSCTHGVPGDLQIYHIGNLLKGDRVNGHLIHKIEPHFNTSWMSWDGCDLDYYCNMGDWPSCTYTGVTQHNHAAFVNLLNIETDYTKNFHFHSKRVTAHGDTPQLDLKARPTYGAGEITVLVEVADMELHTKKIAISGLKFASLTCTGCYACSSGISCKVRIHVDEPDELTVHVKSEDPDIVAASSSLMARKLEFGTDSTFKAFSAMPKTSLCFYIVEREYCESCSKEDTQKCVNTKLEQPQSILIEHKGTIIGKQNDTCTAKASCWLESVKSFFYGLKNMLSGIFGNVFIGIFLFLAPFILLILFFMFGWRILFCFKCCRRTRGLFKYRYLKDDEESGYRRIIERLNNKKGKNKLLDGERLADRRIAELFSTKTHIG

SEQ ID NO: 1484 - protein, 972 aa, Artificial Sequence
  derived and/or modified protein sequence (wt) from CCHFV(BA8402, Artificial)__AF350449.1__Gn-4aa-Gc
SEESGDDCISRTQLLRTETAEIHNDNYGGPGDKITICNGSTVVDQRLGSELGCYTINRVNSFNLCENTATGKSCEIDSTPVKCRQGFCLKITQEGRGHVKLSRGSEVVLDACESSCEIMIPKGTGDILVDCSGGQQHFLKDNLIDLGCPNIPLLGKMAIYICRMSNHPKTTMAFLFWFSFGYVVTCILCKVIFYLLIVVGTLGKKFKQYRELKPQTCTICETTPVNAIDAEMHDLNCSYNICPYCASRPTSDGLARHVMQCPKRKEKIEETALYLNLERIPWVVRKLLQVSESTGVALKRSSWLVVLLVLLTVSLSPVQSAPIGRKPLFSDSIVKGMKNLLNSTSLETSLSIEAPWGAINVQSTFKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFIKWKVEYIKTEAIVCVELTSQERQCTLIEAGTRFNLGPVTITLSEPRNIQQKLPPEIVTLHPRIEEGFFDLMHVQKVLSASTVCKLQSCTHGVPGDLQVYHIGNLLKGDKVNGHLIHKIEPHFNTSWMSWDGCDLHYYCNMGDWPSCTYTGVTQHNHAAFVNMLNIETDYTKNFHFHSKRVTAHGDTPQLDLKARPTYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCESCSKEDTQKCVNTKLEQPQSILIEHKGTIIGKQSNTCTAKASCWLESVKSFFYGLKNMLSGIFGNVFIGVFLFFAPFILLILFFMFGWRILFCFKCCRRTRGLFKYRHLKDDEETGYRKIIERLNNKKGKNKLLDGERLADRKIAELFSTKTHIG

SEQ ID NO: 1485 - protein, 972 aa, Artificial Sequence
  derived and/or modified protein sequence (wt) from CCHFV(Matin, Artificial)__AF467769.2__Gn-4aa-Gc
SEESGDDCISRTQLLRTETAEIHSDSYGGPGDKITICNGSTVVDQRLGSELGCYTINRVKSFKLCENSATGKSCEIDSTPVKCRQGFCLKITQEGRGHVKLSRGSEVVLDACDSSCEIMIPKGTGDILVDCSGGQQHFLKDNLIDLGCPNIPLLGKMAIYICRMSNHPKTTMVFLFWFSFGYVITCILCKVIFYLLIVVGTLGKKFKQYRELKPQTCTICETTPVNAIDAEMHDLNCSYNICPYCASRLTSDGLARHVMQCPKRKEKIEETELYLNLERIPWVVRKLLQVSESTGVALKRSSWLVVLLVLLTVSLSPVQSAPIGRKPLFLDSIIKGMKNLLNSTSLETSLSIEAPWGAINVQSTFKPTMSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEVIVCVELTSQERQCSLIEAGTRFNLGPVTITLSEPRNIQQKLPPEIVTLHPRIEEGFFDLMHVQKVLSASTVCKLQSCTHGVPGDLQVYHIGNLLKGDKVNGHLIHKIEPHFNTSWMSWDGCDLDYYCNMGDWPSCSYTGVTQHNHAAFVNMLSIETDYTKNFHFHSKRVTAHGDTPQLDLKARPTYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSKEDTQKCVNTKLEQPQSILIEHKGTIIGKQNDTCTAKASCWLESVKSFFYGLKNMLSGIFGNVFIGIFLFLAPFALLILFFMFGWRILFCFKCCRRTRGLFKYRHLKDDEETGYRKIIERLNNKKGKNKLLDGERLADRKIAELFSTKTHVG

SEQ ID NO: 1486 - protein, 972 aa, Artificial Sequence
  derived and/or modified protein sequence (wt) from CCHFV(Baghdad 12, Artificial)__AJ538197.2__Gn-4aa-Gc
SEESGDDCISRTRLLRTETAEIHGDSYGGPGDKITICNGSTIVDQRLGSEMGCYTINRVKSFKLCENSATGKSCKIDSIPVKCRQGYCLKITQEGRGHVKLSRGSEVVLDACDSSCEVMIPKGTGDILVDCSGGQQHFLKDNLIDLGCPNIPLLGKMAIYICRMSNHPKTTMAFLFWFSFGYVITCILCKAIFYLLIIVGTLGKRFKQYRELKPQTCTICETTPVNAIDAEMHDLNCSYNICPYCASRLTSDGLARHVTQCPKRKEKVEETELYLNLERIPWVVRKLLQVSESTGVALKRSSWLIVLLVLLAVSSSPVQSAPIGRKPLFLDSIVKGTKNLLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTTSTCLHKEWPHSRNWRCNPTWCWGVGTGCTCCGLDVKDLFTDYMFVKWKVEYIKTDAIVCVELTSQERQCSLIEAGTRFNLGSVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFVNLLNIETDYTKSFHFHSKRVTAHGDTPQLDLKVRPTYGAGEITVLVEVADMELHTKKIEISGLKFASLTCTGCYACSSGISCKVRIHVDEPDELTVHVKSDDPDVVAASSSLMARKLEFGTDSTFKAFSAMPKTSLCFYIVEREYCKSCSKEDTQKCVNTKLEQPQSILIEHKGTIIGKQNNTCTAKTSCWLESVKSFFYGLKNMLSGIFGNFFMGIFLFLAPFILLILFFMFGWRILFCFKCCRRTRGLFKYRHLKDDEETGYRRIIERLNNKKGKNKLLDGERLADRRIAELFSTKTHIG

SEQ ID NO: 1487 - protein, 972 aa, Artificial Sequence
  derived and/or modified protein sequence (wt) from CCHFV(VLG/TI29414, Artificial)__AY179961.1__Gn-4aa-Gc
SEEPGDDCISRTQLLRAEPAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVPQCPKRKEKVEETELYLNLERIPWNVRKLLQVSESTGVALKRSSWLIVLLVLLTVSLSPVQSAPVGRKPLFLDSIVKGMKNLLNSTNLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWEVGTGCTCCGWNVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRVNGHLIHKIEPHFNTSWMSWDGCDLDYYCNMGDWPSCTYTGMTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSNDPDVIAASTSLMARKLEFGTDSTFKAFSAMPKTSLCFYIAEREYCKSCSEEDTQKCVDTKLEQPQSILIEHKGTIIGKQNDTCTAKASCWLESVKSFFYGLKNMLGSVFGNFFIGILLFLAPFVLLVLFFMFGWKILFCFKCCRRTRGLLKYRLLKDDEETGYRRIIERLNNKKGKNRLLDGERLADRKIAELFSTKTHIG

SEQ ID NO: 1488 - protein, 972 aa, Artificial Sequence
  derived and/or modified protein sequence (wt) from CCHFV(TADJ/HU8966, Artificial)__AY179962.1__Gn-4aa-Gc
SEESGDDCISRTQLLRTETAEIHGDDYGGPGDKITICNGSTIVDQRLGSELGCYTINRVKSFKLCENSATGKNCEIDSVPVKCRQGYCLKITQEGRGHVKLSRGSEVVLDACDSSCEVMIPKGTGDISVDCSGGQQHFLKDNLIDLGCPKIPLLGKMAIYICRMSNHPKTTMAFLFWFSFGYVITRILCKAIFYLLIIVGTLGKRFKQYRELKPQTCTICETTPANAIDAEMHDLNCSYNICPYCASRLTSDGLARHVTQCPKRKERVEETELYLNLERIPWIVRKLLQVSESTGVALKRSSWLIVLLVLFTVSLSPVQSAPIGRRPLFLDSIVKGMKNPLNSTSLETSLSIEAPWGAINVQSTYKPTVSTANIALSWSSIEHRGNNILVSGRSESIMKLEERTGISGDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFIDYMFVKWKVDYIKTEAIVCVELTSQERQCSLVEAGTRFNLGPVTITLSEPRNIQQKLPPEIITLHPRIEEGFFDLMHVQKVLSASTVCKLQSCTHGVPGDLQVYHIGNLLKGDKENGHLIHKIEPHFNTSWMSWDGCDLDYYCNMGDWPSCTYTGVTQHNHASFVNLLNIETDYTKSFHFHSKRVTAHGDTPQLDLKARPTYGAGEITVLVEVADMELHTKKIEITGLKFASLTCTGCYACSSGISCKVRIHVDEPDELTVHVKSDDPDVVAASSSLMARKLEFGTDSTFKAFSAMPKTSLCFYIVEREYRKSCSKEDTQKCVNTKLEQPQSILIEHKGTIIGKQNNTCTAKASCWLESVKSFFYGLKNMLSGIFGNVFVGIFLFLAPFILLILFFMFGWRILSCFKCCRRTRGLLKHRHLKDDEETGYRRIIERLNNKKGKNKLLDGERLADRRIAELFSTKTHIG

SEQ ID NO: 1489 - protein, 972 aa, Artificial Sequence
  derived and/or modified protein sequence (wt) from CCHFV(Hodzha, Artificial)__AY223476.1__Gn-4aa-Gc
SEESGDDCISRTQLLRTETAEIHGDDYGGPGDKITICNGSTIVDQRLGSELGCYTINRVKSFKLCKNSATGKSCEIDSTPVKCRQGYCLKITQEGRGHVKLSRGSEVVLDACDSSCEVMIPKGTGDILVDCSGGQQHFLKDNLIDLGCPRIPLLGKMAIYICRMSNHPKTTMAFLFWFSFGYVITCILCKAIFYLLIIVGTLGKRFKQYRELKPQTCTICETTPANAIDAEMHDLNCSYNICPYCASRLTSDGLARHVTQCPKRKEKVEETELYLNLERIPWIVRKLLQVSESTGVALKRSSWLIVLLVLFAVSLSPVQSAPIGRRPLFLDSIVKGTKNLLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVDYIKTEAIVCVELTSQERQCSLVEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFVNLLNIETDYTKSFHFHSKRVTAHGDTPQLDLKARPTYGAGEITVLVEVADMELHTKKIEITGLKFASLTCTGCYACSSGISCKVRIHVDEPDELTVHVKSDDPDVVAASSSLMARKLEFGTDSTFKAFSAMPKTSLCFYIVEREYCKSCSKEDTQKCVNTKLEQPQSILIERKGTIIGKQNNTCTAKASCWLESVKSFFYGLKNMLSGIFGNVFVGIFLFLAPFILLILFFMFGWRILFCFKCCRRTRGLFKYKHLKDDEETGYRRIIERLNNKKGKNKLLDGERLADRRIAELFSTKTHIG

SEQ ID NO: 1490 - protein, 972 aa, Artificial Sequence
  derived and/or modified protein sequence (wt) from CCHFV(Kosovo/9553/2001, Artificial)__AY675511.1__Gn-4aa-Gc
SEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYIARMSNHPKTTMAFLFWFSLGYVITCILCKALFYSLIIIGTLGKKIKQYRELKPQTCTICETAPVNAIDAEMHDLNCSYNICPYCASRLTSDGLARHVKQCPKRKEKVEETELYLNLERIPWVVRKLLQVSESTGVALKRSSWLIVLLVLLTVSLSPVQSAPVGRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEKEYCKSCSEDDTKKCVDTKLEQPQSILIEHRGTIIGKPNDTCPAKTSCWLESVKSFFYGLKNMLGSVFGNFFIGILLFLAPFFLWMLSFMFGWKILFCFKCCRRTRGLFKYRHLKDDEETGYRRIIERLNNKKGKNRLLDGERLADRKIAELFSTKTHIG

SEQ ID NO: 1491 - protein, 972 aa, Artificial Sequence
  derived and/or modified protein sequence (wt) from CCHFV(SPU41/84, Artificial)__AY900142.1__Gn-4aa-Gc
SEESSDDCISRTQLLRTETAEIHGDNYGGPGDKITICNGSTVVDQRLGSELGCYTINRVKTFKLCENSATGKSCEIDSVPVKCRQGYCLKITQEGRGHVKLSRGSEVVLDACDTSCEVMIPKGTGDILVDCSGGQQHFLKDNLIDLGCPKIPLLGKMAIYICRMSNHPKTTMAFLFWFSFGYVITCIICKVIFYLLIIVGTLGKRFKQYRELKPQTCTICETTPVNAIDAEMHDLNCSYNICPYCASRLTSDGLARHVTQCPKRKEKVEETELYLNLERIPWVVRKLLQVSESTGVALKRSSWLVVLLVLLTVSLSPVQSAPISRRPLFLDSIVKGMKNLLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLVHKIEPHFNTSWMSWDGCDLDYYCNMGDWPSCTYTGVTQHNHASFVNMLNIETDYTKNFHFHSKRVTAHGDTPQLDLKARPTYGAGEITVLVEVADMELHTKKIEISGLKFTSLTCTGCYACSSGISCKVRIHVDEPDELTVHVKSEDPDVVAASSSLMARKLEFGTDSTFKAFSAMPKTSLCFYIVEREYCKSCSEEDTQKCVNTKLEQPQSILIERKGTIIGKQNNTCKAKAGCWLESVKSFFYGLKNMLSGIFGNVFIGIFLFLAPFILLILFFMFGWRILFCFKCCRRTRGLFKYRHLKDDEETGYRKIIERLNNKKGKNKLLDGERLADRRIAELFSTKTHIG

SEQ ID NO: 1492 - protein, 972 aa, Artificial Sequence
  derived and/or modified protein sequence (wt) from CCHFV(UG3010, Artificial)__AY900143.1__Gn-4aa-Gc
AEGVSNDCVSRTQLIKTEVAEIHEDSYGGPGEKITICNGSTIVDQRLGSELGCYTINRVKTYKLCENSATEKGCEIDSVPVKCKQGFCLKVTQEGRGHVKLSRGTEIVLDVCDTSCELMIPKGTGDILVDCSGGQQHFLQDNLIDLGCPNVPLLGKMAIYICRMSNHPKTTMAFLFWFSFGYVITCIVCKVLFYLLIVIGTLSKKLKQYRELKPQTCIVCESTPVNAIDAEMHELNCNYNICPYCASRLTSDGLVRHVNQCPKRKEKVEETELYLNLERIPWLVRRLLQVSESTGMALKRSCWMTTLLILLVVSLSPVQSAPVGRKPLYLDSIAKGMKSLLNSTNLETSLSIEAPWGAINVQSTFKPTVSAANIALSWSSVEHRGNKILVSGRSESIMKLEERTGISWSLGVEDASESKTLTVSVMDLSQMYSPVFEYLSGDRQVEEWPKATCTGDCQERCGCTSSTCLHKEWPHSRNWRCNPTWCWGVGTGCTCCGLDVRDLFTDYMMVKWKVEYVKTEAIMCVELTSQERQCSLIEAGTRFNLGPVTITLSEPRNIQQRLPSEIVTLHPKIEEGFFDLMHVQKVLSASTVCKLQSCTHGVPGDLQVYHVGNLLKGDKVNGHSIHKIESHFNTSWMSWDGCDLDYFCNMGDWPSCTYTGVTQHNRAAFINMLNIETDYTKTFHFHSKRVTAHGDTPQLDLKARPTYGAGEVTVLVEVADLELHTKKIEVSGLKFASLTCSGCYACSSGISCKVRIHVNEPDEFTVHVKSSDPDVVAAGSSLMARKIEFGADSTFKAFSSMPKNSLCFYIVERDYCSSCTNDDTQKCVDTKLEHPQSILIEHKGTIIGKQNDTCSTKTSCWLESVKSFFYGLKNMLGGIFGNVFLGIFLFLAPFALLIFFFFFGWRLLFCLKCCRRTRGLLKYKQLKDEEEAGYKKIIERLNDKKGKSRLFDGERLADRKIAELFSTKTHIG

SEQ ID NO: 1493 - protein, 972 aa, Artificial Sequence
  derived and/or modified protein sequence (wt) from CCHFV(Hy13, Artificial)__AY900145.1__Gn-4aa-Gc
SEESGDDCISRTQLSRTETAEIHSDNYGGPGDKITICNGSTIVDQRLGSELGCYTINRVKSFKLCENSATGKSCEIDSTPIKCRQGFCLKITQEGRGHVKLSRGSEVVLDACDSSCEIMIPKGTGDILVDCSGGQQHFLKDNLIDLGCPNIPLLGKMAIYICRMSNHPKTTMAFLFWFSFGYVITCILCKVIFYLLIVVGTLGKKFKQYRELKPQTCTICETTPVNAIDAEMHDLNCSYNICPYCASRLTSDGLARHVMQCPKRKEKVEETELYLNLERIPWVVRKLLQVSESTGVALKRSSWLVVLLVLLTVSLSPVQSAPIGRKPLFSDSIVKGMKNLLNSTSLETSLSIEAPWGAINVQSTFKPTVSAANIALSWSSVEHRGNKILVSGRSESIMKLEERTGISWDLGVEDASESKLLTVSIMDLSQMYSPVFEYLSGDRQVEEWPKATCTGDCPERCGCTSSTCLHKEWPHSRNWRCNPTWCWGVGTGCTCCGLDVKDLFTDHMFVKWKVEYIKTEAIVCVELTSQERQCSLIEAGTRFNLGPVTITLSEPRNIQQKLPPEIVTLHPRIEEGFFDLMHVKKVLSASTVCKLQSCTHGVPGDLQVYHIGNLLKGDKVNGHLIHKIEPHFNTSWMSWDGCDLDYYCNMGDWPSCSYTGVTQHNHAAFVNMLNIETDYTKIFHFHSKRVTAHGDTPQLDLKARPTYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSKEDTQKCVNTKLEQPQSILIEHKGTIIGKQNDTCTSKAGCWLESVKSFFYGLKNMLSGIFGNVFIGIFLFLAPFILLILFFMFGWRILFCFKCCRRTRGLFKYRHLKDDEETGYRKIIERLNNKKGKNKLLDGERLADRKIAELFSTKTHIG

SEQ ID NO: 1494 - protein, 972 aa, Artificial Sequence
  derived and/or modified protein sequence (wt) from CCHFV(Semunya, Artificial)__DQ094832.1__Gn-4aa-Gc
AEGVSNDCVSRTQLIKTEVAEIHEDSYGGPGEKITICNGSTIVDQRLGSELGCYTINRVKTYKLCENSATEKGCEIDSVPVKCKQGFCLKVTQEGRGHVKLSRGTEIVLDVCDTSCELMIPKGTGDILVDCSGGQQHFLQDNLIDLGCPNVPLLGKMAIYICRMSNHPKTTMAFLFWFSFGYVITCVVCKVLFYLLIVIGTLGKKLKQYRELKPQTCIVCESIPVNAIDAEMHELNCNYNICPYCASRLTSDGLVRHVTQCPKRKEKVEETELYLNLERIPWLVRRLLQVSESTGMALKRSCWMTTLLILLVVSLSPVQSAPVGRKPLFLDSIAKGKKSLLNSTNLETSLSIEAPWGAINVQSTFKPTVSAANIALSWSSVEHRGNKILVSGRSESIMKLEERTGISWSLGVEDASESKTLTVSVMDLSQMYSPVFEYLSGDRQVEEWPKATCTGDCPERCGCTSSTCLHKEWPHSRNWRCNPTWCWGVGTGCTCCGLDVRDLFTDYMMVKWKVEYVKTEAIMCVELTSQERQCSLIEAGTRFNLGPVTITLSEPRNVQQRLPSEIVTLHPKIEEGFFDLMHVQKVLFCKYSLQATSCTHGVPGDLQVYHVGNLLKGDKVNGHSIHKIESHFNTSWMSWDGCDLDYFCNMGDWPSCTYTGVTQHNRAAFVNMLNIETDYTKTFHFHSKRVTAHGDTPQLDLKARPTYGAGEVTVLVEVADLELHTKKIEVSGLKFASLTCSGCYACSSGISCKVRIHVNEPDEFTVHVKSNDPDVVAAGSSLMARKIEFGADSTFKAFSSMPKNSLCFYIVERDYCSSCTDDDTQKCVNIKLEHPQSILIEHKGTIIGKQNDTCPTKTSCWLESVKSFFYGLKNMLGGIFGNVFLGIFLFLAPFALLILFFFFGWRLLFCLKCCRRTRGLLKYKQLKDEEEAGYKKIIERLNDKKGKSRLFDGERLADRKIAKLFSTKTHIG

SEQ ID NO: 1495 - protein, 972 aa, Artificial Sequence
  derived and/or modified protein sequence (wt) from CCHFV(SPU128/81/7, Artificial)__DQ157174.1__Gn-4aa-Gc
SEEPSDDCISRTQLLRTETAEIHGDNYGGPGDKITICNGSTIVDQRLGSELGCYTINRVKSFKLCENSATGKSCEIESVPVKCRQGYCLRITQEGRGHVKLSRGSEVVLDACDTSCEIMIPKGTGDILVDCSGGQQHFLKDNLIDLGCPKIPLLGKMAIYICRMSNHPKTTMAFLFWFSFGYVITCILCKAIFYLLIIIGTLGKRFKQYRELKPQTCTICETTPVNAIDAEMHDLNCSYNICPYCASRLTSDGLARHVTQCPKRKEKVEETELYLNLERIPWVVRKLLQVSESTGVALKRSSWLIVLLVLFTVSLSPVQSAPIGRKPLFLDSIVKGMKNLLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFVNLLNIETDYTKNFHFHSKRVTAHGDTPQLDLKARPTYGAGEITVLVEVADMELHTKKIEISGLKFASLTCTGCYACSSGISCKVRIHVDEPDELTVHVKSDDPDVVAASSSLMARKLEFGTDSTFKAFSAMPKTSLCFYIVEREHCKSCSEEDTKKCVNTKLEQPQSILIEHKGTIIGKQNSTCTAKASCWLESVKSFFYGLKNMLSGIFGNVFIGIFLFLGPFILLILFFMFGWRILFCFKCCRRTRGLLKYRHLKEDEETGYRRIIERLNNKKGKNKLLDGERLADRRIAELFSTKTHIG

SEQ ID NO: 1496 - protein, 972 aa, Artificial Sequence
  derived and/or modified protein sequence (wt) from CCHFV(ROS/HUVLV-100, Artificial)__DQ206448.1__Gn-4aa-Gc
SEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVGRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEEDTQKCVDTKLEQPQSILIEHKGTIIGKQNDTCTAKASCWLESVKSFFYGLKNMLGSVFGNFFIGILLFLAPFVLLVLFFMFGWKILFCFKCCRRTRGLLKYRLLKDDEETGYRRIIERLNNKKGKNRLLDGERLADRKIAELFSTKTHIG

SEQ ID NO: 1497 - protein, 972 aa, Artificial Sequence
  derived and/or modified protein sequence (wt) from CCHFV(AP92, Artificial)__DQ211625.1__Gn-4aa-Gc
SEGGDGGCISRTQLIKTETAEVHGDDYGGPGEKITICNGSTIVDQRLGSELGCYTINRIKSFKLCENSAQGKNCEIDSAPVQCRQGYCLKISQEGRGHVKLSRGSEIVLDVCDTSCEIMIPKGTGDILVDCSGGQQHFLQSNLVDLGCPNIPLLGKMAIYICRMSNHPKTTMAFLFWFSFGYVITCILCKTLFYILIIIGTLGKKLKQYRELKPQTCTICESVPVNAIDAEMHDLNCSYNICPYCASRLTSEGLTRHVNQCPKRKEKVEETELYLNLERIPWIVRKLLQVSESTGVALKRSSWMIVLLILLIVSMSPVQSAPISRKPLFLDSIAKGVKNLLNSTSLETSLSIEAPWGAINAQSTYKPTASSANIALTWSSVEHRGNKILVSGRSESIMKLEERTGISWNLGVEDASESRTLTISVMDLSQMYSPVFEYLSGDRQVEEWPKATCTGNCPERCGCTSSTCLYKEWPHSRNWRCNPTWCWGVGTGCTCCGLDVKELFTDHMLVKWKVEYIKTEAIVCVELTSQERQCSLIEAGTRFSLGPVTITLSEPRNIQQKLPPELITLHPKIEDGYFDLMHVQKVMSASTVCKLQSCTHGVPGDLQIYHVGNLLKGDRVNGHLIHKVEPHLNTSWMSWDGCDLDYFCNMGDWPSCTYTGVTQHNHAAFANLLNIETDYTKTFHFHSKRVTAHGDTPQLDLKARPRYGAGEITVLVEVADMELHTKKVEVTGLKFASLTCSGCYACSSGISCKVRIHVDEPDELTVHVKSSDPDIVAASSSLMARKIEFGVDSTFKAFSSMPKDSLCFYIVERDYCNSCKNEETQRCVNAKLEQPQSILIEHTGTIIGKQNDTCGSRTSCWLDSFKSFFYGLKSMLSGIFGNVFLGIFLFLAPFALLLFFFFFGWRILFCFKCCRRTRGLFKYRHIKDDEEVGYKKIIERLNNKKGKHRLLDGERLADRKIAELFSTKTHIG

SEQ ID NO: 1498 - protein, 972 aa, Artificial Sequence
  derived and/or modified protein sequence (wt) from CCHFV(ArD8194, Artificial)__DQ211626.1__Gn-4aa-Gc
AEGGSNDCVSRTQLVKTEVAEIHEDSYGGPGEKITICNGSTIVDQRLGSELGCYTINRVRTYKLCENSATEKSCEIDSVPVKCKQGFCLKITQEGRGHVKLSRGTEIVLDVCDTSCELMIPKGTGDILVDCSGGQQHFLQDNLIDLGCPNIPLLGRTAIYVCRMSNHPKTTMAFLFWFSFGYVITCVVCKVLFYLLIVIGTLGKRLKQYRELKPQTCIVCESIPVNAIDAEMHDLNCNYNICPYCASRLTSDGLVRHVTQCPKRKEKVEETELYLNLERIPWLVRKLLQVSESTGVALKRSCWMITLLILLTVSMSPVQSAPVGRKPLFLDRIAKGMKSLLNSTSLETSLSIEAPWGAINVQSTFKPTVSAANIALSWSSVEHKGNKILVSGRSESIMKLEERTGISWCLGVEDASESKTLTVSVMDLSQMYSPVFEYLSGDRQVEEWPKATCTGDCPERCGCTSSTCLHKEWPHSRNWRCNPTWCWGVGTGCTCCGLDVKDLFTDYMLVKWKVEYIKTEAIICVELTSQERQCSLIEAGTRFNLGPVTITLSEPRNVQQRLPPEIITLHPKIEEGFFDLMHVQKVMSASTVCKLQSCTHGVPGDLQVYHVGNLLKGDKVNGHSIHKIESHLNTSWMSWDGCDLDYFCNMGDWPSCTYTGVTQHNHAAFINMLNIETDYTKTFHFHSKRVTAHGDTPQLDLKARPAYGAGEITVLVEVADLELHTKKIEVSGLKFASLSCSGCYACSSGISCKVRIHVNEPDEFTVHVKSNDPDVVAAGSSLMARKIESGADSTFKAFSSMPKNSLCFYIVERDYCSSCTDDDTQKCVDIKLEHPQSILIEHKGTIIGKQNDTCPTKTSCWLESIKSFFYGLKNMLSGIFGNVFLGMLLFLAPFILLILFFFFGWRLLFCLKCCRRTRKLLKYKHLRDEEESGYKKIIERLNDKKGKSRLFDGERLADRKIAELFSTKTHIG

SEQ ID NO: 1499 - protein, 972 aa, Artificial Sequence
  derived and/or modified protein sequence (wt) from CCHFV(ArD15786, Artificial)__DQ211627.1__Gn-4aa-Gc
AEGGSNDCVSRTQLVKTEVTEIHEDSYGGPGEKITICNGSTIVDQRLGSELGCYTINRVRTYKLCENSATEKSCEIDSVPVKCKQGFCLKITQEGRGHVKLSRGTEIVLDVCDTSCELMIPKGTGDILVDCSGGQQHFLQDNLIDLGCPNIPLLGQTAIYVCRMSNHPKTTMAFLFWFSFGYVITCVVCKVLFYLLIVIGTLGKRLKQYRELKPQTCIVCESIPVNAIDAEMHDLNCNYNICPYCASRLTSDGLVRHVTQCPKRKEKVEETELYLNLERIPWLVRKLLQVSESTGVALKRSCWIITLLILLTVSMSPVQSAPVGRKPLSLDSIAKGMKSLLNSTSLETSLSIEAPWGAINVQSTFKPTISAANIALSWSSVEHKGNKILVSGRSESIMKLEERTGISWCLGVEDASESKTLTVSVMDLSQMYSPVFEYLSGDRQVEEWPKATCTGDCPERCGCTSSTCLHKEWPHSRNWRCNPTWCWGVGTGCTCCGLDVKDLFTDYMLVKWKVEYIKTEAIICVELTSQERQCSLIEAGTRFNLGPVTITLSEPRNVQQRLPPEIITLHPKIEEGFFDLMHVQKVMSASTVCKLQSCTHGVPGDLQVYHVGNLLKGDKVNGHSIHKIESHLNTSWMSWDGCDLDYFCNMGDWPSCTYTGVTQHNRAAFINMLNIETDYTKTFHFHSKRVTAHGDTPQLDLKARPTYGAGEITVLVEVADLELHTKKIEVSGLKFASLTCSGCYACSSGISCKVRIHVNEPDEFTVHVKSNDPDVVAAGSSLMARKIESGADSTFKAFSSMPKNSLCFYIVERDYCSSCTDDDTQKCVDIKLEHPQSILIEHKGTIIGKQNDTCPTKTSCWLESIKSFFYGLKNMLSGIFGNIFLGMLLFLAPFVLLILFFFFGWRLLFCLKCCRRTRKLLKYKHLRDEEESGYKKIIERLNDKKGKSRLFDGERLADRKIAELFSTKTHVG

SEQ ID NO: 1500 - protein, 972 aa, Artificial Sequence
  derived and/or modified protein sequence (wt) from CCHFV(ArD39554, Artificial)__DQ211628.1__Gn-4aa-Gc
SESNNNDCVSRTQLIKTENAEIHGDDYGGPGEKITICNGSTIVEQRLGSELGCYTINRIKSFKLCENSASGKGCEIDSTPVKCKQGFCLKITQEGRGHVKLSRGSEIILDVCDSSCEMMIPKGSGDILVDCSGGQQHFLQDNLVDLGCPNVPLLGKMAIYICRMSNHPKTTMAFLFWFSFGYVITCIFCKVIFYVLIIIGTLGKRIKQYRELKPQTCTICEATPVNAIDAEMHDLNCSYNICPYCASRLTSEGLVRHVTQCPKRKEKIEETELYLNLERIPWFVRKLLQVSESTGVALKRSSWLVTLLVLLTVSLSPVQSAPIGRKPLFLDSTAKSMKSLLNSTSLETSLSIEAPWGAINVQSTFKPTASTANIALSWSSVEHRGNKILVTGRSESIMKLEERTGISWNLGVEDASESKTLTVSVMDLSQMYSTVFEYLSGDRQVEEWPKATCTGDCPERCGCTSSTCLHKAWPHSRNWRCNPTWCWGVGTGCTCCGLDVKNLFTDYMLIKWKVEFIKTEAIVCVELTSQERQCSLIEAGTRFNLGPVTITLSEPRNIQQKLPPELVTLHPRVEEGFFDLMHVQKVLSASTVCKLQSCTHGVPGDLQVYHVGNLLKGDKINGNSFHKIEPNLNTSWMSWDGCDLDYYCNMGDWPSCTYTGVTQHNHAAFVNLLNIETDYTKNFHFHSKRVTAHGETPQLDLKARPKYGAGEVTVLVEVADMELHTKKIEISGLKFASLTCTGCYACSSGISCKVRLHVDEPDELTVHVKSDDPDVVAASSSLMARKIEFGTDSTFKAFSSMPKDKLCFYIVERDYCSSCSKEDTQKCVNAKLEQPQSILIEHKGTIIGKQNDTCTVKASCWLESVKSFFYGLKNMLGGIFGNVILGIIMFLAPFALLLLFFLFGWRILFCLRCCRRTRGLFKYKHIKDDEESGYKRIIERLNNKKGKNKLFDGERLADKKIAELFSTKTHIG

SEQ ID NO: 1501 - protein, 972 aa, Artificial Sequence
  derived and/or modified protein sequence (wt) from CCHFV(C-68031, Artificial)__DQ211629.1__Gn-4aa-Gc
SEESGDDCISRTQLSRTETAEIHSDNYGGPGDKITICNGSTIVDQRLGSELGCYTINRVKSFKLCENSATGKSCEIDSTPIKCRQGFCLKITQEGRGHVKLSRGSEVVLDACDSSCEIMIPKGTGDILVDCSGGQQHFLKDNLIDLGCPNIPLLGKMAIYICRMSNHPKTTMAFLFWFSFGYVITCILCKVIFYLLIVVGTLGKKFKQYRELKPQTCTICETTPVNAIDAEMHDLNCSYNICPYCASRLTSDGLARHVMQCPKRKEKVEETELYLNLERIPWVVRKLLQVSESTGVALKRSSWLVVLLVLLTVSLSPVQSAPIGRKPLFSDSIVKGMKNLLNSTSLETSLSIEAPWGAINVQSTFKPTVSAANIALSWSSVEHRGNKILVSGRSESIMKLEERTGISWDLGVEDASESKLLTVSIMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIVTLHPRIEEGFFDLMHVKKVLSASTVCKLQSCTHGVPGDLQVYHIGNLLKGDKVNGHLIHKIEPHFNTSWMSWDGCDLDYYCNMGDWPSCSYTGVTQHNHAAFVNMLNIETDYTKIFHFHSKRVTAHGDTPQLDLKARPTYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSKEDTQKCVNTKLEQPQSILIEHKGTIIGKQNDTCTSKAGCWLESVKSFFYGLKNMLSGIFGNVFIGIFLFLAPFILLILFFMFGWRILFCFKCCRRTRGLFKYRHLKDDEETGYRKIIERLNNKKGKNKLLDGERLADRKIAELFSTKTHIG

SEQ ID NO: 1502 - protein, 972 aa, Artificial Sequence
  derived and/or modified protein sequence (wt) from CCHFV(Drosdov, Artificial)__DQ211630.1__Gn-4aa-Gc
SEEPGDDCISRTQLLKTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLKCSYNICPYCASRLTSDGLARHVTQCPKRKEKVEETELYLNLERIPWIVRKLLQVSESTGVALKRSSWLIVLLVLLTVSLSPVQSAPVGRKPLFLDSTVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYMKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRVNGHLIHKIEPHFNTSWMSWDGCDLDYYCNMGNWPSCTYTGVTQHNHAAFVNLLNIETDYTKTFHFHSKRVTAHGDTPQLDLKARPTYGAGEITVLVEVADMELHTKKVEISGLKFASLVCTGCYACSSGISCKVRIHVDEPDELTVHVKSSDPDVVAASTSLMARKLEFGTDSIFKAFSAMPKTSLCFYIVEREYCKSCSEDDTKKCVDTKLEQPQSILIEHKGTIIGKQNDTCTAKASCWLESVKSFFYGLKNMLGSVFGNFFVGILLFLAPFVLLVLFFMFGWKILFCFKCCRRTRGLFKYRHLKDDEETGYRRIIERLNSKKGKNRLLDGERLADRKIAELFSTKTHIG

SEQ ID NO: 1503 - protein, 972 aa, Artificial Sequence
  derived and/or modified protein sequence (wt) from CCHFV(Kashmanov, Artificial)__DQ211631.1__Gn-4aa-Gc
SEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVGRKPLFLDSIVKGMKNSLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRINGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEEDTQKCVDTKLEQPQSILIEHKGTIIGKQNDTCTAKASCWLESVKSFFYGLKNMLGSVFGNFFIGILLFLAPFVLLVLFFMFGWKILFCFKCCRRTRGLLKYRHLKDDEETGYRRIIERLNNKKGKNRLLDGERLADRKIAELFSTKTHIG

SEQ ID NO: 1504 - protein, 972 aa, Artificial Sequence
  derived and/or modified protein sequence (wt) from CCHFV(Oman, Artificial)__DQ211632.1__Gn-4aa-Gc
SEESGEDCISRTQLLRTETAEIHGDNYGGPGDKITICNGSTIVDQRLGSELGCYTINRVKSFKLCENSATGKSCEIDNTPVKCKQGFCLKITQEGRGHVKLSRDSEVVLDACDSSCEIMIPKGTGDILVDCSGGQQHFLKDNLIDLGCPNIPLLGKMAIYICRMSNHPKTTMAFLFWFSFGYVITCILCKVIFYLLIVVGTLGKKFKQYRELKPQTCTICETTPVNAIDAEMHDLNCSYNICPYCASRLTSDGLARHVMQCPKRKEKIEETELYLNLERIPWVVRKLLQVSESTGVALKRSSWLIVLLVLLTVSLSPVQSAPIGRKPLFLDSIAKGMKNLLNSTSLETSLSIEAPWGAINVQSTFKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIVTLHPRIEEGFFDLMHVQKVLSASTVCKLQSCTHGVPGDLQVYHIGNLLKGDKVNGHLIHKVEPHFNTSWMSWDGCDLDYYCNMGDWPSCTYTGVTQHNHAAFVNLLNIETDYTKNFHFHSKRVTAHGDTPQLDLKARPNYGAGEVTVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSKEDTQKCVNAKLERPQSILIEHKGTIIGKQNDTCTAKASCWLESVKSFFYGLKNMLSGIFGNVFIGIFLFLAPFILLILFFMFGWRILFCFKCCRRTRGLFKYRHLKDDEETGYRKIIERLNNKKGKNKLLDGERLADRKIAELFSTKTHIG

SEQ ID NO: 1505 - protein, 972 aa, Artificial Sequence
  derived and/or modified protein sequence (wt) from CCHFV(SPU97/85, Artificial)__DQ211633.1__Gn-4aa-Gc
SEESDGDCISRTQLLRTETAEIHSDNYGGPGDKITICNGSTIVDQRLGSELGCYTINRVKSFKLCENSATGKSCEIDSTPVKCRQGFCLKITQEGRGHVKLSRGSEIVLDACDSSCEIMIPKGTGDILVDCSGGQQHFLKDNLIDLGCPNIPLLGRMAIYICRMSNHPKTTMAFLFWFSFGYVITCILCKVIFYLLIVAGTVGKKFKQYRELRPQTCTICETTPVNAIDAEMHDLNCSYNICPYCASRLTSDGLARHVMQCPKRKEKIEETELYLNLERIPWVVRKLLQVSESTGVALKRSSWLTVLLVLLIVSLSPVQSAPIGRKPLFLDSIVKGKKNLLNSTSLETSLSIEAPWGAINVQSTFKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHAAFVNLLNIETDYTKNFHFHSKRVTAHGDTPQLDLKARPTYGAGEVTVLVEVADMELHTKKIEISGLKFASLSCTGCYACSSGISCKVRIHVDEPDELTVHVKSEDPDIVAAGSSLMARKLEFGADSTFKAFSAMPKTSLCFYIVEREYCKSCSREDTQKCVNTKLERPQSILIEHKGTIIGKQNDTCTAKASCWLESVKSFFYGLKSMLSGIFGNVFIGIFLFIAPFVLLILFFMFGWRILFCFKCCRRTRGLFKYRHLKDDEETGYRKIIERLNNKKGKNKLLDGERLADRKIAELFSTKSHIG

SEQ ID NO: 1506 - protein, 972 aa, Artificial Sequence
  derived and/or modified protein sequence (wt) from CCHFV(SPU103/87, Artificial)__DQ211634.1__Gn-4aa-Gc
SEESSDDCISRTQLLRTETAEIHGDNYGGPGDKITICNGSTIVDQRLGSELGCYTINRVKTFKLCENSATGKSCEIDSVPVKCRQGYCLKITQEGRGHVKLSRGSEVVLDACDTSCEVMIPKGTGDILVDCSGGQQHFLKDNLIDLGCPKIPLLGKMAIYICRMSNHPKTTMAFLFWFSFGYVITCVLCKAIFYLLIIVGTLGKRLKQYRELKPQTCTICETTPVNAIDAEMHDLNCSYNICPYCASRLTSDGLARHVTQCPKRKEKVEETELYLNLERIPWVVRRLLQVSESTGVALKRSSWLIVLLVLFTVSLSPVQSAPISRRPLFLDNIVKGMKNLLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKIEYIKTEAIVCVELTSQERQCSLIEAGTRFNLGPVTITLSEPRNIQQKLPSEIITLHPRIEEGFFDLMHVQKVLSASTVCKLQSCTHGVPGDLQVYHIGNLLKGDKVNGHLVHKIEPHFNTSWMSWDGCDLDYYCNMGDWPSCTYTGVTQHNHASFVNLLNIETDYTKNFHFHSKRVTAHGDTPQLDLKARPTYGAGEITVLVEVADMELHTKKIEISGLKFTSLTCTGCYACSSGISCKVRIHVDEPDELTVHVKSDDPDVVAASSSLMARKLEFGTDSTFKAFSAMPKTSLCFYIVEREYCKSCSEEDTQKCVNTKLEQPQSILIEHKGTIIGKQNNTCKARAGCWLESVKSFFYGLKNMLSGIFGNVFIGIFLFLAPFILLILFFMFGWRILFCFKCCRRTRGLFKYRHLKDDEETGYRKIIERLNNKKGKNKLLDGERLADRRIAELFSTKTHIG

SEQ ID NO: 1507 - protein, 972 aa, Artificial Sequence
  derived and/or modified protein sequence (wt) from CCHFV(SPU415/85, Artificial)__DQ211635.1__Gn-4aa-Gc
SEESDGDCISRTQLLRTETTEIHSDNYGGPGDKITICNGSTIVDQRLGSELGCYTINRVKSFKLCENSATGKSCEIDSTPVKCRQGFCLKITQEGRGHVKLSRGSEIVLDACDSNCEIMIPKGTGDILVDCSGGQQHFLKDNLIDLGCPNIPLLGKMAIYICRMSNHPKTTMAFLFWFSFGYVITCILCKVIFYLLIVAGTVGKKFKQYRELRPQTCTICETIPVNAIDAEMHDLNCSYNICPYCASRLTSDGLARHVMQCPKRKEKVEETELYLNLERIPWVVRKLLQVSESTGVALKRSSWLTVLLVLLIVSLSPVQSAPIGRKPLFLDSIVKGMKNLLNSTSLETSLSIEAPWGAINVQSTFKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQRVLSASTVCKLQSCTHGVPGDLQVYHIGNLLKGDKVNGHLIHKIEPHFNTSWMSWDGCDLDYYCNMGDWPSCTYTGVTQHNHAAFVNLLNIETDYTKNFHFHSKRVTAHGDTPQLDLKARPTYGAGEVTVLVEVADMELHTKKIEISGLKFASLTCTGCYACSSGISCKVKIHVDEPDELTVHVKSEDPDIVAAGSSLMARKLEFGADSTFKAFSAMPKTSLCFYIVEREYCKSCSREDTRKCVNTKLDRPQSILIEHKGTIIGKQNNTCTAKASCWLESVKSFFYGLKNMLSGIFGNVFIGIFLFIAPFVLLILFFMFGWRILFCFKCCRRTRGLFKYRHLKDDEETGYRKIIERLNNKKGKNKLLDGERLADRKIAELFSTKSHIG

SEQ ID NO: 1508 - protein, 972 aa, Artificial Sequence
  derived and/or modified protein sequence (wt) from CCHFV(Turkey200310849, Artificial)__DQ211636.1__Gn-4aa-Gc
SEEPGDDCISRTQLLRTETAEIHDDNYGGPGDKITICNGSTIVDQRLGSELGCYTINRVKSFKLCENSATGKTCEVDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCISCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLTVSLSPVQSAPVGRKPLFLDSIVKGMKNLLNSTSLETSLSIEAPWGAINVQSTFKPAVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQVYHIGNLLKGDRVNGHLIHKIESHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEDDTQKCVDTRLEQPQSILIEHKGTIIGKQNDTCTAKASCWLESVKSFFYGLKNMLGSVFGNLFIGILLFLAPFVLLVLFFMFGWKILFCFKCCRRTRGLFKYRHLKDDEETGYRRIIERLNSKKGKNRLLDGDRLADRKIAELFSTKTHIG

SEQ ID NO: 1509 - protein, 972 aa, Artificial Sequence
  derived and/or modified protein sequence (wt) from CCHFV(Iran-52, Artificial)__DQ446215.1__Gn-4aa-Gc
SEESGDDCISRTQLLRTETAEVHGDNYGGPGDKITICNGSTVVDQRLGSELGCYTINRVRSFKLCENSATGKSCEIDSIPVKCKQGYCLKITQEGRGHVKLSRGSEVVLDVCDSSCEVMIPKGTGDILVDCSGGQQHFLKDNLVDLGCPKIPLLGKMAIYICRMSNHPKTTMAFLFWFSFGYVITCILCKAIFFLLIIFGTLGKRFKQYRELKPQTCTICETTPVNAIDAEMHDLNCSYNICPYCASRLTSDGLARHVTQCPRRKEKVEETELYLNLERIPWVVRKLLQVSESTGTVLKRSSWLIVLLVLFTVSLSPVQSAPIGRRPLFLDSIVKGMKNLLNSTSLETSLSIEAPWGAINVQSTYKPTVSTANIALSWSSVEHRGNKVLVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGSVTITLSEPRNIQQKLPPEIITLHPKIEEGFFDLMHVQKVLSASTVCKLQSCTHGVPGDLQVYHIGNLLKGDRVNGHLIHKIEQHFNTSWMSWDGCDLDYYCNMGDWPSCTYTGVTQHNHASFVNLLNIETDYTKTFHFHSKRVTAHGDTPQLDLKARPTYGAGEITVLVEVADMELHTKKIEISGLKFAGLTCTGCYACSSGISCKVRIHVEEPDELTVHVKSDDPDVVAASSSLMARKLEFGTDSTFKAFSAMPKTSLCFYIVEREYCKSCSKEDTQKCVNTKLEQPQSILIEHKGTIIGKQNNTCTAKASCWLESVKSFFYGLKNMLGGIFGNVFIGIFTFLTPFILLILFFMFGWRILFCFKCCRRTRGLFKYRHLKDDEETGYRKIIERLNNKKGKNRLLDGERLADRKIAELFSTKTHIG

SEQ ID NO: 1510 - protein, 972 aa, Artificial Sequence
  derived and/or modified protein sequence (wt) from CCHFV(Iran-53, Artificial)__DQ446216.1__Gn-4aa-Gc
SEESGDDCISRTQLLRTETAEVHGDNYGGPGDKITICNGSTVVDQRLGSELGCYTINRVRSFKLCENSATGKSCEIDSIPVKCKQGYCLKITQEGRGHVKLSRGSEVVLDVCDSSCEVMIPKGTGDILVDCSGGQQHFLKDNLVDLGCPKIPLLGKMAIYICRMSNHPKTTMAFLFWFSFGYVITCILCKAIFFLLIIFGTLGKRFKQYRELKPQTCTICETTPVNAIDAEMHDLNCSYNICPYCASRLTSDGLARHVTQCPRRKEKVEETELYLNLERIPWVVRKLLQVSESTGTVLKRSSWLIVLLVLFTVSLSPVQSAPIGRRPLFLDSIVKGMKNLLNSTSLETSLSIEAPWGAINVQSTYKPTVSTANIALSWSSVEHRGNKVLVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGSVTITLSEPRNIQQKLPPEIITLHPKIEEGFFDLMHVQKVLSASTVCKLQSCTHGVPGDLQVYHIGNLLKGDRVNGHLIHKIEQHFNTSWMSWDGCDLDYYCNMGDWPSCTYTGVTQHNHASFVNLLNIETDYTKTFHFHSKRVTAHGDTPQLDLKARPTYGAGEVTVLVEVADMELHTKKIEISGLKFAGLTCTGCYACSSGISCKVRIHVDEPDELTVHVKSDDPDVVAASSSLMARKLEFGTDSTFKAFSAMPKTSLCFYIVEREYCKSCSKEDTQKCVNTKLEQPQSILIEHKGTIIGKQNNTCTAKASCWLESVKSFFYGLKNMLGGIFGNVFIGIFTFLTPFILLILFFMFGWRILFCFKCCRRTRGLFKYRHLKDDEETGYRKIIERLNNKKGKNRLLDGERLADRKIAELFSTKTHIG

SEQ ID NO: 1511 - protein, 972 aa, Artificial Sequence
  derived and/or modified protein sequence (wt) from CCHFV(Kosova Hoti, Artificial)__EU037902.1__Gn-4aa-Gc
SEEPGDDCISRTQLLRTETAEIHDDNYGGPGDKITICNGSTIVDQRLGSELGCYTINRVKSFKLCENSATGKTCEIDSTPVKCRQGFCLKITQKGRGHVKLSRGSEVVLDACDSNCEVMIPKGTGDILVDCSGGQQHFLKDNLIDLGCPHIPLLGKMAIYICRMSNHPKTTMAFLFWFSFGYVITCIFCKALFYSLIIIGTLGKKIKQYRELKPQTCTICETAPVNAIDAEMHDLNCSYNICPYCASRLTSDGLARHVKQCPKRKEKVEETELYLNLERIPWVVRKLLQVSESTGVALKRSSWLIVLLVLLTVSLSPVQSAPVGRKPLFLDSIVKGMKNLLNSTSLETSLSIEAPWGAINVQSTFKPTVSTANIALSWSSVEHRGNKILVTGRSESIMKLEERTGISWDLGVEDASESKLLTVSIMDLSQMYSPVFEYLSGDRQVEEWPKATCTGDCPQRCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAAGTSLMARKLEFGTDSTFKAFSAMPKTSLCFYIVEKEYCKSCSEDDTKKCVDTKLEQPQSILIEHRGTIIGKQNDTCTAKASCWLESVKSFFYGLKNMLGSVFGNFFIGILLFLAPFVLLVLFFMFGWKILFCFKCCRRTRGLFKYRHLKDDEETGYRRIIERLNNKKGKNRLLDGERLADRKIAELFSTKTHIG

SEQ ID NO: 1512 - protein, 972 aa, Artificial Sequence
  derived and/or modified protein sequence (wt) from CCHFV(YL04057, Artificial)__FJ562094.1__Gn-4aa-Gc
AEGGSSDCISRTQLVKTEVAEIHEDSYGGPGEKITICNGSTIVDQRLGRELGCYTINRVRSYKLCENSASGKSCEIDSIPVKCKQGFCLKITQEGRGHVKLSRGTEIVLDVCDSSCELMIPKGTGDILVDCSGGQQHFLQNNLIDLGCPNVPLLGKMAIYVCRMSNHPKTTMAFLFWFSFGYVITCIACRVLFYLLIAIGTVGKKLKQYRELKPQTCIVCESVPVNAIDAEMHELNCSYNICPYCASRLSTDGLIRHVTQCPKRREKVEETELFLNLERIPWLVRKLLQVSESTGMALKRSCWMITLLILLLVSISPVQSAPVGRKPLFLDSIAKGKKSLLNSTSLETSLSIEAPWGAINVQSTFKPTVSAANIALSWSSVEHRGNKILVSGRSESIMKLEERTGVSWNLGVEDASESKTLTVSVMDLSQMYSPVFEYLSGDRQVEEWPKATCTGDCPERCGCTSSTCLHKEWPHSRNWRCSPTWCWGVGTGCTCCGLDVKDFFTDYMLVKWKVEYIKTEAIVCVELTSQERQCSLIEAGTRFNLGPVTITLSEPRNVQQRLPPEIVTLHPKIEEGFFDLMHVQKILSASTVCKLQSCTHGVPGDFQVYHVGNLLRGDKVNGHSIHKIEPHFNTSWMSWDGCDLDYFCNMGDWPSCTYTGVTQHNRAAFINMLNIETDYTKTFHFHSKRVTAHGDTPQLDLKARPAYGAGEVTVLVEVADLELHTKKLEVSGLKIASLTCSGCYACSSGISCKVRIHVNEPDEFTVHVRSSDPDVVAAGSSLMARKIEFGADSTFKAFSSMPKDSLCFYIVEKDYCSSCTDDDTQKCVNTKLDHPQSILIEHKGTIIGKQNDTCSTKTSCWLESVKGFFYGLKNMLSGIFGNVFLGILLFLAPFVLLIFFFFFGWRLLFCLKCCRRTRGLLKYKHLKDEEEAGYKKIIERLNGKKGKSQLFDGERLADRKIAELFSTKIHIG

SEQ ID NO: 1513 - protein, 972 aa, Artificial Sequence
  derived and/or modified protein sequence (wt) from CCHFV(V42/81, Artificial)__GU477490.1__Gn-4aa-Gc
SKEPGDDCISRTQLMRTETAEIHDDNYGGPGDKITICNGSTIVDQRLGSELGCYTINRVKSFKLCENSATGKACEVDSTPVKCRQGFCLKITQEGRGHVKLSRGSEVVLDACDSSCEVMIPKGTGDILVDCSGGQQHFLKDNLIDLECPHIPLLGKLAIYICRMSNHPRTTMAFLFWFGFGYVITCILCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVVLKRSSWLIVLLVLLTVSLSPVQSAPVGRKPLFLDSIVKGKKNLLNSTSLETSLSIEAPWGAINIQSTFKPTVSAANIALSWSSVEHRGNKILVSGRSESIMKLEERTGVSWNLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFIDHMFVKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGETPQLDLKARPAYGAGEITVLVEVADMELHTKKVEISGLKFASLACTGCYACSSGISCKVRIHVDEPDELTVHVKSNDPDVVAASTSLMARKLESGTDSTFKAFSAMPKTSLCFYIVEREYCKSCSEDDTQKCVETKLEQPQSILIEHKGTIIGKQNDTCTAKASCWLESVKSFFYGLKNMLGSVFGNFFIGILLFLAPFVLLVLFFMFGWKILFCFKCCRRTRGLFKYRHLKEDEETGYRRIIERLNSKKGKNRLLDGERLADRKIAELFSTKTHIG

SEQ ID NO: 1514 - protein, 972 aa, Artificial Sequence
  derived and/or modified protein sequence (wt) from CCHFV(79121M18, Artificial)__GU477493.1__Gn-4aa-Gc
AEGGSSDCISRTQLVKTEVAEIHEDSYGGPGEKITICNGSTIVDQGLGSELGCYTINRVRSYKLCENSASGKSCEIDSIPVKCKQGFCLKITQEGRGHVKLSRGTEIVLDVCDSSCELMIPKGTGDILVDCSGGQQHFLQNNLIDLGCPNVPLLGKMAIYVCRMSNHPKTTMAFLFWFSFGYVITCIACRVLFYLLIAIGTVGKKLKQYRELKPQTCIVCESVPVNAIDAEMHELNCSYNICPYCASRLSTDGLIRHVTQCPKRREKVEETELFLNLERIPWLVRKLLQVSESTGMALKRSCWMITLLILLLVSISPVQSAPVGRKPLFLDSTAKGMKSLLNSTSLETSLSIEAPWGAINVQSTFKPTVSAANIALSWSSVEHRGNKILVSGRSESIMKLEERTGVSWNLGVEDASESKTLTVSVMDLSQMYSPVFEYLSGDRQVEEWPKATCTGDCPERCGCTSSTCLHKEWPHSRNWRCNPTWCWGVGTGCTCCGLDVKDFFTDYMLVKWKVEYIKTEAIVCVELTSQERQCSLIEAGTRFNLGPVTITLSEPRNVQQRLPPEIVTLHPKIEEGFFDLMHVQKILSASTVCKLQSCTHGVPGDFQIYHVGNLLRGDKVNGHSIHKIEPHFNTSWMSWDGCDLDYFCNMGDWPSCTYTGVTQHNRAAFINMLNIETDYTKTFHFHSKRVTAHGDTPQLDLKARPAYGAGEVTVLVEVADLELHTKKLEVSGLKIASLTCSGCYACSSGISCKVRIHVNEPDEFTVHVRSSDPDVVAAGSSLMARKIEFGADSTFKAFSSMPKDSLCFYIVEKDYCSSCTDDDTQKCVNTKLDHPQSILIEHKGTIIGKQNDTCSTKTSCWLESVKGFFYGLKNMLSGIFGNVFLGIFLFLAPFVLLIFFFFFGWRLLFCLKCCRRTRGLLKYKHLKDEEEAGYKKIIERLNGKKGKSQLFDGERLADRKIAELFSTKIHIG

SEQ ID NO: 1515 - protein, 972 aa, Artificial Sequence
  derived and/or modified protein sequence (wt) from CCHFV(Afg09-2990, Artificial)__HM452306.1__Gn-4aa-Gc
SEESGDDCISRTQLLRTETAEVHGDNYGGPGDKITICNGSTVVDQRLGSELGCYTINRVRSFKLCENSATGKSCEIDSIPVKCKQGYCLKITQEGRGHVKLSRGSEVVLDVCDSSCEVMIPKGTGDILVDCSGGQQHYLKDNLVDLGCPKIPLLGKMAIYICRMSNHPKTTMAFLFWFSFGYVITCILCKAIFFLLIIFGTLGKRFKQYRELKPQTCTICETTPVNAIDAEMHDLNCSYNICPYCASRLTSDGLARHVTQCPRRKEKVEETELYLNLERIPWVVRKLLQVSESTGTVLKRSSWLIVLLVLFTVSLSPVQSAPIGRRPLFLDSIVKGMKNLLNSTSLETSLSIEAPWGAINVQSTYKPTVSTANIALSWSSVEHRGNKVLVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGSVTITLSEPRNIQQKLPPEIITLHPKIEEGFFDLMHVQKVLSASTVCKLQSCTHGVPGDLQVYHIGNLLKGDRVNGHLIHKIEQHFNTSWMSWDGCDLDYYCNMGDWPSCTYTGVTQHNHASFVNLLNIETDYTKTFHFHSKRVTAHGDTPQLDLKARPTYGAGEITVLVEVADMELHTKKIEISGLKFAGLTCTGCYACSSGISCKVRIHVDEPDELTVHVKSDDPDVVAASSSLMARKLEFGTDSTFKAFSAMPKTSLCFYIVEREYCKSCSKEDTQKCVNTKLEQPQSILIEHKGTIIGKQNNTCTAKASCWLESVKSFFYGLKNMLGGIFGNVFIGIFTFLTPFILLILFFMFGWRILFCFKCCRRTRGLFKYRHLKDDEETGYRKIIERLNNKKGKNRLLDGERLADRKIAELFSTKTHIG

SEQ ID NO: 1516 - protein, 972 aa, Artificial Sequence
  derived and/or modified protein sequence (wt) from CCHFV(Sudan Al-Fulah 3-2008, Artificial)__HQ378184.1__Gn-4aa-Gc
SEEPSDDCISRTQLLRTETAEIHGDNYGGPGDKITICNGSTIVDQRLGSELGCYTINRVKSFKLCENSATGKSCVIDSVPVKCRQGYCLRITQEGRGHVKLSRGSEVVLDACDTSCEIMIPKGTGDILVDCSGGQQHFLKDNLVDLGCPKIPLLGKMAIYICRMSNHPKTTMAFLFWFSFGYVITCILCKAIFYLLIIIGTLGKRFRQYRELKPQTCTICETTPVNAIDAEMHDLNCSYNICPYCASRLTSDGLARHVTQCPKRKEKVEETELYLNLERIPWVVRKLLQVSESTGVALKRSSWLIVLLVLFTVSLSPVQSAPIGRRPLFLDSIVKGMKNLLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFVNLLNIETDYTKNFHFHSKRVTAHGDTPQLDLKARPTYGAGEITVLVEVADMELHTKKIEISGLKFASLTCTGCYACSSGISCKVRIHVDEPDELTVHVKSDDPDVVAASSSLMARKLEFGTDSTFKAFSAMPKTSLCFYIVEKEYCKSCSEEDTKKCVNTKLEQPQSILIEHKGTIIGKQNSTCTAKVSCWLESAKSFFYGLKDMLSGIFGNVFIGIFLFLAPFVLLVLFFMFGWRILLCFRCCRRTRGLFKYRHLKDDEETGYRRIIERLNNKKGKNKLLDGERLADRKIAELFSTKTHIG

SEQ ID NO: 1517 - protein, 972 aa, Artificial Sequence
  derived and/or modified protein sequence (wt) from CCHFV(Sudan AB1-2009, Artificial)__HQ378187.1__Gn-4aa-Gc
SEEPSDDCISRTQLLRTETAEIHGDNYGGPGDKITICNGSTIVDQRLGSELGCYTINRVKSFKLCENSATGKNCEIDSVPVKCRQGYCLRITQEGRGHVKLSRGSEVVLDACDTSCEIMIPKGTGDILVDCSGGQQHFLKDNLIDLGCPKIPLLGKMAIYICRMSNHPKTTMAFLFWFSFGYLITCILCKAIFYLLIIIGTLGKRLKQYRELKPQTCTICETTPVNAIDAEMHDLNCSYNICPYCASRLTSDGLARHVIQCPKRKEKVEETELYLNLERIPWVVRKLLQVSESTGVALKRSSWLIVLLVLFTVSLSPVQSAPIGRKPLFLDSIAKGMKNLLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFVNLLNIETDYTKNFHFHSKRVTAHGDTPQLDLKARPTYGAGEITVLVEVADMELHTKKIEISGLKFASLTCTGCYACSSGISCKVRIHVDEPDELTVHVKSDDPDVVAASSSLMARKLEFGTDSTFKAFSAMPKTSLCFYIVEREHCKSCNEEDTKKCVNTKLEQPQSILIEHKGTIIGKQNSTCTARASCWLESVKSFFYGLKNMLSGIFGNVFMGIFLFLAPFILLILFFMFGWRILFCFKCCRRTRGLFKYRHLKDDEETGYRRIIERLNNKKGKNKLLDGERLADRRIAELFSTKTHIG

SEQ ID NO: 1518 - protein, 972 aa, Artificial Sequence
  derived and/or modified protein sequence (wt) from CCHFV(NIVA 118595, Artificial)__JN572083.1__Gn-4aa-Gc
SEESGDDCISRTQLLRTETAEVHGDNYGGPGDKITICNGSTVVDQRLGSELGCYTINRVKSFKLCENSATGKSCEIDSIPVKCRQGYCLKITQEGRGHVKLSRGSEVVLDACDSSCEVMIPKGTGDILVDCSGGQQHFLKDNLIDLGCPKIPLLGKMAIYICRMSNHPKTTMAFLFWFSFGYVITCILCKVIFYLLIIFGTLGKRFKQYRELKPQTCTICETTPVNAIDAEMHDLNCSYNICPYCASRLTSDGLARHVTQCPKRKEKVEETELYLNLERIPWVVRKLLQVSESTGIALKRSSWLIVLLVLFTVSITPVQSAPIGRRPLFLDSIVKGMKNLLNSTSLETSLSIEAPWGAINVQSTYKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGSVTITLSEPRNIQQKLPPEIITLHPRIEEGFFDLMHVQKVLSASTVCKLQSCTHGVPGDLQVYHIGNLLKGDRVNGHLIHKIEQHLNTSWMSWDGCDLDYYCNMGDWPSCTYTGVTQHNHASFVNLLNIETDYTKTFHFHSKRVTAHGDTPQLDLKARPTYGAGEITVLVEVADMELHTKKIEISGLKFASLSCTGCYACSSGISCKVRIHVDEPDELTVHVKSDDPDVVAASSSLMARKLESGTDSTFKAFSAMPKTSLCFYIVEREYCKGCSKEDTQKCVNTKLEQPQSILIEHKGTIIGKQNNTCTAKASCWLESVKSFFYGLKNMLSGIFGNVFLGIFSFLAPFVLLILFFMFGWRILFCFKCCRRTRGLFKYRHLKDDEETGYRKIIERLNNKKGKNKLLDGERLADRKIAELFSTKTHIG

SEQ ID NO: 1519 - protein, 972 aa, Artificial Sequence
  derived and/or modified protein sequence (wt) from CCHFV(NIV 112143, Artificial)__JN572085.1__Gn-4aa-Gc
SEESGDDCISRTQLLRTETAEVHGDNYGGPGDKITICNGSTVVDQRLGSELGCYTINRVKSFKLCENSATGKSCEIDSIPVKCRQGYCLKITQEGRGHVKLSRGSEVVLDACDSSCEVMIPKGTGDILVDCSGGQQHFLKDNLIDLGCPKIPLLGKMAIYICRMSNHPKTTMAFLFWFSFGYVITCILCKVIFYLLIIFGTLGKRFKQYRELKPQTCTICETTPVNAIDAEMHDLNCSYNICPYCASRLTSDGLARHVTQCPKRKEKVEETELYLNLERIPWVVRKLLQVSESTGIALKRSSWLIVLLVLFTVSITPVQSAPIGRRPLFLDSIVKGMKNLLNSTSLETSLSIEAPWGAINVQSTYKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGSVTITLSEPRNIQQKLPPEIITLHPRIEEGFFDLMHVQKVLSASTVCKLQSCTHGVPGDLQVYHIGNLLKGDRVNGHLIHKIEQHLNTSWMSWDGCDLDYYCNMGDWPSCTYTGVTQHNHASFVNLLNIETDYTKTFHFHSKRVTAHGDTPQLDLKARPTYGAGEITVLVEVADMELHTKKIEISGLKFASLSCTGCYACSSGISCKVRIHVDEPDELTVHVKSDDPDVVAASSSLMARKLEFGTDSTFKAFSAMPKTSLCFYIVEREYCKGCSKEDTQKCVNTKLEQPQSILIEHKGTIIGKQNNTCTAKASCWLESVKSFFYGLKNMLSGIFGNVFLGIFSFLAPFVLLILFFMFGWRILFCFKCCRRTRGLFKYRHLKDDEETGYRKIIERLNNKKGKNKLLDGERLADRKIAELFSTKTHIG

SEQ ID NO: 1520 - protein, 972 aa, Artificial Sequence
  derived and/or modified protein sequence (wt) from CCHFV(SCT ex Afghanistan, Artificial)__KC344856.1__Gn-4aa-Gc
SEESGDDCISRTQLLRTETAEVHNDNYGGPGDKITICNGSTIVDQRLGSELGCYTINRVKSFKLCENSATGKSCKIDSTPVKCRQGFCLKITQEGRGHVKLSRGSEVVLDACDSSCEIMIPKGTGDILVDCSGGQQHFLKDNLIDLGCPNIPLLGKMAIYICRMSNHPKTTMAFLFWFSFGYVITCIFCKVIFYLLIVVGTLGKKFKQYRELKPQTCTICETTPTNAIDAEMHDLNCSYNICPYCASRLTSDGLARHVTQCPKRKEKVEETELYLNLERIPWIVRKLLQVSESTGVALKRSSWLIVLLVLLTVSLSPVQSAPIGRKPLFLNSIVKGMKNLLNSTNLETSLSIEAPWGAINVQSTFKPTVSTANIALSWSSVEHRGNKILVSGRSESIMKLEERTGISWDLGVEDASESKSLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKLNGHMIHKIEPHFNTSWMSWDGCDLDYYCNMGDWPSCTYTGVTQHNHAAFVNLLNIETDYTKNFHFHSKRVTAHGDTPQLDLKARPTYGAGEITVLVEVADMELHTKKIDISGLKFASLTCAGCYACSSGISCKVRIHVDEPDELTVHVKSEDPDIVAASTSLIARKLELGTDSTFKAFSAMPKTSLCFYIVEREYCKSCSKEDTQKCVNTKLEHPQGILIEHKGTIIGKQNDTCTAKAGCWLESVKSFFYGLKNMLSGIFGNVFIGIFLFLAPFVLLILFFMFGWRLLFCFKCCRRTRGLFKYRHLKEDEESGYRRIIERLNNKKGKNKLLDGERLADRRIAELFSTKTHIG

SEQ ID NO: 1521 - protein, 972 aa, Artificial Sequence
  derived and/or modified protein sequence (wt) from CCHFV(Zahedan 2007, Artificial)__KC867273.1__Gn-4aa-Gc
SEESGDDCISRTQLLRTETAEVHGDNYGGPGDKITICNGSTVVDQRLGSELGCYTINRVRSFKLCENSATGKSCEIDSIPVKCKQGFCLKITQEGRGHVKLSRGSEVVLDVCDSSCEVMIPKGTGDILVDCSGGQQHFLKDNLVDLGCPKIPLLGKMAIYICRMSNHPKTTMAFLFWFSFGYVITCILCKAIFFLLIIFGTLGKRFKQYRELKPQTCTICETTPVNAIDAEMHDLNCSYNICPYCASRLTSDGLARHVTQCPRRKEKVEETELYLNLERIPWVVRKLLQVSESTGTVLKRSSWLIVLLVLFTVSLSPVQSAPIGRRPLFLDSIVKDMKNLLNSTSLETSLSIEAPWGAINVQSTYKPTVSTANIALSWSSVEHRGNKVLVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGSVTITLSEPRNIQQKLPPEIITLHPKIEEGFFDLMHVQKVLSASTVCKLQSCTHGVPGDLQVYHIGNLLKGDRVNGHLIHKIEQHFNTSWMSWDGCDLDYYCNMGDWPSCTYTGVTQHNHASFVNLLNIETDYTKTFHFHSKRVTAHGDTPQLDLKARPTYGAGEITVLVEVADMELHTKKIEISGLKFAGLTCTGCYACSSGISCKVRIHVDEPDELTVHVKSDDPDVVAASSSLMARKLEFGTDSTFKAFSAMPKTSLCFYIVEREYCKSCSKEDTQKCVNTKLEQPQSILIEHKGTIIGKQNNTCTAKASCWLESVKSFFYGLKNMLGGIFGNVFIGIFTFLTPFILLIFFFMFGWRILFCFKCCRRTRGLFKYRHLKDDEETGYRKIIERLNNKKGKNRLLDGERLADRKIAELFSTKTHIG

SEQ ID NO: 1522 - protein, 972 aa, Artificial Sequence
  derived and/or modified protein sequence (wt) from CCHFV(SPU 44/08, Artificial)__KJ682805.1__Gn-4aa-Gc
SEESNDDCLSRTQLLRTENAEIHSDNYGGPGDKITICNGSTIVDQRLGSELGCYTINRVKSFKLCENSATGKSCEIDSTPVRCRQGFCLKITQEGRGHVKLSRGSEVVLDACDSSCEIMIPKGTGDILVDCSGGQQHFLKDNLVDLGCPNIPLLGKMAIYICRMSNHPKTTMAFLFWFSFGYVITCILCKAIFYLLIVVGTLGKKFKQYRELKPQTCTICETNPVNAIDAEMHDLNCSYNICPYCASRLTSDGLARHVMQCPKRKEKIEETELYLNLERIPWVVRKLLQVSESTGVALKRSSWLVILLVLLTVSLSPVQSAPISRKPLFLDSIVKGMKNLLNSTSLETSLSIEAPWGAINVQSTFKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVDYIKTEAIVCVELTSQERQCSLIEAGTRFNLGPVTITLSEPRNIQQKLPPEIVTLHPRIEEGFFDLMHIQKVLSASTVCKLQSCTHGVPGDLQIYHIGNLLKGDKVNGHLIHKIEPHFNTSWMSWDGCDLDYYCNMGDWPSCSYTGVTQHNHAAFVNMLNIETDYTKNFHFHSKRVTAHGDTPQLDLKARPTYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSKEDTQKCVNTKLEQPQSILIEHKGTIIGKQNDTCTAKASCWLESIKSFFYGLKNMLSGIFGNVFIGIFLFLAPFIMLILFFMFGWRILFCFKCCRRTRGLFKYRHLKDDEEIGYRKIIERLNNKKGKNKLLDGERLADRKIAELFSTKTHIG

SEQ ID NO: 1523 - protein, 972 aa, Artificial Sequence
  derived and/or modified protein sequence (wt) from CCHFV(SPU 383/87, Artificial)__KJ682806.1__Gn-4aa-Gc
SEESNDDCLSRTQLLRTENAEIHSDNYGGPGDKITICNGSTIVDQRLGSELGCYTINRVKSFKLCENSATGKSCEIDSTPVRCRQGFCLKITQEGRGHVKLSRGSEVVLDACDSSCEIMIPKGTGDILVDCSGGQQHFLKDNLVDLGCPNIPLLGKMAIYICRMSNHPKTTMAFLFWFSFGYVITCILCKVIFYLLVVVGTLGKKFKQYRELKPQTCTICETNPVNAIDAEMHDLNCSYNICPYCASRLTSDGLARHVIQCPKRKEKIEETELYLNLERIPWVVRKLLQVSESTGVALKRSSWLVILLVLLTVSLSPVQSAPISRKPLFLDSIVKGMKNLLNSTSLETSLSIEAPWGAINVQSTFKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVDYIKTEAIVCVELTSQERQCSLIEAGTRFNLGPVTITLSEPRNIQQKLPPEIVTLHPRIEEGFFDLMHIQKVLSASTVCKLQSCTHGVPGDLQIYHIGNLLKGDKVNGHLIHKIEPHFNTSWMSWDGCDLDYYCNMGDWPSCSYTGVTQHNHAAFVNMLNIETDYTKNFHFHSKRVTAHGDTPQLDLKARPTYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSKEDTQKCVNTKLEQPQSILIEHKGTIFGKQNDTCTAKASCWLESVKSFFYGLKNMLSGIFGNVFIGVFLFLAPFIMLILFFMFGWRILFCFKCCRRTRGLFKYRHLKDDEEIGYRKIIERLNNKKGKNKLLDGERLADRKIAELFSTKTHIG

SEQ ID NO: 1524 - protein, 972 aa, Artificial Sequence
  derived and/or modified protein sequence (wt) from CCHFV(SPU 130/89, Artificial)__KJ682807.1__Gn-4aa-Gc
SEEPNYDCLSRTQLLRTENAEIHSDNYGGPGDKITICNGSTIVDQRLGSELGCYTINRVKSFKLCENSATGKSCEIDSTPVRCRQGFCLKITQEGRGHVKLSRGSEVVLDACDSSCEIMIPKGTGDILVDCSGGQQHFLKDNLVDLGCPNIPLLGKMAIYICRMSNHPKTTMAFLFWFSFGYVITCILCKVIFYLLIVVGTLGKKFKQYRELKPQTCTICETNPVNAIDAEMHDLNCSYNICPYCASRLTSDGLARHVMQCPKRKEKIEETELYLNLERIPWVVRKLLQVSESTGVALKRSSWLVVLLVLLTVSLSPVQSAPISRKPLSLDSIVKGMKNLLNSTSLETSLSIEAPWGAINVQSTFKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVDYIKTEAIVCVELTSQERQCSLIEAGTRFNLGPVTITLSEPRNIQQKLPPEIVTLHPRIEEGFFDLMHIQKVLSASTVCKLQSCTHGVPGDLQIYHIGNLLKGDKVNGHLIHKIEPHFNTSWMSWDGCDLDYYCNMGDWPSCSYTGVTQHNHAAFVNMLNIETDYTKNFHFHSKRVTAHGDTPQLDLKARPTYGAGEITVLVEVADMELHTKKVEISGLKFASLTCTGCYACSSGISCKVRIHVDEPDELTVHVKSEDPDIVAASSSLMARKLEFGTDSTFKAFSAMPKTSLCFYIVEREHCKSCSKEDTQRCVNTKLEQPQSILIEHKGTIIGKQNDTCTAKASCWLESIKSFFYGLKNMLSGIFGNVFIGVFLFLAPFIILILFFMFGWRILFCFKCCRRTRGLLKYRHLKDDEEIGYRKIIERLNNKKGKNKLLDGERLADRKIAELFSTKTHIG

SEQ ID NO: 1525 - protein, 972 aa, Artificial Sequence
  derived and/or modified protein sequence (wt) from CCHFV(SPU 497/88, Artificial)__KJ682808.1__Gn-4aa-Gc
SEESNDDCLSRTQLLRTENAEIHSDNYGGPGDKITICNGSTIVDQRLGSELGCYTINRVKSFKLCENSATGKSCEIDSTPVRCRQGFCLKITQEGKGHVKLSRGSEVVLDACDSSCEIMIPKGTGDILVDCSGGQQHFLKDNLVDLGCPNIPLLGKMAIYICRMSNHPKTTMVFLFWFSFGYVITCILCKVIFYLLIVVGTLGKKFKQYRELKPQTCTICETNPVNAIDAEMHDLNCSYNICPYCASRLTSDGLARHVMQCPKRKEKIEETELYLNLERIPWVVRKLLQVSESTGVALKRSSWLVILLVLLTVSLSPVQSAPISRKPLFLDSIVKGMRNLLNSTSLETSLSIEAPWGAINVQSTFKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVDYIKTEAIVCVELTSQERQCSLIEAGTRFNLGPVTITLSEPRNIQQKLPPEIVTLHPRIEEGFFDLMHIQKVLSASTVCKLQSCTHGVPGDLQIYHIGNLLKGDKVNGHLIHKIEPHFNTSWMSWDGCDLDYYCNMGDWPSCSYTGVTQHNHAAFVNMLNIETDYTKNFHFHSKRVTAHGDTPQLDLKARPTYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSKEDTQKCVNTKLEQPQSILIEHKGTIIGKQNDTCTARASCWLESIKSFFYGLKNMLSGIFGNVFIGIFLFFAPFIMLILFFMFGWRILFCFKCCRRTRGLFKYRHLKDDEEVGYRKIIERLNNKKGKNKLLDGERLADRKIAELFSTKTHIG

SEQ ID NO: 1526 - protein, 972 aa, Artificial Sequence
  derived and/or modified protein sequence (wt) from CCHFV(SPU 18/88, Artificial)__KJ682810.1__Gn-4aa-Gc
SEESNDDCLSRTQLLRTENAEIHSDNYGGPGDKITICNGSTIVDQRLGSELGCYTINRVKSFKLCENSATGKSCEIDSTPVRCRQGFCLKITQEGRGHVKLSRGSEVVLDACDSSCEIMIPKGTGDILVDCSGGQQHFLKDNLVDLGCPNIPLLGKMAIYICRMSNHPKTTMGFLFWFSFGYVITCILCKVIFYLLIVVGTLGKKFKQYRELKPQTCTICETNPVNAIDAEMHDLNCSYNICPYCASRLTSDGLARHVMQCPKRKEKIEETELYLNLERIPWVVRKLLQVSESTGVALKRSSWLVILLVLLTVSLSPVQSAPISRKPLFLDSIVKGKKNLLNSTSLETSLSIEAPWGAINVQSTFKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVDYIKTEAIVCVELTSQERQCSLIEAGTRFNLGPVTITLSEPRNIQQKLPPEIVTLHPRIEEGFFDLMHIQKVLSASTVCKLQSCTHGVPGDLQIYHIGNLLKGDKVNGHLIHKIEPHFNTSWMSWDGCDLDYYCNMGDWPSCSYTGVTQHNHAAFVNMLNIETDYTKNFHFHSKRVTAHGDTPQLDLKARPTYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSKEDTQKCVNTKLEQPQSILIEHKGTIIGKQNDTCTGKAGCWLESIKSFFYGLKNMLSGIFGNVFIGIFLFLAPFIMLILFFMFGWRILFCFKCCRRTRGLFKYRHLKDDEEIGYRKIIERLKNKKGKNKLLDGERLADRKIAELFSTKTHIG

SEQ ID NO: 1527 - protein, 972 aa, Artificial Sequence
  derived and/or modified protein sequence (wt) from CCHFV(SPU 431/85, Artificial)__KJ682812.1__Gn-4aa-Gc
SEESDGDCISRTQLLRTETTEIHSDNYGGPGDKITICNGSTIVDQRLGSELGCYTINRVKSFKLCENSATGKSCEIDSTPVKCRQGFCLKITQEGRGHVKLSRGSEIVLDACDSNCEIMIPKGTGDILVDCSGGQQHFLKDNLIDLGCPNIPLLGKMAIYICRMSNHPKTTMAFLFWFSFGYVITCILCKVIFYLLIVAGTVGKKFKQYRELRPQTCTICETIPVNAIDAEMHDLNCSYNICPYCASRLTSDGLARHVMQCPKRKEKVEETELYLNLERIPWVVRKLLQVSESTGVALKRSSWLTVLLVLLIVSLSPVQSAPIGRKPLFLDSIVKGRKNLLNSTSLETSLSIEAPWGAINVQSTFKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQRVLSASTVCKLQSCTHGVPGDLQVYHIGNLLKGDKVNGHLIHKIEPHFNTSWMSWDGCDLDYYCNMGDWPSCTYTGVTQHNHAAFVNLLNIETDYTKNFHFHSKRVTAHGDTPQLDLKARPTYGAGEVTVLVEVADMELHTKKIEISGLKFASLTCTGCYACSSGISCKVKIHVDEPDELTVHVKSEDPDIVAAGSSLMARKLEFGADSTFKAFSAMPKTSLCFYIVEREYCKSCSREDTRKCVNTKLDRPQSILIEHKGTIIGKQNNTCTAKASCWLESVKSFFYGLKNMLSGIFGNVFIGIFLFIAPFVLLILFFMFGWRILFCFKCCRRTRGLFKYRHLKDDEETGYRKIIERLNNKKGKNKLLDGERLADRKIAELFSTKSHIG

SEQ ID NO: 1528 - protein, 972 aa, Artificial Sequence
  derived and/or modified protein sequence (wt) from CCHFV(SPU 48/90, Artificial)__KJ682813.1__Gn-4aa-Gc
SEEPSDDCISRTQLLRTETAEIHGDNYGGPGDKITICNGSTIVDQRLGSELGCYTINRVKSFKLCENSATGKSCVIDSVPVKCRQGYCLRITQEGRGHVKLSRGSEVVLDACDTSCEIMIPKGTGDILVDCSGGQQHFLKDNLIDLGCPKIPLLGKMAIYICRMSNHPTTTMAFLFWFSFGYVITCILCKAIFYLLIIIGTLGKRFRQYRELKPQTCTICETTPVNAIDAEMHDLNCSYNICPYCASRLTSDGLARHVTQCPKRKEKVEETELYLNLERIPWVVRKLLQVSESTGVALKRSSWLIVLLVLFTVSLSPVQSAPIGRKPLFRDSIVKGMKNLLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNRASFVNLLNIETDYTKNFHFHSKRVTAHGDTPQLDLKARPTYGAGEITVLVEVADMELHTKKIEISGLKFASLTCTGCYACSSGISCKVRIHVDEPDELTVHVKSDDPDVVAASSSLMARKLEFGTDSTFKAFSAMPKTSLCFYIVEKEYCKSCSEEDTKKCVNTKLEQPQSILIEHKGTIIGKQNSTCTAKVSCWLESAKSFFYGLKDMLSGIFGNVFIGIFLFLAPFILLILFFMFGWRILLCFKCCRRTRGLFKYRHLKDDEETGYRRIIERLNNKKGKNKLLDGERLADRRIAELFSTKTHIG

SEQ ID NO: 1529 - protein, 972 aa, Artificial Sequence
  derived and/or modified protein sequence (wt) from CCHFV(SPU 187/90, Artificial)__KJ682814.1__Gn-4aa-Gc
SEEPSDDCISRTQLLRTETAEIHGDNYGGPGDKITICNGSTIVDQRLGSELGCYTINRVKSFKLCENSATGKSCEIDSVPVKCRQGYCLRITQEGRGHVKLSRGSEVVLDACDTSCEIMIPKGTGDILVDCSGGQQHFLKDNLIDLGCPKIPLLGKMAIYICRMSNHPKTTMAFLFWFSFGYVITCILCKAIFYLLIIIGTLGKRFKQYRELKPQTCTICETTPVNAIDAEMHDLNCSYNICPYCASRLTSDGLARHVTQCPKRKEKVEETELYLNLERIPWVVRKLLQVSESTGVALKRSSWLIVLLVLFTVSLSPVQSAPIGRRPLFLDSIVKGMKNLLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFVNLLNIETDYTKNFHFHSKRVTAHGDTPQLDLKARPTYGAGEITVLVEVADMELHTKKIEISGLKFASLTCTGCYACSSGISCKVRIHVDEPDELTVHVKSDDPDVVAASSSLMARKLEFGTDSIFKAFSAMPKTSLCFYIVEREHCKSCSEEDTKKCVNTKLEQPQSILIEHKGTIIGKQNSTCTAKTSCWLESVKSFFYGLKNMLSGIFGNVFIGIFLFLAPFILLILFFMFGWRILFCFKCCRRTRGLFKYRHLKDDEETGYRRIIERLNNKKGKNKLLDGERLADRRIAELFSTKTHIG

SEQ ID NO: 1530 - protein, 972 aa, Artificial Sequence
  derived and/or modified protein sequence (wt) from CCHFV(Haskovo-V46/13, Artificial)__KR092379.1__Gn-4aa-Gc
SEELGDDCISRTQLLRTETAEIHDDNYGGPGDKITICNGSTIVDQRLGSELGCYTINRGKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETTPVNAIDAEMHDLNCSYNICPYCASRLTSDGLARHVTQCPKRKEKVEETELYLNLERIPWIVRKLLQVSESTGVALKRSSWLIVLLVLLPVSLSPVQSAPVGRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLTCTGCYACSSGISCKVRIHVDEPDELTVHVKSSDPDVVAAGTSLMARKLEFGTDSTFKAFSAMPKTSLCFYIVEREYCKSCSEDDTQKCVDTKLEQPQSILIEHKGTIIGKQNDTCTARASCWLESVKSFFYGLKNMLGSVFGNFLIGILLFLAPFVLLVLFFMFGWKILFCFKCCRRTRGLFKYRHLKDDEETGYRRIIERLNSKKGKNRLLDGERLADRKIAELFSTKTHIG

SEQ ID NO: 1531 - protein, 972 aa, Artificial Sequence
  derived and/or modified protein sequence (wt) from CCHFV(24-R-2012, Artificial)__KR814856.1__Gn-4aa-Gc
SEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDTSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVGRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSNDPDVVAASTSLMARKLEFGTDSTFKAFSAMPKTSLCFYIVEREYCKSCSEEDTQKCVDTKLEQPQSILIEHKGTIIGKQNDTCTAKASCWLESVKSFFYGLKNMLGSVFGNFFIGILLFLAPFVLLVLFFMFGWKILFCFKCCRRTRGLLKYRLLKDDEETGYRRIIERLNNKKGKNRLLDGERLADRKIAELFSTKTHIG

SEQ ID NO: 1532 - protein, 972 aa, Artificial Sequence
  derived and/or modified protein sequence (wt) from CCHFV(36-ST-2014, Artificial)__KR814857.1__Gn-4aa-Gc
SEEPGDDCISRTQLLKTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEIMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLTVSLSPVQSAPVGRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRLNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEDDTKKCVDTKLDQPQSILIEHKGTIIGKQNDTCTAKASCWLESVKSFFYGLKNMLGSVFGNFFVGILLFLAPFVLLVLFFMCGWKFLFCFKCCRRTRGLFKYRHLKDDEETGYRRIIERLNSKKGKNRLLDGERLADRKIAELFSTKSHIG

SEQ ID NO: 1533 - protein, 972 aa, Artificial Sequence
  derived and/or modified protein sequence (wt) from CCHFV(37-R-2013, Artificial)__KR814858.1__Gn-4aa-Gc
SEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDTSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVGRKPLFLDSIVKGMKNLLNSTSLETSLSIEAPWGAINVQSTFKPTVSTANIALSWSSVEHRGNKILVTGRSESIMKLEERTGVSWDLGVDDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSNDPDVVAASTSLMARKLEFGTDSTFKAFSAMPKTSLCFYIVEREYCKSCSEEDTQKCVDTKLEQPQSILIEHKGTIIGKQNVTCTAKASCWLESVKSFFYGLKNMLGSVFGNFFIGILLFLAPFVLLVLFFMFGWKILFCFKCCRRTRGLLKYRLLKDDEETGYRRIIERLNNKKGKNRLLDGERLADRKIAELFSTKTHIG

SEQ ID NO: 1534 - protein, 972 aa, Artificial Sequence
  derived and/or modified protein sequence (wt) from CCHFV(44-ST-2010, Artificial)__KR814859.1__Gn-4aa-Gc
SEEPGDDCISRTQLLKTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEIMIPKGTGDILVDCSGGQQHFLKDNLIDLGCPHIPLLGKMAIYICRMSNHPRTTMAFLLWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLTVSLSPVQSAPVGRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRLNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEDDTKKCVDTKLDQPQSILIEHKGTIIGKQNDTCTAKASCWLESVKSFFYGLKNMLGSVFGNFFVGILLFLAPFVLLVLFFMCGWKILFCFKCCRRTRGLFKYRHLKDDEETGYRRIIERLNSKKGKNRLLDGERLADRKIAELFSTKSHIG

SEQ ID NO: 1535 - protein, 972 aa, Artificial Sequence
  derived and/or modified protein sequence (wt) from CCHFV(46-ST-2012, Artificial)__KR814860.1__Gn-4aa-Gc
SEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVGRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRINGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEEDTQKCVDTRLEQPQSILIEHKGTIIGKQNDTCTAKASCWLESVKSFFYGLKNMLGSVFGNFFIGILLFLAPFVLLVLFFMFGWKILFCFKCCRRTRGLLKYRHLKDDEETGYRRIIERLNNKKGKNRLLDGERLADRKIAELFSTKTHIG

SEQ ID NO: 1536 - protein, 972 aa, Artificial Sequence
  derived and/or modified protein sequence (wt) from CCHFV(47-ST-2013, Artificial)__KR814861.1__Gn-4aa-Gc
SEEPGDDCISRTQLLKTETAEIHDDNYGGPGDKITICNGSTIVDQRLGSELGCYTINRVKSFKLCKNSATGKTCEIDSTPVKCRQGFCLKITQEGRGHVKLSRGSEVVLDACDSSCEIMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLTVSLSPVQSAPVGRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGECPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEVSGLKFASLACTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGNFFVGILLFLAPFVLLVLFFMFGWKILFCFKCCRRTRGLFKYRHLKDDEETGYRRIIERLNSKKGKNRLLDGERLADRKIAELFSTKTHIG

SEQ ID NO: 1537 - protein, 972 aa, Artificial Sequence
  derived and/or modified protein sequence (wt) from CCHFV(52-R-2014, Artificial)__KR814862.1__Gn-4aa-Gc
SEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDTSCEVMIPKGTGDILVDCSGGQQHFLKDNLIDLGCPHVPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVGRKPLFLDSIVKGMKNLLNSTSLETSLSIEAPWGAINVQSTFKPTVSTANIALSWSSVEHRGNKILVTGRSESIMKLEERTGVSWDLGVDDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSNDPDVVAASTSLMARKLEFGTDSTFKAFSAMPKTSLCFYIVEREYCKSCSEEDTQKCVDTKLEQPQSILIEHKGTIIGKQNDTCTAKAGCWLESVKSFFYGLKNMLGSVFGNFFIGILLFLAPFVLLVLFFMFGWKILFCFKCCRRTRGLLKYRLLKDDEETGYRRIIERLNNKKGKNRLLDGERLADRKIAELFSTKTHIG

SEQ ID NO: 1538 - protein, 972 aa, Artificial Sequence
  derived and/or modified protein sequence (wt) from CCHFV(75-R-2012, Artificial)__KR814863.1__Gn-4aa-Gc
SEEPGDDCISRTQLLRTETAEIHDDNYGGPGDKITICNGSTIVDQRLGSELGCYTINRVKSFKLCENSATGKTCEIDSAPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVGRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEEDTQKCVDTKLEQPQSILIEHKGTIIGKQNDTCTAKASCWLESVKSFLYGLKNMLGSVFGNFFIGILLFLAPFVLLVLFFMFGWKILFCFKCCRRTRGLLKYRLLKDDEETGYRRIIERLNNKKGKNRLLDGERLADRKIAELFSTKTHIG

SEQ ID NO: 1539 - protein, 972 aa, Artificial Sequence
  derived and/or modified protein sequence (wt) from CCHFV(75-ST-2010, Artificial)__KR814864.1__Gn-4aa-Gc
SEESGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCLFCKALFYSLIIIGTLGKKIKQYRELRPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVGRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEEDTQKCVDTKLEQPQSILIEHKGTIIGKQNDTCTAKASCWLESVKSFFYGLKNMLGSVFGNFFIGILLFLAPFVLLVLFFMFGWKILFCFKCCRRARGLLKYRHLKDDEETGYRKIIERLNNKKGKNRLLDGERLADRKIAELFSTKTHIG

SEQ ID NO: 1540 - protein, 972 aa, Artificial Sequence
  derived and/or modified protein sequence (wt) from CCHFV(3756-ST-2007, Artificial)__KR814866.1__Gn-4aa-Gc
SEEPGDDCISRTQLLKTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEIMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLTVSLSPVQSAPVGRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLTCTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGSFFVGILLFLTPFVLLVLFFMFGWKILFCFKCCRRTRGLFKYRHLKDDEETGYRRIIERLNSKKGKNRLLDGERLADRKIAELFSTKTHIG

SEQ ID NO: 1541 - protein, 972 aa, Artificial Sequence
  derived and/or modified protein sequence (wt) from CCHFV(3809-ST-2007, Artificial)__KR814867.1__Gn-4aa-Gc
SEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVGRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEKEYCRSCSEEDTQKCVDTKLEQPQSILIEHKGTIIGKQNDTCTAKASCWLESVKSFFYGLKNMLGSVFGNFFIGILLFLTPFVLLVLFFMFGWKILFCFKCCRRTRGLLKYRHLKDDEETGYRRIIERLNNKKGKNRLLDGERLADRKIAELFSTKTHIG

SEQ ID NO: 1542 - protein, 972 aa, Artificial Sequence
  derived and/or modified protein sequence (wt) from CCHFV(3820-ST-2007, Artificial)__KR814868.1__Gn-4aa-Gc
SEEPGDDCISRTQLLKTETAEIHDDNYGSPGDKITICNGSTIVDQRLGSELGCYTINRVKSFKLCENSATGKTCEIDSTPVKCRQGFCLKITQEGRGHVKLSRGSEVVLDACDSSCEIMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLAVSLSPVQSAPVGRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLTCTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGSFFVGILLFLAPFVLLVLFFMFGWKILFCFKCCRRTRGLFKYRHLKDDEETGYRRIIERLNSKKGKNRLLDGERLADRKIAELFSTKTHIG

SEQ ID NO: 1543 - protein, 972 aa, Artificial Sequence
  derived and/or modified protein sequence (wt) from CCHFV(4495-ST-2008, Artificial)__KR814869.1__Gn-4aa-Gc
SEESGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCLFCKALFYSLIIIGTLGKKIKQYRELRPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVGRKPLFLDSIVKGMKNLLNSTSLETSLSIEAPWGAINVQSTFKPTVSTANIALSWSSVEHRGNKILVTGRSESIMKLEERTGISWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEEDTQRCVDTKLEQPQSILIEHKGTIIGKQNDTCTAKASCWLESVKSFFYGLKNMLGSVFGNFFIGILLFLAPFVLLVLFFMFGWKILFCFKCCRRARGLLKYRHLKDDEETGYRKIIERLNNKKGKNRLLDGERLADRKIAELFSTKTHIG

SEQ ID NO: 1544 - protein, 972 aa, Artificial Sequence
  derived and/or modified protein sequence (wt) from CCHFV(4691-ST-2009, Artificial)__KR814871.1__Gn-4aa-Gc
SEEPGDDCISRTQLLKTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEIMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLTVSLSPVQSAPVGRKPLFLDSIVKGMKNLLNSTSLETSLSIEAPWGAINVQSTFKPAVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGNFFVGILLFLAPFVLLVLFFMFGWKILFCFKCCRRTRGLFKYRHLKDDEETGYRRIIERLNSKKGKNRLLDGERLADRKIAELFSTKTHIG

SEQ ID NO: 1545 - protein, 972 aa, Artificial Sequence
  derived and/or modified protein sequence (wt) from CCHFV(4701-ST-2009, Artificial)__KR814872.1__Gn-4aa-Gc
SEEPGDDCISRTQLLKTETAEIHDDNYGGPGDKITICNGSTVVDQRLGSELGCYTINRVKSFKLCENSATGKTCEIDSTPVKCRQGFCLKITQEGRGHVKLSRGSEVVLDACDSSCEIMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLTVSLSPVQSAPVGRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLTCTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGGFFVGILLFLAPFVLLVLFFMFGWKILFCFKCCRRTRGLFKYRHLKDDEETGYRRIIERLNSKKGKNRLLDGERLADRKIAELFSTKTHIG

SEQ ID NO: 1546 - protein, 972 aa, Artificial Sequence
  derived and/or modified protein sequence (wt) from CCHFV(5170-R-2011, Artificial)__KR814873.1__Gn-4aa-Gc
SEEPGDDCISRTQLLKTETAEIHDDNYGGPGDKITICNGSTIVDQRLGSELGCYTINRVKSFKLCENSATGKTCEIDSTPVKCRQGFCLKITQEGRGHVKLSRGSEVVLDVCDSSCEIMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSEGLARHVTQCPKRKEKVEETELYLNLERIPWIVRKLLQVSESTGVALKRSSWLIVLLVLLTVSLSPVQSAPVGRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLTCTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGSFFVGILLFLAPFVLLVLFFMFGWKILFCFKCCRRTRGLFKYRHLKDDEETGYRRIIERLNSKKGKNRLLDGERLADRKIAELFSTKTHIG

SEQ ID NO: 1547 - protein, 972 aa, Artificial Sequence
  derived and/or modified protein sequence (wt) from CCHFV(Oman-199809166, Artificial)__KR864901.1__Gn-4aa-Gc
SEESGEDCISRTQLLRTETAEIHGDNYGGPGDKITICNGSTIVDQRLGSELGCYTINRVKSFKLCENSATGKSCEIDNTPVKCKQGFCLKITQEGRGHVKLSRDSEVVLDACDSSCEIMIPKGTGDILVDCSGGQQHFLKDNLIDLGCPNIPLLGKMAIYICRMSNHPKTTMAFLFWFSFGYVITCILCKVIFYLLIVVGTLGKKFKQYRELKPQTCTICETTPVNAIDAEMHDLNCSYNICPYCASRLTSDGLARHVMQCPKRKEKIEETELYLNLERIPWVVRKLLQVSESTGVALKRSSWLIVLLVLLTVSLSPVQSAPIGRKPLFLDSIAKGMKNLLNSTSLETSLSIEAPWGAINVQSTFKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIVTLHPRIEEGFFDLMHVQKVLSASTVCKLQSCTHGVPGDLQVYHIGNLLKGDKVNGHLIHKVEPHFNTSWMSWDGCDLDYYCNMGDWPSCTYTGVTQHNHAAFVNLLNIETDYTKNFHFHSKRVTAHGDTPQLDLKARPNYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSKEDTQKCVNAKLERPQSILIEHKGTIIGKQNDTCTAKASCWLESVKSFFYGLKNMLSGIFGNVFIGIFLFLAPFILLILFFMFGWRILFCFKCCRRTRGLFKYRHLKDDEETGYRKIIERLNNKKGKNKLLDGERLADRKIAELFSTKTHIG

SEQ ID NO: 1548 - protein, 972 aa, Artificial Sequence
  derived and/or modified protein sequence (wt) from CCHFV(200406546-Turkey, Artificial)__KR864902.1__Gn-4aa-Gc
SEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDVCDSSCEVMIPKGTGDILVDCSGGQQHFLKDNLIDLGCPHVPLLGRMAIYICRMSNHPRTTMAFLFWFSFGYVITCIFCKALFYSLIIIGTLGKKFKQYRELKPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVGRKPLFLDSIVKGMKNLLNSTSLETSLSIEAPWGAINVQSTFKPTVSTANIALSWSSIEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLTARKLEFGTDSTFKAFSAMPKTSLCFYIVEKEYCKSCNEDDTQKCVDTKLEQPQSILIEHKGTIIGKQNDTCTAKASCWLESVKSFFYGLKNMLGSVFGNFFIGILLFLAPFVLLVLFFMFGWKILFCFKCCRRTRGLFKYRHLKDDEETGYKRIIERLNNKKGKNRLLDGERLADRKIAELFSTKTHIG

SEQ ID NO: 1549 - protein, 972 aa, Artificial Sequence
  derived and/or modified protein sequence (wt) from CCHFV(1-CR/HU-2015, Artificial)__KU161584.1__Gn-4aa-Gc
SEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLTVSLSPVQSAPVGRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGNFFIGILLFLAPFVLLVLFFMFGWKILFCFKCCRRTRGLFKYRHLKDDEETGYRRIIERLNNKKGKNRLLDGERLADRKIAELFSTKTHIG

SEQ ID NO: 1550 - protein, 972 aa, Artificial Sequence
  derived and/or modified protein sequence (wt) from CCHFV(Gaib, Artificial)__KX013445.1__Gn-4aa-Gc
SEESSDDCISRTQLLRTETAEIHNDNYGGPGDKITICNGSTIVDQRLGSELGCYTINRVKSFKLCENSATGKSCEIDSIPVKCRQGFCLKITQEGRGHVKLSRGSEVVLDACDSSCEIMIPKGTGDILVDCSGGQQHFLKDNLIDLGCPNIPLLGKMAIYICRMSNHPKTTMAFLFWFSFGYVITCIFCKAIFYLLIIVGTLGKKFKQYRELKPQTCTICETTPVNAIDAEMHDLNCSYNICPYCASRLTSDGLARHVVHCPKRKEKIEETELYLNLERVPWVVRKLLQVSESTGVALKRSSWLIVLLVLLTVSLSPVQSAPIGRKPLFSDSIVKGMKNLLNSTSLETSLSIEAPWGAINVQSTFKPTVSTANIALSWSSIEHRGNKILVSGRSESIMKLEERTGISWDLGVEDASESRLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHAAFVNLLNIETDYTKNFHFHSKRVTAHGDTPQLDLKARPTYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSREDTQKCVSTKLEQPQSILIEHKGTIIGKQNNTCTTKTTCWLESVKSFFYGLKNMLSSIFGNVFVGIFSFLAPFILLILFFMFGWRILFCFKCCRRTRGLFKYRHLKDDEETGYRRIIERLNNKKGKSKLLDGERLADRKIAELFSTKTHIG

SEQ ID NO: 1551 - protein, 972 aa, Artificial Sequence
  derived and/or modified protein sequence (wt) from CCHFV(Hodzha, Artificial)__KX013448.1__Gn-4aa-Gc
SEESGDDCISRTQLLRTETAEIHGDDYGGPGDKITICNGSTIVDQRLGSELGCYTINRVKSFKLCENSATGKSCEIDSTPVKCRQGYCLKITQEGRGHVKLSRGSEVVLDACDSSCEVMIPKGTGDILVDCSGGQQHFLKDNLIDLGCPRIPLLGKMAIYICRMSNHPETTMAFLFWFSFGYVITCILCKAIFYLLIIVGTLGKRFKQYRELKPQTCTICETTPANAIDAEMHDLNCSYNICPYCASRLTSDGLARHVTQCPKRKEKVEETELYLNLERIPWIVRKLLQVSESTGVALKRSSWLIVLLVLFAVSLSPVQSAPIGRRPLFLDSIVKGKKNLLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCSERCGCTSSTCLHKEWPHSRNWRCNPTWCWGVGTGCTCCGLDVKDLFTDYMFVKWKVDYIKTEAIVCVELTSQERQCSLVEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFVNLLNIETDYTKSFHFHSKRVTAHGDTPQLDLKARPTYGAGEITVLVEVADMELHTKKIEITGLKFASLTCTGCYACSSGISCKVRIHVDEPDELTVHVKSDDPDVVAASSSLMARKLEFGTDSTFKAFSAMPKTSLCFYIVEREYCKSCSKEDTQKCVNTKLEQPQSILIEQKGTIIGKQNNTCTAKASCWLESVKSFFYGLKNMLSGIFGNVFVGIFLFLAPFILLILFFMFGWRILFCFKCCRRTRGLFKYKHLKDDEETGYRRIIERLNNKKGKNKLLDGERLADRRIAELFSTKTHIG

SEQ ID NO: 1552 - protein, 972 aa, Artificial Sequence
  derived and/or modified protein sequence (wt) from CCHFV(IbAn7620, Artificial)__KX013451.1__Gn-4aa-Gc
SEEPSDDCISRTQLLRTETAEIHGDNYGGPGDKITICNGSTIVDQRLGSELGCYTINRVKSFKLCENSATGKNCEIDSVPVKCRQGYCLRITQEGRGHVKLSRGSEIVLDACDTSCEIMIPKGTGDILVDCSGGQQHFLKDNLIDLGCPKIPLLGKMAIYICRMSNHPKTTMAFLFWFSFGYVITCILCKAIFYLLIIIGTLGKRLKQYRELKPQTCTICETTPVNAIDAEMHDLNCSYNICPYCASRLTSDGLARHVIQCPKRKEKVEETELYLNLERIPWVVRKLLQVSESTGVALKRSSWLIVLLVLFTVSLSPVQSAPIGRKPLFLDSIAKGMKNPLNSTSLETSLSIEAPWGAIDVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFVNLLNIETDYTKNFHFHSKRVTAHGDTPQLDLKARPTYGAGEITVLVEVANMELHTKKIEISGLKFASLTCTGCYACSSGISCKVRIHVDEPDELTVHVKSDDPDVVAASSSLMARKLEFGTDSTFKAFSAMPKTSLCFYIVEREHCKSCSEEDTKKCVNTKLEQPQSILIEHKGTIIGKQNSTCTAKASCWLESVKSFFYGLKNMLSGIFGNVFMGIFLFLAPFILLILFFMFGWRILFCFKCCRRTRGLFKYRHLKDDEETGYRRIIERLNNKKGKNKLLDGERLADRRIAELFSTKTHIG

SEQ ID NO: 1553 - protein, 972 aa, Artificial Sequence
  derived and/or modified protein sequence (wt) from CCHFV(K128_76, Artificial)__KX013454.1__Gn-4aa-Gc
SDESGDDCISRTQLLRTETAEIHGDNYGGPGDKITICNGSTIVDQRLGSELGCYTINRVKSFKLCENSATGKSCEIDSIPVKCRQGYCLKITQEGRGHVKLSRGSEVVLDACDSSCEVMIPKGTGDILVDCSGGQQHFLKDNLIDLGCPKIPLLGKMAIYICRMSNHPKTTMAFLFWFSFGYVITCIVCKAIFYLLIIVGTLGKRFKQYRELKPQTCTICETTPTNAIDAEMHDLNCSYNICPYCASRLTSDGLARHVTHCPKRKEKVEETELYLNLERIPWVVRKLLQVSESTGVALKRSSWLIVLLVLFAVSLSPVQSAPISRRPLFQDSIVKGMKNLLNSTSLETSLSIEAPWGAINVQSTYKPAVSAANIALSWSSVEHRGSKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDRVNGHLIHKIEPHFNTSWMSWDGCDLDYYCNMGDWPSCTYTGVTQHNHASFVNLLNIETDYTKSFHFHSKRVTAHGDTPQLDLKARPNYGAGEITVLVEVADMELHTKKIEISGLKFASLTCTGCYACSSGISCKVRIHVDEPDELTVHVKSDDPDVVAASSSLMARKLEFGTDSTFKAFSAMPKTSLCFYIVEREYCKSCSKEDTQKCVNTKLEQPQSILIEHKGTIIGKQNNTCTAKTSCWLESVKSFFYGLKNMLSGIFGNVFVGIFLFLAPFILLILFFMFGWRILFCFKCCRRTRGLFRYKHLENDEETGYRRIIERLNNKKGKNKLLDGERLADRRIAELFSTKTHIG

SEQ ID NO: 1554 - protein, 972 aa, Artificial Sequence
  derived and/or modified protein sequence (wt) from CCHFV(K168_40, Artificial)__KX013457.1__Gn-4aa-Gc
SDESGDDCISRTQLLRTETAEIHGDNYGGPGDKITICNGSTIVDQRLGSELGCYTINRVKSFKLCENSATGKSCEVDSIPVKCRQGYCLKITQEGRGHVKLSRGSEVVLDACDSSCEVMIPKGTGDILVDCSGGQQHFLKDNLIDLGCPKIPLLGKMAIYICRMSNHPKTTMAFLFWFSFGYVITCIVCKAIFYLLIIVGTLGKRFKQYRELKPQTCTICETTPTNAIDAEMHDLNCSYNICPYCASRLTSDGLARHVTHCPKRKEKVEETELYLNLERIPWVVRKLLQVSESTGVALKRSSWLIVLLVLFAVSLSPVQSAPIGRRPLFLDGIVKGMKNLLNSTSLETSLSIEAPWGAINVQSTYKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFINLLNIETDYTKSFHFHSKRVTAHGDTPQLDLKARPNYGAGEITVLVEVADMELHTKKIEISGLKFASLTCTGCYACSSGISCKVRIHVDEPDELTVHVKSDDPDVVAASSSLMARKLEFGTDSTFKAFSAMPKTSLCFYIVEREYCKSCSKEDTQKCVNTKLEHPQSILIEHKGTIIGKQNNTCTAKTSCWLESVKSFFYGLKNMLSGIFGNVFVGIFLFLAPFILLILFFMFGWRILFCFKCCRRTRGLFRYKHLEDDEETGYRRIIERLNNKKGKNKLLDGERLADRRIAELFSTKTHIG

SEQ ID NO: 1555 - protein, 972 aa, Artificial Sequence
  derived and/or modified protein sequence (wt) from CCHFV(K168_125, Artificial)__KX013460.1__Gn-4aa-Gc
SDESGDDCISRTQLLRTETAEIHGDNYGGPGDKITICNGSTIVDQRLGSELGCYTINRVKSFKLCENSATGKSCEVDSIPVKCRQGYCLKITQEGRGHVKLSRGSEVVLDACDSSCEVMIPKGTGDILVDCSGGQQHFLKDNLIDLGCPKVPLLGKMAIYICRMSNHPKTTMAFLFWFSFGYVITCIVCKAIFYLLIIVGTLGKRFKQYRELKPQTCTICETTPTNAIDAEMHDLNCSYNICPYCASRLTSDGLARHVTHCPKRKEKVEETELYLNLERIPWVVRKLLQVSESTGVALKRSSWLIVLLVLFAVSLSPVQSAPIGRRPLFLDSIVKGKKNLLNSTSLETSLSIEAPWGAINVQSTYKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFINLLNIETDYTKSFHFHSKRVTAHGDTPQLDLKARPNYGAGEITVLVEVADMELHTKKIEISGLKFASLTCTGCYACSSGISCKVRIHVDEPDELTVHVKSDDPDVVAASSSLMARKLEFGTDSTFKAFSAMPKTSLCFYIVEREYCKSCSKEDTQKCVNTKLEHPQSILIEHKGTIIGKQNNTCTAKTSCWLESVKSFFYGLKNMLSGIFGNVFVGIFLFLAPFILLILFFMFGWRILFCFKCCRRTRGLFRYKHLEDDEETGYRRIIERLNNKKGKNKLLDGERLADRRIAELFSTKTHIG

SEQ ID NO: 1556 - protein, 972 aa, Artificial Sequence
  derived and/or modified protein sequence (wt) from CCHFV(K229_194, Artificial)__KX013463.1__Gn-4aa-Gc
SEEPGDDCISRTQLLKTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEIMIPKGTGDILVDCSGGQQHFLKGNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLTVSLSPVQSAPVGRKPLFLDSIVKGKKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRLNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYSCSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGNFFVGILLFLAPFVLLVLFFMFGWKILFCFKCCRRTRGLFKYRHLKDDEETGYRKIIERLNSKKGKNRLLDGERLADRKIAELFSTKTHIG

SEQ ID NO: 1557 - protein, 972 aa, Artificial Sequence
  derived and/or modified protein sequence (wt) from CCHFV(K229_243, Artificial)__KX013466.1__Gn-4aa-Gc
SEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVGRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEKEYCKSCSEEDTQKCVDTKLEQPQSILIEHKGTIIGKQNDTCTAKASCWLESVKSFFYGLKNMLGSVFGNFFIGILLFLTPFVLLVLFFMFGWKILFCFKCCRRTRGLLKYRHLKDDEETGYRRIIERLNNKKGKNRLLDGERLADRKIAELFSTKTHIG

SEQ ID NO: 1558 - protein, 972 aa, Artificial Sequence
  derived and/or modified protein sequence (wt) from CCHFV(K315_14, Artificial)__KX013469.1__Gn-4aa-Gc
SEEPGDDCISRTQLLKTETAEIHDDNYGGPGDKITICNGSTVVDQRLGSELGCYTINRVKSFKLCKNSATGKTCEIDSTPVKCRQGFCLKITQEGRGHVKLSRGSEVVLDVCDSSCEIMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSEGLARHVTQCPKRKEKVEETELYLNLERIPWIVRKLLQVSESTGVALKRSSWLIVLLVLLTVSLSPVQSAPVGRKPLFLDSIVKGMKKLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLTCTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGSFFVGILLFLAPFVLLVLFFMFGWKILFCFKCCRRTRGLFKYRHLKDDEETGYRRIIERLNSKKGKNRLLDGERLADRKIAELFSTKTHIG

SEQ ID NO: 1559 - protein, 972 aa, Artificial Sequence
  derived and/or modified protein sequence (wt) from CCHFV(K323_27, Artificial)__KX013472.1__Gn-4aa-Gc
SEEPGDDCISRTQLLKTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEIMIPKGTGDILVDCSGGQQHFLKDNLIDLGCPHIPLLGKMAIYICRMSNHPRTTMAFLFWFSFGYVITCIFCKALFYLLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLTVLLVLLTVSLSPVQSAPVGRKPLFLDSIAKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTGQERQCSLIEAGTRFNLGPVTITLSEPRNIQQKLPPEIITLHPKIEEGFFDLMHVQKVLSASTVCKLQSCTHGIPGDLQIYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLTCTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGSFFVGILLFLAPFVLLVLFFMFGWKILFCFKCCRRTRGLFKYRHLNDDEETGYRRIIERLNSKKGKNRLLDGERLADRKIAELFSTKTHIG

SEQ ID NO: 1560 - protein, 972 aa, Artificial Sequence
  derived and/or modified protein sequence (wt) from CCHFV(K340_6, Artificial)__KX013475.1__Gn-4aa-Gc
SEEPGDDCISRTQLLKTETAEIHDDNYGGPGDKITICNGSTIVDQRLGSELGCYTINRVKSFKLCENSTTGKTCEIDSTPVKCRQGFCLKITQEGRGHVKLSRGSEVVLDACDSSCEIMIPKGTGDILVDCSGGQQHFLKDNLIDLGCPHIPPLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLTVSLSPVQSAPVGRKPLSLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVTDMELHTKKVEISGLKFASLTCTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGSFFVGILLFLAPFVLLVLFFMFGWKILFCFKCCRRTRGLFKYRHFKDDEETGYRRIIERLNSKKGKNRLLDGERLADRKIAELFSTKTHIG

SEQ ID NO: 1561 - protein, 972 aa, Artificial Sequence
  derived and/or modified protein sequence (wt) from CCHFV(Mamon, Artificial)__KX013478.1__Gn-4aa-Gc
SEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVSDACDSSCEVMIPKGTGDILVDCSGGQQHFLKDNLIDLGCPHIPLLGKMAIYICRMSNHPRTTVAFLFWFSFGYVITCIFCKALFYSLIIIGTLGKKIKQYRELKPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVGRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEEDTQKCVDTKLEQPQSILIEHKGTIIGKQNDTCTAKTSCWLESVKSFFYGLKNMLGSVFGNFFIGILLFLAPFVLLVLFFMFGWKILFCFKCCRRTRGLLKYRHLKDDEETGYRRIIERLNNKKGKNRLLDGERLADRKIAELFSTKTHIG

SEQ ID NO: 1562 - protein, 972 aa, Artificial Sequence
  derived and/or modified protein sequence (wt) from CCHFV(Min, Artificial)__KX013481.1__Gn-4aa-Gc
SEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVGRKPLFLDSIVKGTKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRINGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEEDTQKCVDTKLEQPQSILIEHKGTIIGKQNDTCTAKASCWLESVKSFFYGLKNMLGSVFGNFFIGILLFLAPFVLLVLFFMFGWKILFCFKCCRRTRGLLKYRHLKDDEETGYRRIIERLNNKKGKNRLLDGERLADRKIAELFSTKTHIG

SEQ ID NO: 1563 - protein, 972 aa, Artificial Sequence
  derived and/or modified protein sequence (wt) from CCHFV(Nakiwogo, Artificial)__KX013484.1__Gn-4aa-Gc
AEGVSNDCVSRTQLIKTEVAEIHEDSYGGPGEKITICNGSTIVDQRLGSELGCYTINRVKTYKLCENSATEKGCEIDSVPVKCKQGFCLKVTQEGRGHVKLSRGTEIVLDVCDTSCELMIPKGTGDILVDCSGGQQHFLQDNLIDLGCPNVPLLGKMAIYICRMSNHPKTTMAFLFWFSFGYVITCVVCKVLFYLLIVIGTLGKKLKQYRELKPQTCIVCESIPVNVIDAEMHELNCNYNICPYCASRLTSDGLVRHVTQCPKRKEKVEETELYLNLERIPWLVRRLLQVSESTGMALKRSCWMTTLLILLVVSLSPVQSAPVGRKPLYLDSIAKGMKSLLNSTNLETSLSIEAPWGAINVQSTFKPTVSAANIALSWSSVEHRGNKILVSGRSESIMKLEERTGISWSLGVEDASESKTLTVSVMDLSQMYSPVFEYLSGDRQVEEWPKATCTGDCPERCGCTSSTCLHKEWPHSRNWRCNPTWCWGVGTGCTCCGLDVRDLFTDYMMVKWKVEYVKTEAIMCVELTSQERQCSLIEAGTRFNLGPVTITLSEPRNVQQRLPSEIVTLHPKIEEGFFDLMHVQKVLFCKHSLQATSCTHGVPGDLQVYHVGNLLKGDKVNGHSIHKIESHFNTSWMSWDGCDLDYFCNMGDWPSCTYTGVTQHNRAAFVNMLNIETDYTKTFHFHSKRVTAHGDTPQLDLKARPTYGAGEVTVLVEVADLELHTKKIEVSGLKFASLTCSGCYACSSGISCKVRIHVNEPDEFTVHVKSNDPDVVAAGSSLMARKIELGADSTFKAFSSMPKNSLCFYIVERDYCSSCTDDDTQKCVNTKLEHPQSILIEHKGTIIGKQNDTCPTKTSCWLESVKSFFYGLKNMLGGIFGNVFLGIFLFLAPFALLILFFFFGWRLLFCLKCCRRTRGLLKYKQLKDEEEAGYKKIIERLNDKKGKSRLFDGERLADRKIAELFSTKTHIG

SEQ ID NO: 1564 - protein, 972 aa, Artificial Sequence
  derived and/or modified protein sequence (wt) from CCHFV(Saf, Artificial)__KX013487.1__Gn-4aa-Gc
SEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHYLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVGRKPLFSDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYMKTFHFHSKRVTAHGDTPQLDLKARPTYGAGEITVLVEVADMELHTKKVEISGLKFVSLACTGCYACSSGISCKVRIHVDEPDELTVHVKSSDPDVVAASTSLMARKLEFGTDSTFKAFSAMPKTSLCFYIVEREYCKSCSEEDTQKCVDTKLEQPQSILIEHKGTIIGKQNDTCTAKASCWLESVKSFFYGLKNMLGSVFGNFFIGILLFLAPFVLLVLFFMFGWKILFCFKCCRRTRGLLKYRHLKDDEETGYRRIIERLNNKKGKNRLLDGERLADRKIAELFSTKTHIG

SEQ ID NO: 1565 - protein, 972 aa, Artificial Sequence
  derived and/or modified protein sequence (wt) from CCHFV(Ast199, Artificial)__KX056051.1__Gn-4aa-Gc
SEEPGDDCISRTQLLKTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEIMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRCSWLIVLLVLLTVSLSPVQSAPVGRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRLNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEVSGLKFASLACTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGNFFVGILLFLAPFVLLVLFFIFGWKILFCFKCCRRTRGLFKYRHLKDDEETGYRKIIERLNSKKGKNRLLDGERLADRKIAELFSTKTHIG

SEQ ID NO: 1566 - protein, 972 aa, Artificial Sequence
  derived and/or modified protein sequence (wt) from CCHFV(Ast149, Artificial)__KX056054.1__Gn-4aa-Gc
SEEPGDDCISRTQLLKTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEIMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLTVSLSPVQSAPVGRKPLFLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRLNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEVSGLKFASLACTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGNFFVGILLFLAPFVLLALFFIFGWKILFCFKCCRRTRGLFKYRHLKDDEETGYRKIIERLNSKKGKNRLLDGERLADRKIAELFSTKTHIG

SEQ ID NO: 1567 - protein, 972 aa, Artificial Sequence
  derived and/or modified protein sequence (wt) from CCHFV(Ast137, Artificial)__KX056057.1__Gn-4aa-Gc
SEEPGDDCISRTQLLKTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEIMIPKGTGDILVDCSGGQQHFLKDNLIDLGCPHIPLLGKMAIHICRMSNHPRTTMAFLFWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLTVSLSPVQSAPVGRKPLFLDSIVKGTKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRLNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEVSGLKFASLACTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGNFFVGILLFLAPFVLLVLFFIFGWKILFCFKCCRRTRGLFKYRHLKDDEETGYRKIIERLNSKKGKNRLLDGERLADRKIAELFSTKTHIG

SEQ ID NO: 1568 - protein, 972 aa, Artificial Sequence
  derived and/or modified protein sequence (wt) from CCHFV(Ast133, Artificial)__KX056060.1__Gn-4aa-Gc
SEEPDDDCISRTQLLKTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEIMIPKGTGDILVDCSGGQQHFLKDNLIDLGCPHIPLLGKMAIYICRMSNHPRTTMAFLFWFSFGYVITCIFCKALFYLLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLTVSLSPVQSAPVGRKPLFSDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLTCTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGSFFVGILLFLAPFVLLVLFFMFGWKILFCFKCCRRTRGLFKYRHLKDDEETGYRRIIERLNSKKGKNRLLDGERLADRKIAELFSSKTHIG

SEQ ID NO: 1569 - protein, 972 aa, Artificial Sequence
  derived and/or modified protein sequence (wt) from CCHFV(SK/2015/human, Artificial)__KX458183.1__Gn-4aa-Gc
SEESGDDCISRTRLLRTETAEIHGDSYGGPGDKITICNGSTIVDQRLGSEMGCYTINRVKSFKLCENSATGKSCEIDSIPVRCRQGYCLKITQEGRGHVKLSRGSEVVLDACDSSCEVMIPKGTGDILVDCSGGQQHFLKDNLIDLGCPNIPLLGKMAIYICRMSNHPKTTMAFLFWFSFGYVITCILCKAIFYLLIIVGTLGKRFKQYRELKPQTCTICETTPANAIDAEMHDLNCSYTICPYCASRLTSDGLARHVTQCPKRKEKVEETELYLNLERIPWVVRKLLQVSESTGVALKRSSWLIVLLVLFTVSLSPVQSAPIGRRPLFLDSIVRGMKNLLNSTSLETSLSIEAPWGAINVQSTYKPTVSTANIALSWSSVEHRGNKILVSGRSESIMKLEERTGVSWDLGVEDASESKLLTVSVMDLSQMYSPVFEYLSGDRQVEEWPKATCTGDCPERCGCTTSTCLHKEWPHSRNWRCNPTWCWGVGTGCTCCGLDVKDLFTDYMFVKWKVEYIKTEAIVCVELTSQGRQCSLIEAGTRFNLGSVTITLSEPRNIQHKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFVNLLNIETDYTKNFHFHSKRVTAHGDTPQLDLKARPTYGAGEITVLVEVADMELHTKKIEISGLKFASLTCTGCYACSSGISCKVRIHVDEPDELTVHVKSDDPDVVAASSSLMARKLEFGTDSTFKAFSAMPKTSLCFYIVEREYCKSCSKEDTQKCVNTKLEQPQSILIEHRGTIIGKQNNTCIAKASCWLESVKSFFYGLKNMLSGIFGNLFLGIFLFLAPFILLILFFMFGWRILFCFKCCRRTRGLFKYRHLKDDEETGYRRIIERLNNKKGKNKLLDGERLADRRIAELFSTKTHIG

SEQ ID NO: 1570 - protein, 972 aa, Artificial Sequence
  derived and/or modified protein sequence (wt) from CCHFV(YL16070, Artificial)__KY354081.1__Gn-4aa-Gc
AEGGSSDCISRTQLVKTEVAEIHEDSYGGPGEKITICNGSTIVDQRLGSELGCYTINRVKSYKLCENSASGKSCEIDSIPVKCKQGFCLKITQEGRGHVKLSRGTEIVLDVCDSSCELMIPKGTGDILVDCSGGQQHFLQNNLIDLGCPNVPLLGKMAIYVCRMSNHPKTTMAFLFWFSFGYVITCIVCRVLFYLLIAIGTVGKKLKQYRELKPQTCIVCESVPVNAIDAEMHELNCSYNICPYCASRLSTDGLIRHVTQCPKRREKVEETELFLNLERIPWLVRKLLQVSESTGMALKRSCWMITLLILLLVSMSPVQSAPVGRKPLFLDSIAKGMKSLLNSTSLETSLSIEAPWGAINVQSTFKPTVSAANIALSWSSVEHRGNKILVSGRSESIMKLEERTGVSWNLGVEDASESKTLTVSVMDLSQMYSPVFEYLSGDRQVEEWPKATCTGDCPERCGCTSSTCLHKEWPHSRNWRCNPTWCWGVGTGCTCCGLDVKDFFTDYMLVKWKVEYIKTEAIVCVELTSQERQCSLIEAGTRFNLGPVTITLSEPRNVQQRLPPEIVTLHPKIEEGFFDLMHVQKILSASTVCKLQSCTHGVPGDFQVYHVGNLLRGDKVNGHSIHKIEPHFNTSWMSWDGCDLDYFCNMGDWPSCTYTGVTQHNRAAFINMLNIETDYTKTFHFHSKRVTAHGDTPQLDLKARPAYGAGEVTVLVEVADLELHTKKLEVSGLKIASLTCSGCYACSSGISCKVRIHVNEPDEFTVHVRSSDPDVVAAGSSLMARKIEFGADSTFKAFSSMPKDSLCFYIVEKDYCSSCTDDDTQKCVNTKLDHPQSILIEHKGTIIGKQNDTCSTKTSCWLKSFKGFFYGLKNMLSGIFGNVFLGILLFLAPFVLLIFFFFFGWRLLFCLKCCKKTKGLLKYKHLKDKEEAGYKKIIERLNGKKGKSQLFDGERLANRKIAELFSTKIHIG

SEQ ID NO: 1571 - protein, 972 aa, Artificial Sequence
  derived and/or modified protein sequence (wt) from CCHFV(Oman_812956, Artificial)__KY362518.1__Gn-4aa-Gc
SEESGEDCISRTQLLRTETAEIHGDNYGGPGDKITICNGSTIVDQRLGSELGCYTINRVKSFKLCENSATGKSCEIDNTPVKCKQGFCLKITQEGRGHVKLSRDSEVVLDACDSSCEIMIPKGTGDILVDCSGGQQHFLKDNLIDLGCPNIPLLGKMAIYICRMSNHPKTTMAFLFWFSFGYVITCILCKVIFYLLIVVGTLGKKFKQYRELKPQTCTICETTPVNAIDAEMHDLNCSYNICPYCASRLTSDGLARHVMQCPKRKEKIEETELYLNLERIPWVVRKLLQVSESTGVALKRSSWLIVLLVLLTVSLSPVQSAPIGRKPLFFDSIAKGMKNLLNSTSLETSLSIEAPWGAINVQSTFKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIVTLHPRIEEGFFDLMHVQKVLSASTVCKLQSCTHGVPGDLQVYHIGNLLKGDKVNGHLIHKVEPHFNTSWMSWDGCDLDYYCNMGDWPSCTYTGVTQHNHAAFVNLLNIETDYTKNFHFHSKRVTAHGDTPQLDLKARPNYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSKEDTQKCVNAKLERPQSILIEHKGTIIGKQNDTCTAKASCWLESVKSFFYGLKNMLSGIFGNVFIGIFLFLAPFILLILFFMFGWRILFCFKCCRRTRGLFKYRHLKDDEETGYRKIIERLNNKKGKNKLLDGERLADRKIAELFSTKTHIG

SEQ ID NO: 1572 - protein, 972 aa, Artificial Sequence
  derived and/or modified protein sequence (wt) from CCHFV(UCCR4405, Artificial)__KY484029.1__Gn-4aa-Gc
SEEPGDDCISRTQLLKTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLKCSYNICPYCASRLTSDGLARHVTQCPKRKEKVEETELYLNLERIPWIVRKLLQVSESTGVALKRSSWLIVLLVLLTVSLSPVQSAPVGRKPLFLDSTVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRVNGHLIHKIEPHFNTSWMSWDGCDLDYYCNMGNWPSCTYTGVTQHNHAAFVNLLNIETDYTKTFHFHSKRVTAHGDTPQLDLKARPTYGAGEITVLVEVADMELHTKKVEISGLKFASLVCTGCYACSSGISCKVRIHVDEPDELTVHVKSSDPDVVAASTSLMARKLEFGTDSIFKAFSAMPKTSLCFYIVEREYCKSCSEDDTKKCVDTKLEQPQSILIEHKGTIIGKQNDTCTAKASCWLESVKSFFYGLKNMLGSVFGNFFVGILLFLAPFVLLVLFFMFGWKILFCFKCCRRTRGLFKYRHLKDDEETGYRRIIERLNSKKGKNRLLDGERLADRKIAELFSTKTHIG

SEQ ID NO: 1573 - protein, 972 aa, Artificial Sequence
  derived and/or modified protein sequence (wt) from CCHFV(UCCR4401, Artificial)__KY484035.1__Gn-4aa-Gc
SEEPSDDCISRTQLLRTETAEIHGDNYGGPGDKITICNGSTIVDQRLGSELGCYTINRVRSFKLCENSATGKNCEIDSVPVKCRQGYCLRITQEGRGHVKLSRGSEVVLDACDTSCEIMIPKGTGDILVDCSGGQQHFLKDNLIDLGCPKIPLLGKMAIYICRMSNHPKTTMAFLFWFSFGYVITCILCKAIFYLLIIVGTLGKRLKQYRELKPQTCTICETTPVNAIDAEMHDLNCSYNICPYCASRLTSDGLARHVIQCPKRKEKVEETELYLNLERIPWVVRKLLQVSESTGVALKRSSWLIVLLVLFTVSLSPVQSAPIGRKPLFLDSTAKGMKNLLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFVNLLNIETDYTKNFHFHSKRVTAHGDTPQLDLKARPTYGAGEITVLVEVADMELHTKKIEISGLKFASLACTGCYACSSGISCKVRIHVDEPDELTVHVKSDDPDVVAASSSLMARKLEFGTDSTFKAFSAMPKTSLCFYIVEREHCKSCSEEDTKKCVNTKLEQPQSILIEHKGTIIGKQNSTCTAKASCWLESVKSFFYGLKNMLSGIFGNVFMGIFLFLAPFILLILFFMFGWRILFCFKCCRRTRGLFKYRHLKDDEETGYRRIIEKLNNKKGKNKLLDGERLADRRIAELFSTKTHIG

SEQ ID NO: 1574 - protein, 972 aa, Artificial Sequence
  derived and/or modified protein sequence (wt) from CCHFV(UCCR4448, Artificial)__KY484042.1__Gn-4aa-Gc
SEETSDDCISRTQLLRTETAEIHGDNYGGPGDKITICNGSTIVDQRLGSELGCYTINRVKSFKLCENSATGKSCEIDSVPVKCRQGYCLRITQEGRGHVKLSRGSEVVLDACDTSCEIMIPKGTGDILVDCSGGQQHFLKDNLIDLGCPKIPLLGKMAIYICRMSNHPKTTMAFLFWFSFGYVITCILCKAIFYLLIIIGTLGKRFKQYRELKPQTCTICETTPVNAIDAEMHDLNCSYNICPYCASRLTSDGLARHVTQCPKRKEKVEETELYLNLERIPWVVRKLLQVSESTGVALKRSSWLIVLLVLFTISLSPVQSAPISRKPLFLDSIVKGMKNLLNSTSLETSLSIEAPWGAINVQSTYKPTVSTANIALSWSSVEHRGNKILVSGRSESIMKLEEKTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFVNLLNIETDYTKNFHFHSKRVTAHGDTPQLDLKARPTYGAGEITVLVEVADMELHTKKIEISGLKFASLTCTGCYACSSGISCKVRIHVDEPDELTVHVKSDDPDVVAASSSLMARKLEFGTDSTFKAFSAMPKTSLCFYIVEREHCKSCSEEDTKKCVNTKLEQPQSILIEHKGTIIGKQNSTCTAKASCWLESVKSFFYGLKNMLSGIFGNVFIGIFLFLAPFILLILFFMFGWKILFCFKCCRRTRGLFKYRHLKDDEETGYRRIIERLNNKKGKNKLLDGEILADRRIAELFSTKTHIG

SEQ ID NO: 1575 - protein, 972 aa, Artificial Sequence
  derived and/or modified protein sequence (wt) from CCHFV(SPU 45/88, Artificial)__KJ682809.1__Gn-4aa-Gc
SEESSDDCLSRTQLLRTENTEIHSDNYGGPGDKITICNGSTIVDQRLGSELGCYTINRVKSFKLCENSATGKSCEIDSTPVRCRQGFCLKITQEGRGHVKLSRGSEVVLDACDSSCEIMIPKGTGDILVDCSGGQQHFLKDNLVDLGCPNIPLLGKMAIYICRMSNHPKTTMGFLFWFSFGYVITCILCKVIFYLLIVVGTLGKKFKQYRELKPQTCTICETTPVNAIDAEMHDLNCSYNICPYCASRLTSDGLARHVMQCPKRKEKIEETELYLNLERIPWIVRKLLQVSESTGVALKRSSWLVVLLVLLTVSLSPVQSAPIGRKPLFLDSIVKGKKNLLNSTSLETSLSIEAPWGAINVQSTFKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVDYIKTEAIVCVELTSQERQCSLIEAGTRFNLGPVTITLSEPRNIQQKLPPEIVTLHPRIEEGFFDLMHVQNVLSASTVCKLQSCTHGVPGDLQIYHIGNLLKGDKVNGHLIHKIEPHFNTSWMSWDGCDLDYYCNMGDWPSCSYTGVTQHNHAAFVNMLNIETDYTKNFHFHSKRVTAHGDTPQLDLKARPTYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSKEDTQKCVNTKLEQPQSILIEHKGTIIGKQNDTCTAKASCWLESVKSFFYGLKNMLSGIFGNVFIGILLFLAPFIMLILFFMFGWRILFCFKCCRRTRGLFKYRHLKDDEEIGYRKIIERLNNKKGKNKLLDGERLADRKIAELFSTKTHIG

SEQ ID NO: 1576 - protein, 972 aa, Artificial Sequence
  derived and/or modified protein sequence (wt) from CCHFV(3010, Artificial)__DQ019222.1__Gn-4aa-Gc
AEGVSNDCVSRTQLIKTEVAEIHEDSYGGPGEKITICNGSTIVDQRLGSELGCYTINRVKTYKLCENSATEKGCEIDSVPVKCKQGFCLKVTQEGRGHVKLSRGTEIVLDVCDTSCELMIPKGTGDILVDCSGGQQHFLQDNLIDLGCPNVPLLGKMAIYICRMSNHPKTTMAFLFWFSFGYVITCIVCKVLFYLLIVIGTLSKKLKQYRELKPQTCIVCESTPVNAIDAEMHELNCNYNICPYCASRLTSDGLVRHVNQCPKRKEKVEETELYLNLERIPWLVRRLLQVSESTGMALKRSCWMTTLLILLVVSLSPVQSAPVGRRPLFLDSIVKGMKNLLNSTSLETSLSIEAPWGAINVQSTYKPTVSTANIALSWSSVEHRGNKVLVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGSVTITLSEPRNIQQKLPPEIITLHPKIEEGFFDLMHVQKVLSASTVCKLQSCTHGVPGDLQVYHIGNLLKGDRVNGHLIHKIEQHFNTSWMSWDGCDLDYYCNMGDWPSCTYTGVTQHNHASFVNLLNIETDYTKTFHFHSKRVTAHGDTPQLDLKARPTYGAGEVTVLVEVADMELHTKKIEISGLKFAGLTCTGCYACSSGISCKVRIHVDEPDELTVHVKSDDPDVVAASSSLMARKLEFGTDSTFKAFSAMPKTSLCFYIVEREYCKSCSKEDTQKCVNTKLEQPQSILIEHKGTIIGKQNNTCTAKASCWLESVKSFFYGLKNMLGGIFGNVFIGIFTFLTPFILLILFFMFGWRILFCFKCCRRTRGLFKYRHLKDDEETGYRKIIERLNNKKGKNRLLDGERLADRKIAELFSTKTHIG

SEQ ID NO: 1577 - protein, 324 aa, Artificial Sequence
  derived and/or modified protein sequence (wt) from CCHFV(10200)__U39455.2__Gn
SEEPSDDCVSRTQLLRTETAEIHGDNYGGPGDKITICNGSTIVDQRLGSELGCYTINRVRSFKLCENSATGKNCEIDSVPVKCRQGYCLRITQEGRGHVKLSRGSEVVLDACDTSCEIMIPKGTGDILVDCSGGQQHFLKDNLIDLGCPKIPLLGKMAIYICRMSNHPKTTMAFLFWFSFGYVITCILCKAIFYLLIIVGTLGRRLKQYRELKPQTCTICETTPVNAIDAEMHDLNCSYNICPYCASRLTSDGLARHVIQCPKRKEKVEETELYLNLERIPWVVRKLLQVSESTGVALKRSSWLIVLLVLFTVSLSPVQSAPIG

SEQ ID NO: 1578 - protein, 324 aa, Artificial Sequence
  derived and/or modified protein sequence (wt) from CCHFV(IbAr10200)__AF467768.2__Gn
SEEPSDDCISRTQLLRTETAEIHGDNYGGPGDKITICNGSTIVDQRLGSELGCYTINRVRSFKLCENSATGKNCEIDSVPVKCRQGYCLRITQEGRGHVKLSRGSEVVLDACDTSCEIMIPKGTGDILVDCSGGQQHFLKDNLIDLGCPKIPLLGKMAIYICRMSNHPKTTMAFLFWFSFGYVITCILCKAIFYLLIIVGTLGKRLKQYRELKPQTCTICETTPVNAIDAEMHDLNCSYNICPYCASRLTSDGLARHVIQCPKRKEKVEETELYLNLERIPWVVRKLLQVSESTGVALKRSSWLIVLLVLFTVSLSPVQSAPIG

SEQ ID NO: 1579 - protein, 324 aa, Artificial Sequence
  derived and/or modified protein sequence (wt) from CCHFV(Turkey-Kelkit06)__GQ337054.1__Gn
SEEPGDDCISRTQLLRTETAEIHDDNYGGPGDKITICNGSTIVDQRLGSELGCYTINRVKSFKLCKNSATGKTCEVDSTPVKCRQGFCLKITQEGRGHVKLSRGSEVVLDACDSSCEVMIPKGTGDILVDCSGGQQHFLKDNLIDLGCPHIPLLGRMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLTVSLSPVQSAPVG

SEQ ID NO: 1580 - protein, 324 aa, Artificial Sequence
  derived and/or modified protein sequence (wt) from CCHFV(SR3)__AJ538199.1__Gn
SEESGDDCISRTQLLRTETAEVHGDNYGGPGDKITICNGSTVVDQRLGSELGCYTINRVRSFKLCENSATGKSCEIDSIPVKCKQGYCLKITQEGRGHVKLSRGSEVVLDVCDSSCEVMIPKGTGDILVDCSGGQQHFLKDNLVDLGCPKIPLLGKMAIYICRMSNHPKTTMAFLFWFSFGYVITCILCKAIFFLLIIFGTLGKRFKQYRELKPQTCTICETTPVNAIDAEMHDLNCSYNICPYCASRLTSDGLARHVTQCPRRKEKVEETELYLNLERIPWVVRKLLQVSESTGTVLKRSSWLIVLLVLFTVSLSPVQSAPIG

SEQ ID NO: 1581 - protein, 324 aa, Artificial Sequence
  derived and/or modified protein sequence (wt) from CCHFV(UCCR4413)__KY484038.1__Gn
SESSASGCISRTQMIKSETAEIHDDIYGGPGEKLTICNGTTVVDQRLGSELGCYTINRIKTYKLCENSVKEKTCEIDSVPVKCRQGLCLKITQEGRGHVKLSRGSEIVLDICDSSCELMIPKGTGDILVDCSGGQQHFLQDNLVDLGCPNIPLLGKVAIYICRMSNHPKTTMAFLFWFSFGYVITCILCKILFYLLIITGTLGKKLKQYRELKPQTCTICESTPVNAIDAEMHDLNCSYNICPYCASRLTSDGLIRHVNLCPKRKEKVEETELYLNLERIPWFVRKLLQVSESTGVALKRSSWLLILVILLTVSMSPVQSAPIN

SEQ ID NO: 1582 - protein, 324 aa, Artificial Sequence
  derived and/or modified protein sequence (wt) from CCHFV(66019)__AB069669.1__Gn
SEESGDDCISRTQLLRTETAEVHGDNYGGPGDKITICNGSTIVDQRLGSELGCYTINRVKSFKLCENSGTGKSCKIDNTPVKCRQGFCLKITQEGRGHVKLSRGSEVVLDACDSSCEIMIPKGTGDILVDCSGGQQHFLKDNLVDLGCPNIPLLGKMAIYICRMSNHPKTTMAFLFWFSFGYVITCIFCKIIFYLLIVVGTLGKKFKQYRELKPQTCTICETTPTNAIDAEMHDLKCSYNICPYCASRLTSDGLARHVTQCPKRKEKVEETELYLNLERIPWIVRKLLQVSESTGVALKRSSWLIVLLVLLTVSLSPVQSAPIG

SEQ ID NO: 1583 - protein, 324 aa, Artificial Sequence
  derived and/or modified protein sequence (wt) from CCHFV(7001)__AB069670.1__Gn
AEGGSSDCISRTQLVKTEVAEIHEDSYGGPGEKITICNGSTIVDQRLGSELGCYTINRVRSYKLCENSASGKSCEIDSIPVKCKQGFCLKITQEGRGHVKLSRGTEIVLDVCDSSCELMIPKGTGDILVDCSGGQQHFLQNNLIDLGCPNVPLLGKMAIYVCRMSNHPKTTMAFLFWFSFGYVITCIACRVLFYLLIAIGTVGKKLKQYRELKPQTCIVCESVPVNAIDAEMHELNCSYNICPYCASRLSTDGLIRHVTQCPKRREKVEETELFLNLERIPWLVRKLLQVSESTGMALKRSCWMITLLILLLVSISPVQSAPVG

SEQ ID NO: 1584 - protein, 324 aa, Artificial Sequence
  derived and/or modified protein sequence (wt) from CCHFV(75024)__AB069671.1__Gn
SEESGDDCISRTQLLRTETAEIHGDNYGGPGDKITICNGSTIVDQRLGSEMGCYTINRVKSFKLCENSATGKSCEIDSIPVKCRQGYCLKITQEGRGHVKLSRGSEVVLDACDSSCEVMIPKGTGDILVDCSGGQQHFLKDNLIDLGCPSIPLLGKMAIYICRMSNHPKTTMAFLFWFSFGYVITCILCKAIFYLLIIVGTLGKRFKQYRELKPQTCTICETTPANAIDAEMHDLNCSYNICPYCASRLTSDGLARHVTQCPKRKEKVEETELYLNLERIPWVVRKLLQVSESTGVALKRSSWLIVLLVLFAISLSPVQSAPIG

SEQ ID NO: 1585 - protein, 324 aa, Artificial Sequence
  derived and/or modified protein sequence (wt) from CCHFV(7803)__AB069672.1__Gn
SEESGDDCISRTQLLRTETAEIHGDNYGGPGDKITICNGSTIVDQRLGSEMGCYTINRVKSFKLCENSATGKSCEIDSIPVKCRQGYCLKITQEGRGHVKLSRGSEVILDACDSSCEVMIPKGTGDILVDCSGGQQHFLKDNLIDLGCPSIPLLGKMAIYICRMSNHPKTTMAFLFWFSFGYVITCILCKAIFYLLIIVGTLGKRFKQYRELKPQTCTICETTPANAIDAEMHDLNCSYNICPYCASRLTSDGLARHVTQCPKRKEKVEETELYLNLERIPWVVRKLLQVSESTGVALKRSSWLIVLLVLFAISLSPVQSAPIS

SEQ ID NO: 1586 - protein, 324 aa, Artificial Sequence
  derived and/or modified protein sequence (wt) from CCHFV(79121)__AB069673.1__Gn
AEGGSSDCISRTQLVKTEVAEIHEDSYGGPGEKITICNGSTIVDQGLGSELGCYTINRVRSYKLCENSASGKSCEIDSIPVKCKQGFCLKITQEGRGHVKLSRGTEIVLDVCDSSCELMIPKGTGDILVDCSGGQQHFLQNNLIDLGCPNVPLLGKMAIYVCRMSNHPKTTMAFLFWFSFGYVITCIACRVLFYLLIAIGTVGKKLKQYRELKPQTCIVCESVPVNAIDAEMHELNCSYNICPYCASRLSTDGLIRHVTQCPKRREKVEETELFLNLERIPWLVRKLLQVSESTGMALKRSCWMITLLILLLVSISPVQSAPVG

SEQ ID NO: 1587 - protein, 324 aa, Artificial Sequence
  derived and/or modified protein sequence (wt) from CCHFV(8402)__AB069674.1__Gn
SEESGDDCISRTQLLRTETAEIHNDNYGGPGDKITICNGSTVVDQRLGSELGCYTINRVKSFKLCENSATGKSCEIDSTPVKCRQGFCLKITQEGRGHVKLSRGSEVVLDACDSSCEIMIPKGTGDILVDCSGGQQHFLKDNLIDLGCPNIPLLGKMAIYICRMSNHPKTTMAFLFWFSFGYVVTCILCKVIFYLLIVVGTLGKKFKQYRELKPQTCTICETTPVNAIDAEMHDLNCSYNICPYCASRLTSDGLARHVMQCPKRKEKIEETELYLNLERIPWVVRKLLQVSESTGVALKRSSWLVVLLVLLTVSLSPVQSAPIG

SEQ ID NO: 1588 - protein, 324 aa, Artificial Sequence
  derived and/or modified protein sequence (wt) from CCHFV(88166)__AB069675.1__Gn
SEESGDDCISRTQLLRTETAEIHSDNYGGPGDKITICNGSTVVDQRLGSELGCYTINRVKSFKLCENSATGKSCEIDSTPVKCRQGFCLKITQEGRGHVKLSRGSEVVLDACDSSCEIMIPKGTGDILVDCSGGQQHFLKDNLIDLGCPNIPLLGKMAIYICRMSNHPKTTMGFLFWFSFGYVVTCILCKVIFYLLIVVGTLGKKFKQYRELKPQTCTICETTPVNAIDAEMHDLNCSYNICPYCASRLTSDGLARHVMQCPKRKEKIEETELYLNLERIPWVVRKLLQVSESTGVALKRSSWLVVLLVLLTVSLSPVQSAPIG

SEQ ID NO: 1589 - protein, 324 aa, Artificial Sequence
  derived and/or modified protein sequence (wt) from CCHFV(BA88166)__AF338470.1__Gn
SEESGDDCISRTQLLRTETAEIHSDNYGGPGDKITICNGSTVVDQRLGSELGCYTINRVKSFKLCENSATGKSCEIDSTPVKCRQGFCLKITQEGRGHVKLSRGSEVVLDACDSSCEIMIPKGTGDILVDCSGGQQHFLKDNLIDLGCPNIPLLGKMAIYICRMSNHPKTTMGFLFWFSFGYVVTCILCKGIFYLLIVVGTLGKKFKQYRELKPQTCTICETTPVNAIDAEMHDLNCSYNICPYCASRLTSDGLARHVMQCPKRKEKIEETELYLNLERIPWVVRKLLQVSESTGVALKRSSWLVVLLVLLTVSLSPVQSAPIG

SEQ ID NO: 1590 - protein, 324 aa, Artificial Sequence
  derived and/or modified protein sequence (wt) from CCHFV(BA66019)__AF350448.1__Gn
SEESGDDCISRTQLLRTETAEVHGDNYGGPGDKITICNGSTIVDQRLGSELGCYTINRVKSFKLCENSGTGKSCKIDKHPVKCRQGFCLKITQEGRGHVKLSRGSEVVLDACDSSCEIMIPKGTGDILVDCSGGQQHFLKDNLVDLGCPNIPLLGKMAIYICRMSNHPKTTMAFLFWFSFGYVITCIFCKIIFYLLIVVGTLGKKFKQYRELKPQTCTICETTPTNAIDAEMHDLKCSYNICPYCASRLTSDGLARHVTQCPKRKEKVEETELYLNLERIPWIVRKLLQVSESTGVALKRSSWLIVLLVLLTVSLSPVQSAPIG

SEQ ID NO: 1591 - protein, 324 aa, Artificial Sequence
  derived and/or modified protein sequence (wt) from CCHFV(BA8402)__AF350449.1__Gn
SEESGDDCISRTQLLRTETAEIHNDNYGGPGDKITICNGSTVVDQRLGSELGCYTINRVNSFNLCENTATGKSCEIDSTPVKCRQGFCLKITQEGRGHVKLSRGSEVVLDACESSCEIMIPKGTGDILVDCSGGQQHFLKDNLIDLGCPNIPLLGKMAIYICRMSNHPKTTMAFLFWFSFGYVVTCILCKVIFYLLIVVGTLGKKFKQYRELKPQTCTICETTPVNAIDAEMHDLNCSYNICPYCASRPTSDGLARHVMQCPKRKEKIEETALYLNLERIPWVVRKLLQVSESTGVALKRSSWLVVLLVLLTVSLSPVQSAPIG

SEQ ID NO: 1592 - protein, 324 aa, Artificial Sequence
  derived and/or modified protein sequence (wt) from CCHFV(Matin)__AF467769.2__Gn
SEESGDDCISRTQLLRTETAEIHSDSYGGPGDKITICNGSTVVDQRLGSELGCYTINRVKSFKLCENSATGKSCEIDSTPVKCRQGFCLKITQEGRGHVKLSRGSEVVLDACDSSCEIMIPKGTGDILVDCSGGQQHFLKDNLIDLGCPNIPLLGKMAIYICRMSNHPKTTMVFLFWFSFGYVITCILCKVIFYLLIVVGTLGKKFKQYRELKPQTCTICETTPVNAIDAEMHDLNCSYNICPYCASRLTSDGLARHVMQCPKRKEKIEETELYLNLERIPWVVRKLLQVSESTGVALKRSSWLVVLLVLLTVSLSPVQSAPIG

SEQ ID NO: 1593 - protein, 324 aa, Artificial Sequence
  derived and/or modified protein sequence (wt) from CCHFV(Baghdad 12)__AJ538197.2__Gn
SEESGDDCISRTRLLRTETAEIHGDSYGGPGDKITICNGSTIVDQRLGSEMGCYTINRVKSFKLCENSATGKSCKIDSIPVKCRQGYCLKITQEGRGHVKLSRGSEVVLDACDSSCEVMIPKGTGDILVDCSGGQQHFLKDNLIDLGCPNIPLLGKMAIYICRMSNHPKTTMAFLFWFSFGYVITCILCKAIFYLLIIVGTLGKRFKQYRELKPQTCTICETTPVNAIDAEMHDLNCSYNICPYCASRLTSDGLARHVTQCPKRKEKVEETELYLNLERIPWVVRKLLQVSESTGVALKRSSWLIVLLVLLAVSSSPVQSAPIG

SEQ ID NO: 1594 - protein, 324 aa, Artificial Sequence
  derived and/or modified protein sequence (wt) from CCHFV(VLG/TI29414)__AY179961.1__Gn
SEEPGDDCISRTQLLRAEPAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVPQCPKRKEKVEETELYLNLERIPWNVRKLLQVSESTGVALKRSSWLIVLLVLLTVSLSPVQSAPVG

SEQ ID NO: 1595 - protein, 324 aa, Artificial Sequence
  derived and/or modified protein sequence (wt) from CCHFV(TADJ/HU8966)__AY179962.1__Gn
SEESGDDCISRTQLLRTETAEIHGDDYGGPGDKITICNGSTIVDQRLGSELGCYTINRVKSFKLCENSATGKNCEIDSVPVKCRQGYCLKITQEGRGHVKLSRGSEVVLDACDSSCEVMIPKGTGDISVDCSGGQQHFLKDNLIDLGCPKIPLLGKMAIYICRMSNHPKTTMAFLFWFSFGYVITRILCKAIFYLLIIVGTLGKRFKQYRELKPQTCTICETTPANAIDAEMHDLNCSYNICPYCASRLTSDGLARHVTQCPKRKERVEETELYLNLERIPWIVRKLLQVSESTGVALKRSSWLIVLLVLFTVSLSPVQSAPIG

SEQ ID NO: 1596 - protein, 324 aa, Artificial Sequence
  derived and/or modified protein sequence (wt) from CCHFV(Hodzha)__AY223476.1__Gn
SEESGDDCISRTQLLRTETAEIHGDDYGGPGDKITICNGSTIVDQRLGSELGCYTINRVKSFKLCKNSATGKSCEIDSTPVKCRQGYCLKITQEGRGHVKLSRGSEVVLDACDSSCEVMIPKGTGDILVDCSGGQQHFLKDNLIDLGCPRIPLLGKMAIYICRMSNHPKTTMAFLFWFSFGYVITCILCKAIFYLLIIVGTLGKRFKQYRELKPQTCTICETTPANAIDAEMHDLNCSYNICPYCASRLTSDGLARHVTQCPKRKEKVEETELYLNLERIPWIVRKLLQVSESTGVALKRSSWLIVLLVLFAVSLSPVQSAPIG

SEQ ID NO: 1597 - protein, 324 aa, Artificial Sequence
  derived and/or modified protein sequence (wt) from CCHFV(Kosovo/9553/2001)__AY675511.1__Gn
SEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYIARMSNHPKTTMAFLFWFSLGYVITCILCKALFYSLIIIGTLGKKIKQYRELKPQTCTICETAPVNAIDAEMHDLNCSYNICPYCASRLTSDGLARHVKQCPKRKEKVEETELYLNLERIPWVVRKLLQVSESTGVALKRSSWLIVLLVLLTVSLSPVQSAPVG

SEQ ID NO: 1598 - protein, 324 aa, Artificial Sequence
  derived and/or modified protein sequence (wt) from CCHFV(SPU41/84)__AY900142.1__Gn
SEESSDDCISRTQLLRTETAEIHGDNYGGPGDKITICNGSTVVDQRLGSELGCYTINRVKTFKLCENSATGKSCEIDSVPVKCRQGYCLKITQEGRGHVKLSRGSEVVLDACDTSCEVMIPKGTGDILVDCSGGQQHFLKDNLIDLGCPKIPLLGKMAIYICRMSNHPKTTMAFLFWFSFGYVITCIICKVIFYLLIIVGTLGKRFKQYRELKPQTCTICETTPVNAIDAEMHDLNCSYNICPYCASRLTSDGLARHVTQCPKRKEKVEETELYLNLERIPWVVRKLLQVSESTGVALKRSSWLVVLLVLLTVSLSPVQSAPIS

SEQ ID NO: 1599 - protein, 324 aa, Artificial Sequence
  derived and/or modified protein sequence (wt) from CCHFV(UG3010)__AY900143.1__Gn
AEGVSNDCVSRTQLIKTEVAEIHEDSYGGPGEKITICNGSTIVDQRLGSELGCYTINRVKTYKLCENSATEKGCEIDSVPVKCKQGFCLKVTQEGRGHVKLSRGTEIVLDVCDTSCELMIPKGTGDILVDCSGGQQHFLQDNLIDLGCPNVPLLGKMAIYICRMSNHPKTTMAFLFWFSFGYVITCIVCKVLFYLLIVIGTLSKKLKQYRELKPQTCIVCESTPVNAIDAEMHELNCNYNICPYCASRLTSDGLVRHVNQCPKRKEKVEETELYLNLERIPWLVRRLLQVSESTGMALKRSCWMTTLLILLVVSLSPVQSAPVG

SEQ ID NO: 1600 - protein, 324 aa, Artificial Sequence
  derived and/or modified protein sequence (wt) from CCHFV(Hy13)__AY900145.1__Gn
SEESGDDCISRTQLSRTETAEIHSDNYGGPGDKITICNGSTIVDQRLGSELGCYTINRVKSFKLCENSATGKSCEIDSTPIKCRQGFCLKITQEGRGHVKLSRGSEVVLDACDSSCEIMIPKGTGDILVDCSGGQQHFLKDNLIDLGCPNIPLLGKMAIYICRMSNHPKTTMAFLFWFSFGYVITCILCKVIFYLLIVVGTLGKKFKQYRELKPQTCTICETTPVNAIDAEMHDLNCSYNICPYCASRLTSDGLARHVMQCPKRKEKVEETELYLNLERIPWVVRKLLQVSESTGVALKRSSWLVVLLVLLTVSLSPVQSAPIG

SEQ ID NO: 1601 - protein, 324 aa, Artificial Sequence
  derived and/or modified protein sequence (wt) from CCHFV(Semunya)__DQ094832.1__Gn
AEGVSNDCVSRTQLIKTEVAEIHEDSYGGPGEKITICNGSTIVDQRLGSELGCYTINRVKTYKLCENSATEKGCEIDSVPVKCKQGFCLKVTQEGRGHVKLSRGTEIVLDVCDTSCELMIPKGTGDILVDCSGGQQHFLQDNLIDLGCPNVPLLGKMAIYICRMSNHPKTTMAFLFWFSFGYVITCVVCKVLFYLLIVIGTLGKKLKQYRELKPQTCIVCESIPVNAIDAEMHELNCNYNICPYCASRLTSDGLVRHVTQCPKRKEKVEETELYLNLERIPWLVRRLLQVSESTGMALKRSCWMTTLLILLVVSLSPVQSAPVG

SEQ ID NO: 1602 - protein, 324 aa, Artificial Sequence
  derived and/or modified protein sequence (wt) from CCHFV(SPU128/81/7)__DQ157174.1__Gn
SEEPSDDCISRTQLLRTETAEIHGDNYGGPGDKITICNGSTIVDQRLGSELGCYTINRVKSFKLCENSATGKSCEIESVPVKCRQGYCLRITQEGRGHVKLSRGSEVVLDACDTSCEIMIPKGTGDILVDCSGGQQHFLKDNLIDLGCPKIPLLGKMAIYICRMSNHPKTTMAFLFWFSFGYVITCILCKAIFYLLIIIGTLGKRFKQYRELKPQTCTICETTPVNAIDAEMHDLNCSYNICPYCASRLTSDGLARHVTQCPKRKEKVEETELYLNLERIPWVVRKLLQVSESTGVALKRSSWLIVLLVLFTVSLSPVQSAPIG

SEQ ID NO: 1603 - protein, 324 aa, Artificial Sequence
  derived and/or modified protein sequence (wt) from CCHFV(ROS/HUVLV-100)__DQ206448.1__Gn
SEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVG

SEQ ID NO: 1604 - protein, 324 aa, Artificial Sequence
  derived and/or modified protein sequence (wt) from CCHFV(AP92)__DQ211625.1__Gn
SEGGDGGCISRTQLIKTETAEVHGDDYGGPGEKITICNGSTIVDQRLGSELGCYTINRIKSFKLCENSAQGKNCEIDSAPVQCRQGYCLKISQEGRGHVKLSRGSEIVLDVCDTSCEIMIPKGTGDILVDCSGGQQHFLQSNLVDLGCPNIPLLGKMAIYICRMSNHPKTTMAFLFWFSFGYVITCILCKTLFYILIIIGTLGKKLKQYRELKPQTCTICESVPVNAIDAEMHDLNCSYNICPYCASRLTSEGLTRHVNQCPKRKEKVEETELYLNLERIPWIVRKLLQVSESTGVALKRSSWMIVLLILLIVSMSPVQSAPIS

SEQ ID NO: 1605 - protein, 324 aa, Artificial Sequence
  derived and/or modified protein sequence (wt) from CCHFV(ArD8194)__DQ211626.1__Gn
AEGGSNDCVSRTQLVKTEVAEIHEDSYGGPGEKITICNGSTIVDQRLGSELGCYTINRVRTYKLCENSATEKSCEIDSVPVKCKQGFCLKITQEGRGHVKLSRGTEIVLDVCDTSCELMIPKGTGDILVDCSGGQQHFLQDNLIDLGCPNIPLLGRTAIYVCRMSNHPKTTMAFLFWFSFGYVITCVVCKVLFYLLIVIGTLGKRLKQYRELKPQTCIVCESIPVNAIDAEMHDLNCNYNICPYCASRLTSDGLVRHVTQCPKRKEKVEETELYLNLERIPWLVRKLLQVSESTGVALKRSCWMITLLILLTVSMSPVQSAPVG

SEQ ID NO: 1606 - protein, 324 aa, Artificial Sequence
  derived and/or modified protein sequence (wt) from CCHFV(ArD15786)__DQ211627.1__Gn
AEGGSNDCVSRTQLVKTEVTEIHEDSYGGPGEKITICNGSTIVDQRLGSELGCYTINRVRTYKLCENSATEKSCEIDSVPVKCKQGFCLKITQEGRGHVKLSRGTEIVLDVCDTSCELMIPKGTGDILVDCSGGQQHFLQDNLIDLGCPNIPLLGQTAIYVCRMSNHPKTTMAFLFWFSFGYVITCVVCKVLFYLLIVIGTLGKRLKQYRELKPQTCIVCESIPVNAIDAEMHDLNCNYNICPYCASRLTSDGLVRHVTQCPKRKEKVEETELYLNLERIPWLVRKLLQVSESTGVALKRSCWIITLLILLTVSMSPVQSAPVG

SEQ ID NO: 1607 - protein, 324 aa, Artificial Sequence
  derived and/or modified protein sequence (wt) from CCHFV(ArD39554)__DQ211628.1__Gn
SESNNNDCVSRTQLIKTENAEIHGDDYGGPGEKITICNGSTIVEQRLGSELGCYTINRIKSFKLCENSASGKGCEIDSTPVKCKQGFCLKITQEGRGHVKLSRGSEIILDVCDSSCEMMIPKGSGDILVDCSGGQQHFLQDNLVDLGCPNVPLLGKMAIYICRMSNHPKTTMAFLFWFSFGYVITCIFCKVIFYVLIIIGTLGKRIKQYRELKPQTCTICEATPVNAIDAEMHDLNCSYNICPYCASRLTSEGLVRHVTQCPKRKEKIEETELYLNLERIPWFVRKLLQVSESTGVALKRSSWLVTLLVLLTVSLSPVQSAPIG

SEQ ID NO: 1608 - protein, 324 aa, Artificial Sequence
  derived and/or modified protein sequence (wt) from CCHFV(Drosdov)__DQ211630.1__Gn
SEEPGDDCISRTQLLKTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLKCSYNICPYCASRLTSDGLARHVTQCPKRKEKVEETELYLNLERIPWIVRKLLQVSESTGVALKRSSWLIVLLVLLTVSLSPVQSAPVG

SEQ ID NO: 1609 - protein, 324 aa, Artificial Sequence
  derived and/or modified protein sequence (wt) from CCHFV(Oman)__DQ211632.1__Gn
SEESGEDCISRTQLLRTETAEIHGDNYGGPGDKITICNGSTIVDQRLGSELGCYTINRVKSFKLCENSATGKSCEIDNTPVKCKQGFCLKITQEGRGHVKLSRDSEVVLDACDSSCEIMIPKGTGDILVDCSGGQQHFLKDNLIDLGCPNIPLLGKMAIYICRMSNHPKTTMAFLFWFSFGYVITCILCKVIFYLLIVVGTLGKKFKQYRELKPQTCTICETTPVNAIDAEMHDLNCSYNICPYCASRLTSDGLARHVMQCPKRKEKIEETELYLNLERIPWVVRKLLQVSESTGVALKRSSWLIVLLVLLTVSLSPVQSAPIG

SEQ ID NO: 1610 - protein, 324 aa, Artificial Sequence
  derived and/or modified protein sequence (wt) from CCHFV(SPU97/85)__DQ211633.1__Gn
SEESDGDCISRTQLLRTETAEIHSDNYGGPGDKITICNGSTIVDQRLGSELGCYTINRVKSFKLCENSATGKSCEIDSTPVKCRQGFCLKITQEGRGHVKLSRGSEIVLDACDSSCEIMIPKGTGDILVDCSGGQQHFLKDNLIDLGCPNIPLLGRMAIYICRMSNHPKTTMAFLFWFSFGYVITCILCKVIFYLLIVAGTVGKKFKQYRELRPQTCTICETTPVNAIDAEMHDLNCSYNICPYCASRLTSDGLARHVMQCPKRKEKIEETELYLNLERIPWVVRKLLQVSESTGVALKRSSWLTVLLVLLIVSLSPVQSAPIG

SEQ ID NO: 1611 - protein, 324 aa, Artificial Sequence
  derived and/or modified protein sequence (wt) from CCHFV(SPU103/87)__DQ211634.1__Gn
SEESSDDCISRTQLLRTETAEIHGDNYGGPGDKITICNGSTIVDQRLGSELGCYTINRVKTFKLCENSATGKSCEIDSVPVKCRQGYCLKITQEGRGHVKLSRGSEVVLDACDTSCEVMIPKGTGDILVDCSGGQQHFLKDNLIDLGCPKIPLLGKMAIYICRMSNHPKTTMAFLFWFSFGYVITCVLCKAIFYLLIIVGTLGKRLKQYRELKPQTCTICETTPVNAIDAEMHDLNCSYNICPYCASRLTSDGLARHVTQCPKRKEKVEETELYLNLERIPWVVRRLLQVSESTGVALKRSSWLIVLLVLFTVSLSPVQSAPIS

SEQ ID NO: 1612 - protein, 324 aa, Artificial Sequence
  derived and/or modified protein sequence (wt) from CCHFV(SPU415/85)__DQ211635.1__Gn
SEESDGDCISRTQLLRTETTEIHSDNYGGPGDKITICNGSTIVDQRLGSELGCYTINRVKSFKLCENSATGKSCEIDSTPVKCRQGFCLKITQEGRGHVKLSRGSEIVLDACDSNCEIMIPKGTGDILVDCSGGQQHFLKDNLIDLGCPNIPLLGKMAIYICRMSNHPKTTMAFLFWFSFGYVITCILCKVIFYLLIVAGTVGKKFKQYRELRPQTCTICETIPVNAIDAEMHDLNCSYNICPYCASRLTSDGLARHVMQCPKRKEKVEETELYLNLERIPWVVRKLLQVSESTGVALKRSSWLTVLLVLLIVSLSPVQSAPIG

SEQ ID NO: 1613 - protein, 324 aa, Artificial Sequence
  derived and/or modified protein sequence (wt) from CCHFV(Turkey200310849)__DQ211636.1__Gn
SEEPGDDCISRTQLLRTETAEIHDDNYGGPGDKITICNGSTIVDQRLGSELGCYTINRVKSFKLCENSATGKTCEVDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCISCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLTVSLSPVQSAPVG

SEQ ID NO: 1614 - protein, 324 aa, Artificial Sequence
  derived and/or modified protein sequence (wt) from CCHFV(Kosova Hoti)__EU037902.1__Gn
SEEPGDDCISRTQLLRTETAEIHDDNYGGPGDKITICNGSTIVDQRLGSELGCYTINRVKSFKLCENSATGKTCEIDSTPVKCRQGFCLKITQKGRGHVKLSRGSEVVLDACDSNCEVMIPKGTGDILVDCSGGQQHFLKDNLIDLGCPHIPLLGKMAIYICRMSNHPKTTMAFLFWFSFGYVITCIFCKALFYSLIIIGTLGKKIKQYRELKPQTCTICETAPVNAIDAEMHDLNCSYNICPYCASRLTSDGLARHVKQCPKRKEKVEETELYLNLERIPWVVRKLLQVSESTGVALKRSSWLIVLLVLLTVSLSPVQSAPVG

SEQ ID NO: 1615 - protein, 324 aa, Artificial Sequence
  derived and/or modified protein sequence (wt) from CCHFV(YL04057)__FJ562094.1__Gn
AEGGSSDCISRTQLVKTEVAEIHEDSYGGPGEKITICNGSTIVDQRLGRELGCYTINRVRSYKLCENSASGKSCEIDSIPVKCKQGFCLKITQEGRGHVKLSRGTEIVLDVCDSSCELMIPKGTGDILVDCSGGQQHFLQNNLIDLGCPNVPLLGKMAIYVCRMSNHPKTTMAFLFWFSFGYVITCIACRVLFYLLIAIGTVGKKLKQYRELKPQTCIVCESVPVNAIDAEMHELNCSYNICPYCASRLSTDGLIRHVTQCPKRREKVEETELFLNLERIPWLVRKLLQVSESTGMALKRSCWMITLLILLLVSISPVQSAPVG

SEQ ID NO: 1616 - protein, 324 aa, Artificial Sequence
  derived and/or modified protein sequence (wt) from CCHFV(V42/81)__GU477490.1__Gn
SKEPGDDCISRTQLMRTETAEIHDDNYGGPGDKITICNGSTIVDQRLGSELGCYTINRVKSFKLCENSATGKACEVDSTPVKCRQGFCLKITQEGRGHVKLSRGSEVVLDACDSSCEVMIPKGTGDILVDCSGGQQHFLKDNLIDLECPHIPLLGKLAIYICRMSNHPRTTMAFLFWFGFGYVITCILCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVVLKRSSWLIVLLVLLTVSLSPVQSAPVG

SEQ ID NO: 1617 - protein, 324 aa, Artificial Sequence
  derived and/or modified protein sequence (wt) from CCHFV(Afg09-2990)__HM452306.1__Gn
SEESGDDCISRTQLLRTETAEVHGDNYGGPGDKITICNGSTVVDQRLGSELGCYTINRVRSFKLCENSATGKSCEIDSIPVKCKQGYCLKITQEGRGHVKLSRGSEVVLDVCDSSCEVMIPKGTGDILVDCSGGQQHYLKDNLVDLGCPKIPLLGKMAIYICRMSNHPKTTMAFLFWFSFGYVITCILCKAIFFLLIIFGTLGKRFKQYRELKPQTCTICETTPVNAIDAEMHDLNCSYNICPYCASRLTSDGLARHVTQCPRRKEKVEETELYLNLERIPWVVRKLLQVSESTGTVLKRSSWLIVLLVLFTVSLSPVQSAPIG

SEQ ID NO: 1618 - protein, 324 aa, Artificial Sequence
  derived and/or modified protein sequence (wt) from CCHFV(Sudan Al-Fulah 3-2008)__HQ378184.1__Gn
SEEPSDDCISRTQLLRTETAEIHGDNYGGPGDKITICNGSTIVDQRLGSELGCYTINRVKSFKLCENSATGKSCVIDSVPVKCRQGYCLRITQEGRGHVKLSRGSEVVLDACDTSCEIMIPKGTGDILVDCSGGQQHFLKDNLVDLGCPKIPLLGKMAIYICRMSNHPKTTMAFLFWFSFGYVITCILCKAIFYLLIIIGTLGKRFRQYRELKPQTCTICETTPVNAIDAEMHDLNCSYNICPYCASRLTSDGLARHVTQCPKRKEKVEETELYLNLERIPWVVRKLLQVSESTGVALKRSSWLIVLLVLFTVSLSPVQSAPIG

SEQ ID NO: 1619 - protein, 324 aa, Artificial Sequence
  derived and/or modified protein sequence (wt) from CCHFV(Sudan AB1-2009)__HQ378187.1__Gn
SEEPSDDCISRTQLLRTETAEIHGDNYGGPGDKITICNGSTIVDQRLGSELGCYTINRVKSFKLCENSATGKNCEIDSVPVKCRQGYCLRITQEGRGHVKLSRGSEVVLDACDTSCEIMIPKGTGDILVDCSGGQQHFLKDNLIDLGCPKIPLLGKMAIYICRMSNHPKTTMAFLFWFSFGYLITCILCKAIFYLLIIIGTLGKRLKQYRELKPQTCTICETTPVNAIDAEMHDLNCSYNICPYCASRLTSDGLARHVIQCPKRKEKVEETELYLNLERIPWVVRKLLQVSESTGVALKRSSWLIVLLVLFTVSLSPVQSAPIG

SEQ ID NO: 1620 - protein, 324 aa, Artificial Sequence
  derived and/or modified protein sequence (wt) from CCHFV(NIVA 118595)__JN572083.1__Gn
SEESGDDCISRTQLLRTETAEVHGDNYGGPGDKITICNGSTVVDQRLGSELGCYTINRVKSFKLCENSATGKSCEIDSIPVKCRQGYCLKITQEGRGHVKLSRGSEVVLDACDSSCEVMIPKGTGDILVDCSGGQQHFLKDNLIDLGCPKIPLLGKMAIYICRMSNHPKTTMAFLFWFSFGYVITCILCKVIFYLLIIFGTLGKRFKQYRELKPQTCTICETTPVNAIDAEMHDLNCSYNICPYCASRLTSDGLARHVTQCPKRKEKVEETELYLNLERIPWVVRKLLQVSESTGIALKRSSWLIVLLVLFTVSITPVQSAPIG

SEQ ID NO: 1621 - protein, 324 aa, Artificial Sequence
  derived and/or modified protein sequence (wt) from CCHFV(SCT ex Afghanistan)__KC344856.1__Gn
SEESGDDCISRTQLLRTETAEVHNDNYGGPGDKITICNGSTIVDQRLGSELGCYTINRVKSFKLCENSATGKSCKIDSTPVKCRQGFCLKITQEGRGHVKLSRGSEVVLDACDSSCEIMIPKGTGDILVDCSGGQQHFLKDNLIDLGCPNIPLLGKMAIYICRMSNHPKTTMAFLFWFSFGYVITCIFCKVIFYLLIVVGTLGKKFKQYRELKPQTCTICETTPTNAIDAEMHDLNCSYNICPYCASRLTSDGLARHVTQCPKRKEKVEETELYLNLERIPWIVRKLLQVSESTGVALKRSSWLIVLLVLLTVSLSPVQSAPIG

SEQ ID NO: 1622 - protein, 324 aa, Artificial Sequence
  derived and/or modified protein sequence (wt) from CCHFV(Zahedan 2007)__KC867273.1__Gn
SEESGDDCISRTQLLRTETAEVHGDNYGGPGDKITICNGSTVVDQRLGSELGCYTINRVRSFKLCENSATGKSCEIDSIPVKCKQGFCLKITQEGRGHVKLSRGSEVVLDVCDSSCEVMIPKGTGDILVDCSGGQQHFLKDNLVDLGCPKIPLLGKMAIYICRMSNHPKTTMAFLFWFSFGYVITCILCKAIFFLLIIFGTLGKRFKQYRELKPQTCTICETTPVNAIDAEMHDLNCSYNICPYCASRLTSDGLARHVTQCPRRKEKVEETELYLNLERIPWVVRKLLQVSESTGTVLKRSSWLIVLLVLFTVSLSPVQSAPIG

SEQ ID NO: 1623 - protein, 324 aa, Artificial Sequence
  derived and/or modified protein sequence (wt) from CCHFV(SPU 44/08)__KJ682805.1__Gn
SEESNDDCLSRTQLLRTENAEIHSDNYGGPGDKITICNGSTIVDQRLGSELGCYTINRVKSFKLCENSATGKSCEIDSTPVRCRQGFCLKITQEGRGHVKLSRGSEVVLDACDSSCEIMIPKGTGDILVDCSGGQQHFLKDNLVDLGCPNIPLLGKMAIYICRMSNHPKTTMAFLFWFSFGYVITCILCKAIFYLLIVVGTLGKKFKQYRELKPQTCTICETNPVNAIDAEMHDLNCSYNICPYCASRLTSDGLARHVMQCPKRKEKIEETELYLNLERIPWVVRKLLQVSESTGVALKRSSWLVILLVLLTVSLSPVQSAPIS

SEQ ID NO: 1624 - protein, 324 aa, Artificial Sequence
  derived and/or modified protein sequence (wt) from CCHFV(SPU 383/87)__KJ682806.1__Gn
SEESNDDCLSRTQLLRTENAEIHSDNYGGPGDKITICNGSTIVDQRLGSELGCYTINRVKSFKLCENSATGKSCEIDSTPVRCRQGFCLKITQEGRGHVKLSRGSEVVLDACDSSCEIMIPKGTGDILVDCSGGQQHFLKDNLVDLGCPNIPLLGKMAIYICRMSNHPKTTMAFLFWFSFGYVITCILCKVIFYLLVVVGTLGKKFKQYRELKPQTCTICETNPVNAIDAEMHDLNCSYNICPYCASRLTSDGLARHVIQCPKRKEKIEETELYLNLERIPWVVRKLLQVSESTGVALKRSSWLVILLVLLTVSLSPVQSAPIS

SEQ ID NO: 1625 - protein, 324 aa, Artificial Sequence
  derived and/or modified protein sequence (wt) from CCHFV(SPU 130/89)__KJ682807.1__Gn
SEEPNYDCLSRTQLLRTENAEIHSDNYGGPGDKITICNGSTIVDQRLGSELGCYTINRVKSFKLCENSATGKSCEIDSTPVRCRQGFCLKITQEGRGHVKLSRGSEVVLDACDSSCEIMIPKGTGDILVDCSGGQQHFLKDNLVDLGCPNIPLLGKMAIYICRMSNHPKTTMAFLFWFSFGYVITCILCKVIFYLLIVVGTLGKKFKQYRELKPQTCTICETNPVNAIDAEMHDLNCSYNICPYCASRLTSDGLARHVMQCPKRKEKIEETELYLNLERIPWVVRKLLQVSESTGVALKRSSWLVVLLVLLTVSLSPVQSAPIS

SEQ ID NO: 1626 - protein, 324 aa, Artificial Sequence
  derived and/or modified protein sequence (wt) from CCHFV(SPU 497/88)__KJ682808.1__Gn
SEESNDDCLSRTQLLRTENAEIHSDNYGGPGDKITICNGSTIVDQRLGSELGCYTINRVKSFKLCENSATGKSCEIDSTPVRCRQGFCLKITQEGKGHVKLSRGSEVVLDACDSSCEIMIPKGTGDILVDCSGGQQHFLKDNLVDLGCPNIPLLGKMAIYICRMSNHPKTTMVFLFWFSFGYVITCILCKVIFYLLIVVGTLGKKFKQYRELKPQTCTICETNPVNAIDAEMHDLNCSYNICPYCASRLTSDGLARHVMQCPKRKEKIEETELYLNLERIPWVVRKLLQVSESTGVALKRSSWLVILLVLLTVSLSPVQSAPIS

SEQ ID NO: 1627 - protein, 324 aa, Artificial Sequence
  derived and/or modified protein sequence (wt) from CCHFV(SPU 18/88)__KJ682810.1__Gn
SEESNDDCLSRTQLLRTENAEIHSDNYGGPGDKITICNGSTIVDQRLGSELGCYTINRVKSFKLCENSATGKSCEIDSTPVRCRQGFCLKITQEGRGHVKLSRGSEVVLDACDSSCEIMIPKGTGDILVDCSGGQQHFLKDNLVDLGCPNIPLLGKMAIYICRMSNHPKTTMGFLFWFSFGYVITCILCKVIFYLLIVVGTLGKKFKQYRELKPQTCTICETNPVNAIDAEMHDLNCSYNICPYCASRLTSDGLARHVMQCPKRKEKIEETELYLNLERIPWVVRKLLQVSESTGVALKRSSWLVILLVLLTVSLSPVQSAPIS

SEQ ID NO: 1628 - protein, 324 aa, Artificial Sequence
  derived and/or modified protein sequence (wt) from CCHFV(SPU 48/90)__KJ682813.1__Gn
SEEPSDDCISRTQLLRTETAEIHGDNYGGPGDKITICNGSTIVDQRLGSELGCYTINRVKSFKLCENSATGKSCVIDSVPVKCRQGYCLRITQEGRGHVKLSRGSEVVLDACDTSCEIMIPKGTGDILVDCSGGQQHFLKDNLIDLGCPKIPLLGKMAIYICRMSNHPTTTMAFLFWFSFGYVITCILCKAIFYLLIIIGTLGKRFRQYRELKPQTCTICETTPVNAIDAEMHDLNCSYNICPYCASRLTSDGLARHVTQCPKRKEKVEETELYLNLERIPWVVRKLLQVSESTGVALKRSSWLIVLLVLFTVSLSPVQSAPIG

SEQ ID NO: 1629 - protein, 324 aa, Artificial Sequence
  derived and/or modified protein sequence (wt) from CCHFV(SPU 187/90)__KJ682814.1__Gn
SEEPSDDCISRTQLLRTETAEIHGDNYGGPGDKITICNGSTIVDQRLGSELGCYTINRVKSFKLCENSATGKSCEIDSVPVKCRQGYCLRITQEGRGHVKLSRGSEVVLDACDTSCEIMIPKGTGDILVDCSGGQQHFLKDNLIDLGCPKIPLLGKMAIYICRMSNHPKTTMAFLFWFSFGYVITCILCKAIFYLLIIIGTLGKRFKQYRELKPQTCTICETTPVNAIDAEMHDLNCSYNICPYCASRLTSDGLARHVTQCPKRKEKVEETELYLNLERIPWVVRKLLQVSESTGVALKRSSWLIVLLVLFTVSLSPVQSAPIG

SEQ ID NO: 1630 - protein, 324 aa, Artificial Sequence
  derived and/or modified protein sequence (wt) from CCHFV(Haskovo-V46/13)__KR092379.1__Gn
SEELGDDCISRTQLLRTETAEIHDDNYGGPGDKITICNGSTIVDQRLGSELGCYTINRGKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETTPVNAIDAEMHDLNCSYNICPYCASRLTSDGLARHVTQCPKRKEKVEETELYLNLERIPWIVRKLLQVSESTGVALKRSSWLIVLLVLLPVSLSPVQSAPVG

SEQ ID NO: 1631 - protein, 324 aa, Artificial Sequence
  derived and/or modified protein sequence (wt) from CCHFV(24-R-2012)__KR814856.1__Gn
SEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDTSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVG

SEQ ID NO: 1632 - protein, 324 aa, Artificial Sequence
  derived and/or modified protein sequence (wt) from CCHFV(36-ST-2014)__KR814857.1__Gn
SEEPGDDCISRTQLLKTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEIMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLTVSLSPVQSAPVG

SEQ ID NO: 1633 - protein, 324 aa, Artificial Sequence
  derived and/or modified protein sequence (wt) from CCHFV(44-ST-2010)__KR814859.1__Gn
SEEPGDDCISRTQLLKTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEIMIPKGTGDILVDCSGGQQHFLKDNLIDLGCPHIPLLGKMAIYICRMSNHPRTTMAFLLWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLTVSLSPVQSAPVG

SEQ ID NO: 1634 - protein, 324 aa, Artificial Sequence
  derived and/or modified protein sequence (wt) from CCHFV(47-ST-2013)__KR814861.1__Gn
SEEPGDDCISRTQLLKTETAEIHDDNYGGPGDKITICNGSTIVDQRLGSELGCYTINRVKSFKLCKNSATGKTCEIDSTPVKCRQGFCLKITQEGRGHVKLSRGSEVVLDACDSSCEIMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLTVSLSPVQSAPVG

SEQ ID NO: 1635 - protein, 324 aa, Artificial Sequence
  derived and/or modified protein sequence (wt) from CCHFV(52-R-2014)__KR814862.1__Gn
SEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDTSCEVMIPKGTGDILVDCSGGQQHFLKDNLIDLGCPHVPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVG

SEQ ID NO: 1636 - protein, 324 aa, Artificial Sequence
  derived and/or modified protein sequence (wt) from CCHFV(75-R-2012)__KR814863.1__Gn
SEEPGDDCISRTQLLRTETAEIHDDNYGGPGDKITICNGSTIVDQRLGSELGCYTINRVKSFKLCENSATGKTCEIDSAPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVG

SEQ ID NO: 1637 - protein, 324 aa, Artificial Sequence
  derived and/or modified protein sequence (wt) from CCHFV(75-ST-2010)__KR814864.1__Gn
SEESGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCLFCKALFYSLIIIGTLGKKIKQYRELRPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVG

SEQ ID NO: 1638 - protein, 324 aa, Artificial Sequence
  derived and/or modified protein sequence (wt) from CCHFV(3820-ST-2007)__KR814868.1__Gn
SEEPGDDCISRTQLLKTETAEIHDDNYGSPGDKITICNGSTIVDQRLGSELGCYTINRVKSFKLCENSATGKTCEIDSTPVKCRQGFCLKITQEGRGHVKLSRGSEVVLDACDSSCEIMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLAVSLSPVQSAPVG

SEQ ID NO: 1639 - protein, 324 aa, Artificial Sequence
  derived and/or modified protein sequence (wt) from CCHFV(4701-ST-2009)__KR814872.1__Gn
SEEPGDDCISRTQLLKTETAEIHDDNYGGPGDKITICNGSTVVDQRLGSELGCYTINRVKSFKLCENSATGKTCEIDSTPVKCRQGFCLKITQEGRGHVKLSRGSEVVLDACDSSCEIMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLTVSLSPVQSAPVG

SEQ ID NO: 1640 - protein, 324 aa, Artificial Sequence
  derived and/or modified protein sequence (wt) from CCHFV(5170-R-2011)__KR814873.1__Gn
SEEPGDDCISRTQLLKTETAEIHDDNYGGPGDKITICNGSTIVDQRLGSELGCYTINRVKSFKLCENSATGKTCEIDSTPVKCRQGFCLKITQEGRGHVKLSRGSEVVLDVCDSSCEIMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSEGLARHVTQCPKRKEKVEETELYLNLERIPWIVRKLLQVSESTGVALKRSSWLIVLLVLLTVSLSPVQSAPVG

SEQ ID NO: 1641 - protein, 324 aa, Artificial Sequence
  derived and/or modified protein sequence (wt) from CCHFV(200406546-Turkey)__KR864902.1__Gn
SEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDVCDSSCEVMIPKGTGDILVDCSGGQQHFLKDNLIDLGCPHVPLLGRMAIYICRMSNHPRTTMAFLFWFSFGYVITCIFCKALFYSLIIIGTLGKKFKQYRELKPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVG

SEQ ID NO: 1642 - protein, 324 aa, Artificial Sequence
  derived and/or modified protein sequence (wt) from CCHFV(1-CR/HU-2015)__KU161584.1__Gn
SEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLTVSLSPVQSAPVG

SEQ ID NO: 1643 - protein, 324 aa, Artificial Sequence
  derived and/or modified protein sequence (wt) from CCHFV(Gaib)__KX013445.1__Gn
SEESSDDCISRTQLLRTETAEIHNDNYGGPGDKITICNGSTIVDQRLGSELGCYTINRVKSFKLCENSATGKSCEIDSIPVKCRQGFCLKITQEGRGHVKLSRGSEVVLDACDSSCEIMIPKGTGDILVDCSGGQQHFLKDNLIDLGCPNIPLLGKMAIYICRMSNHPKTTMAFLFWFSFGYVITCIFCKAIFYLLIIVGTLGKKFKQYRELKPQTCTICETTPVNAIDAEMHDLNCSYNICPYCASRLTSDGLARHVVHCPKRKEKIEETELYLNLERVPWVVRKLLQVSESTGVALKRSSWLIVLLVLLTVSLSPVQSAPIG

SEQ ID NO: 1644 - protein, 324 aa, Artificial Sequence
  derived and/or modified protein sequence (wt) from CCHFV(Hodzha)__KX013448.1__Gn
SEESGDDCISRTQLLRTETAEIHGDDYGGPGDKITICNGSTIVDQRLGSELGCYTINRVKSFKLCENSATGKSCEIDSTPVKCRQGYCLKITQEGRGHVKLSRGSEVVLDACDSSCEVMIPKGTGDILVDCSGGQQHFLKDNLIDLGCPRIPLLGKMAIYICRMSNHPETTMAFLFWFSFGYVITCILCKAIFYLLIIVGTLGKRFKQYRELKPQTCTICETTPANAIDAEMHDLNCSYNICPYCASRLTSDGLARHVTQCPKRKEKVEETELYLNLERIPWIVRKLLQVSESTGVALKRSSWLIVLLVLFAVSLSPVQSAPIG

SEQ ID NO: 1645 - protein, 324 aa, Artificial Sequence
  derived and/or modified protein sequence (wt) from CCHFV(IbAn7620)__KX013451.1__Gn
SEEPSDDCISRTQLLRTETAEIHGDNYGGPGDKITICNGSTIVDQRLGSELGCYTINRVKSFKLCENSATGKNCEIDSVPVKCRQGYCLRITQEGRGHVKLSRGSEIVLDACDTSCEIMIPKGTGDILVDCSGGQQHFLKDNLIDLGCPKIPLLGKMAIYICRMSNHPKTTMAFLFWFSFGYVITCILCKAIFYLLIIIGTLGKRLKQYRELKPQTCTICETTPVNAIDAEMHDLNCSYNICPYCASRLTSDGLARHVIQCPKRKEKVEETELYLNLERIPWVVRKLLQVSESTGVALKRSSWLIVLLVLFTVSLSPVQSAPIG

SEQ ID NO: 1646 - protein, 324 aa, Artificial Sequence
  derived and/or modified protein sequence (wt) from CCHFV(K128_76)__KX013454.1__Gn
SDESGDDCISRTQLLRTETAEIHGDNYGGPGDKITICNGSTIVDQRLGSELGCYTINRVKSFKLCENSATGKSCEIDSIPVKCRQGYCLKITQEGRGHVKLSRGSEVVLDACDSSCEVMIPKGTGDILVDCSGGQQHFLKDNLIDLGCPKIPLLGKMAIYICRMSNHPKTTMAFLFWFSFGYVITCIVCKAIFYLLIIVGTLGKRFKQYRELKPQTCTICETTPTNAIDAEMHDLNCSYNICPYCASRLTSDGLARHVTHCPKRKEKVEETELYLNLERIPWVVRKLLQVSESTGVALKRSSWLIVLLVLFAVSLSPVQSAPIS

SEQ ID NO: 1647 - protein, 324 aa, Artificial Sequence
  derived and/or modified protein sequence (wt) from CCHFV(K168_40)__KX013457.1__Gn
SDESGDDCISRTQLLRTETAEIHGDNYGGPGDKITICNGSTIVDQRLGSELGCYTINRVKSFKLCENSATGKSCEVDSIPVKCRQGYCLKITQEGRGHVKLSRGSEVVLDACDSSCEVMIPKGTGDILVDCSGGQQHFLKDNLIDLGCPKIPLLGKMAIYICRMSNHPKTTMAFLFWFSFGYVITCIVCKAIFYLLIIVGTLGKRFKQYRELKPQTCTICETTPTNAIDAEMHDLNCSYNICPYCASRLTSDGLARHVTHCPKRKEKVEETELYLNLERIPWVVRKLLQVSESTGVALKRSSWLIVLLVLFAVSLSPVQSAPIG

SEQ ID NO: 1648 - protein, 324 aa, Artificial Sequence
  derived and/or modified protein sequence (wt) from CCHFV(K168_125)__KX013460.1__Gn
SDESGDDCISRTQLLRTETAEIHGDNYGGPGDKITICNGSTIVDQRLGSELGCYTINRVKSFKLCENSATGKSCEVDSIPVKCRQGYCLKITQEGRGHVKLSRGSEVVLDACDSSCEVMIPKGTGDILVDCSGGQQHFLKDNLIDLGCPKVPLLGKMAIYICRMSNHPKTTMAFLFWFSFGYVITCIVCKAIFYLLIIVGTLGKRFKQYRELKPQTCTICETTPTNAIDAEMHDLNCSYNICPYCASRLTSDGLARHVTHCPKRKEKVEETELYLNLERIPWVVRKLLQVSESTGVALKRSSWLIVLLVLFAVSLSPVQSAPIG

SEQ ID NO: 1649 - protein, 324 aa, Artificial Sequence
  derived and/or modified protein sequence (wt) from CCHFV(K229_194)__KX013463.1__Gn
SEEPGDDCISRTQLLKTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEIMIPKGTGDILVDCSGGQQHFLKGNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLTVSLSPVQSAPVG

SEQ ID NO: 1650 - protein, 324 aa, Artificial Sequence
  derived and/or modified protein sequence (wt) from CCHFV(K315_14)__KX013469.1__Gn
SEEPGDDCISRTQLLKTETAEIHDDNYGGPGDKITICNGSTVVDQRLGSELGCYTINRVKSFKLCKNSATGKTCEIDSTPVKCRQGFCLKITQEGRGHVKLSRGSEVVLDVCDSSCEIMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSEGLARHVTQCPKRKEKVEETELYLNLERIPWIVRKLLQVSESTGVALKRSSWLIVLLVLLTVSLSPVQSAPVG

SEQ ID NO: 1651 - protein, 324 aa, Artificial Sequence
  derived and/or modified protein sequence (wt) from CCHFV(K323_27)__KX013472.1__Gn
SEEPGDDCISRTQLLKTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEIMIPKGTGDILVDCSGGQQHFLKDNLIDLGCPHIPLLGKMAIYICRMSNHPRTTMAFLFWFSFGYVITCIFCKALFYLLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLTVLLVLLTVSLSPVQSAPVG

SEQ ID NO: 1652 - protein, 324 aa, Artificial Sequence
  derived and/or modified protein sequence (wt) from CCHFV(K340_6)__KX013475.1__Gn
SEEPGDDCISRTQLLKTETAEIHDDNYGGPGDKITICNGSTIVDQRLGSELGCYTINRVKSFKLCENSTTGKTCEIDSTPVKCRQGFCLKITQEGRGHVKLSRGSEVVLDACDSSCEIMIPKGTGDILVDCSGGQQHFLKDNLIDLGCPHIPPLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLTVSLSPVQSAPVG

SEQ ID NO: 1653 - protein, 324 aa, Artificial Sequence
  derived and/or modified protein sequence (wt) from CCHFV(Mamon)__KX013478.1__Gn
SEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVSDACDSSCEVMIPKGTGDILVDCSGGQQHFLKDNLIDLGCPHIPLLGKMAIYICRMSNHPRTTVAFLFWFSFGYVITCIFCKALFYSLIIIGTLGKKIKQYRELKPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVG

SEQ ID NO: 1654 - protein, 324 aa, Artificial Sequence
  derived and/or modified protein sequence (wt) from CCHFV(Nakiwogo)__KX013484.1__Gn
AEGVSNDCVSRTQLIKTEVAEIHEDSYGGPGEKITICNGSTIVDQRLGSELGCYTINRVKTYKLCENSATEKGCEIDSVPVKCKQGFCLKVTQEGRGHVKLSRGTEIVLDVCDTSCELMIPKGTGDILVDCSGGQQHFLQDNLIDLGCPNVPLLGKMAIYICRMSNHPKTTMAFLFWFSFGYVITCVVCKVLFYLLIVIGTLGKKLKQYRELKPQTCIVCESIPVNVIDAEMHELNCNYNICPYCASRLTSDGLVRHVTQCPKRKEKVEETELYLNLERIPWLVRRLLQVSESTGMALKRSCWMTTLLILLVVSLSPVQSAPVG

SEQ ID NO: 1655 - protein, 324 aa, Artificial Sequence
  derived and/or modified protein sequence (wt) from CCHFV(Saf)__KX013487.1__Gn
SEEPGDDCISRTQLLRTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEVMIPKGTGDILVDCSGGQQHYLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVPQCPKRKEKVEETELYLNLERIPWIVRKLLQVSESTGVALKRSSWLIVLLVLLTVSLSPVQSAPVG

SEQ ID NO: 1656 - protein, 324 aa, Artificial Sequence
  derived and/or modified protein sequence (wt) from CCHFV(Ast199)__KX056051.1__Gn
SEEPGDDCISRTQLLKTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEIMIPKGTGDILVDCSGGQQHFLKDNLIDLGCPHIPLLGKMAIYICRMSNHPRTTMAFLFWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRCSWLIVLLVLLTVSLSPVQSAPVG

SEQ ID NO: 1657 - protein, 324 aa, Artificial Sequence
  derived and/or modified protein sequence (wt) from CCHFV(Ast137)__KX056057.1__Gn
SEEPGDDCISRTQLLKTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEIMIPKGTGDILVDCSGGQQHFLKDNLIDLGCPHIPLLGKMAIHICRMSNHPRTTMAFLFWFSFGYVITCIFCKALFYSLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLTVSLSPVQSAPVG

SEQ ID NO: 1658 - protein, 324 aa, Artificial Sequence
  derived and/or modified protein sequence (wt) from CCHFV(Ast133)__KX056060.1__Gn
SEEPDDDCISRTQLLKTETAEIHDDNYGGPGDKITICNGSTIVDQRLGSELGCYTINRVKSFKLCENSATGKTCEIDSTPVKCRQGFCLKITQEGRGHVKLSRGSEVVLDACDSSCEIMIPKGTGDILVDCSGGQQHFLKDNLIDLGCPHIPLLGKMAIYICRMSNHPRTTMAFLFWFSFGYVITCIFCKALFYLLIIIGTLGKKIKQYRELKPQTCTICETAPVNAIDAEMHDLNCSYNICPYCASRLTSDGLARHVTQCPKRKEKVEETELYLNLERIPWIVRKLLQVSESTGVALKRSSWLIVLLVLLTVSLSPVQSAPVG

SEQ ID NO: 1659 - protein, 324 aa, Artificial Sequence
  derived and/or modified protein sequence (wt) from CCHFV(SK/2015/human)__KX458183.1__Gn
SEESGDDCISRTRLLRTETAEIHGDSYGGPGDKITICNGSTIVDQRLGSEMGCYTINRVKSFKLCENSATGKSCEIDSIPVRCRQGYCLKITQEGRGHVKLSRGSEVVLDACDSSCEVMIPKGTGDILVDCSGGQQHFLKDNLIDLGCPNIPLLGKMAIYICRMSNHPKTTMAFLFWFSFGYVITCILCKAIFYLLIIVGTLGKRFKQYRELKPQTCTICETTPANAIDAEMHDLNCSYTICPYCASRLTSDGLARHVTQCPKRKEKVEETELYLNLERIPWVVRKLLQVSESTGVALKRSSWLIVLLVLFTVSLSPVQSAPIG

SEQ ID NO: 1660 - protein, 324 aa, Artificial Sequence
  derived and/or modified protein sequence (wt) from CCHFV(YL16070)__KY354081.1__Gn
AEGGSSDCISRTQLVKTEVAEIHEDSYGGPGEKITICNGSTIVDQRLGSELGCYTINRVKSYKLCENSASGKSCEIDSIPVKCKQGFCLKITQEGRGHVKLSRGTEIVLDVCDSSCELMIPKGTGDILVDCSGGQQHFLQNNLIDLGCPNVPLLGKMAIYVCRMSNHPKTTMAFLFWFSFGYVITCIVCRVLFYLLIAIGTVGKKLKQYRELKPQTCIVCESVPVNAIDAEMHELNCSYNICPYCASRLSTDGLIRHVTQCPKRREKVEETELFLNLERIPWLVRKLLQVSESTGMALKRSCWMITLLILLLVSMSPVQSAPVG

SEQ ID NO: 1661 - protein, 324 aa, Artificial Sequence
  derived and/or modified protein sequence (wt) from CCHFV(UCCR4448)__KY484042.1__Gn
SEETSDDCISRTQLLRTETAEIHGDNYGGPGDKITICNGSTIVDQRLGSELGCYTINRVKSFKLCENSATGKSCEIDSVPVKCRQGYCLRITQEGRGHVKLSRGSEVVLDACDTSCEIMIPKGTGDILVDCSGGQQHFLKDNLIDLGCPKIPLLGKMAIYICRMSNHPKTTMAFLFWFSFGYVITCILCKAIFYLLIIIGTLGKRFKQYRELKPQTCTICETTPVNAIDAEMHDLNCSYNICPYCASRLTSDGLARHVTQCPKRKEKVEETELYLNLERIPWVVRKLLQVSESTGVALKRSSWLIVLLVLFTISLSPVQSAPIS

SEQ ID NO: 1662 - protein, 324 aa, Artificial Sequence
  derived and/or modified protein sequence (wt) from CCHFV(SPU 45/88)__KJ682809.1__Gn
SEESSDDCLSRTQLLRTENTEIHSDNYGGPGDKITICNGSTIVDQRLGSELGCYTINRVKSFKLCENSATGKSCEIDSTPVRCRQGFCLKITQEGRGHVKLSRGSEVVLDACDSSCEIMIPKGTGDILVDCSGGQQHFLKDNLVDLGCPNIPLLGKMAIYICRMSNHPKTTMGFLFWFSFGYVITCILCKVIFYLLIVVGTLGKKFKQYRELKPQTCTICETTPVNAIDAEMHDLNCSYNICPYCASRLTSDGLARHVMQCPKRKEKIEETELYLNLERIPWIVRKLLQVSESTGVALKRSSWLVVLLVLLTVSLSPVQSAPIG

SEQ ID NO: 1663 - protein, 644 aa, Artificial Sequence
  derived and/or modified protein sequence (wt) from CCHFV(10200)__U39455.2__Gc
FLDSTAKGMKNLLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFVNLLNIETDYTKNFHFHSKRVTAHGDTPQLDLKARPTYGAGEITVLVEVADMELHTKKIEISGLKFASLACTGCYACSSSISCKVRIHVDEPDELTVHVKSDDPDVVAASSSLMARKLEFGTDSTFKAFSAMPKTSLCFYIVEREHCKSCSEEDTKKCVNTKLEQPQSILIEHKGTIIGKQNSTCTAKASCWLESVKSFFYGLKNMLSGIFGNVFMGIFLFLAPFILLILFFMFGWRILFCFKCCRRTRGLFKYRHLKDDEETGYRRIIEKLNNKKGKNKLLDGERLADGRIAELFSTKTHIG

SEQ ID NO: 1664 - protein, 644 aa, Artificial Sequence
  derived and/or modified protein sequence (wt) from CCHFV(IbAr10200)__AF467768.2__Gc
FLDSTAKGMKNLLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVGEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFVNLLNIETDYTKNFHFHSKRVTAHGDTPQLDLKARPTYGAGEITVLVEVADMELHTKKIEISGLKFASLACTGCYACSSGISCKVRIHVDEPDELTVHVKSDDPDVVAASSSLMARKLEFGTDSTFKAFSAMPKTSLCFYIVEREHCKSCSEEDTKKCVNTKLEQPQSILIEHKGTIIGKQNSTCTAKASCWLESVKSFFYGLKNMLSGIFGNVFMGIFLFLAPFILLILFFMFGWRILFCFKCCRRTRGLFKYRHLKDDEETGYRRIIEKLNNKKGKNKLLDGERLADRRIAELFSTKTHIG

SEQ ID NO: 1665 - protein, 644 aa, Artificial Sequence
  derived and/or modified protein sequence (wt) from CCHFV(Turkey-Kelkit06)__GQ337054.1__Gc
FLDSIVKGMKNLLNSTSLETSLSIEAPWGAINVQSTFKPTVSTANIALSWSSVVHRGNKILVTGRSESIMKLEERTGVSWDLGVEDASESKLLTVSIMDLSQMYSPVFEYLSGDRQVEEWPKATCTGDCPERCGCTSSTCLHKEWSHSRNWRCNPTWCWGVGTGCTCCGVDVKDLFTDHMFVKWKVEYIKTEAIVCVALTSQERQCSLIEAGTRFNLGPVTITLSEPRNIQQKLPPEIITLHPKIEEGFFDLMHVQKVLSASTVCKLQSCTHGIPGDLQVYHIGNLLKGDRVNGHLIHKIESHFNTSWMSWDGCDLDYYCNMGDWPSCTYTGVTQHNHAAFVNLLNIETDYTKTFHFHSKRVTAHGDTPQLDLKARPTYGAGGITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEDDTQKCVDTRLEQPQSILIEHKGTIIGKQNDTCTAKASCWLESVKSFFYGLKNMLGSVFGNLFIGILLFLAPFVLLVLFFMFGWKILFCFKCCRRTRGLFKYRHLKDDEETGYRRIIERLNSKKGKNRLLDGDRLADRKIAELFSTKTHIG

SEQ ID NO: 1666 - protein, 645 aa, Artificial Sequence
  derived and/or modified protein sequence (wt) from CCHFV(SR3)__AJ538199.1__Gc
LFLDSIVKGMKNLLNSTSLETSLSIEAPWGAINVQSTYKPTVSTANIALSWSSVEHRGNKVLVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGSVTITLSEPRNIQQKLPPEIITLHPKIEEGFFDLMHVQKVLSASTVCKLQSCTHGVPGDLQVYHIGNLLKGDRVNGHLIHKIEQHFNTSWMSWDGCDLDYYCNMGDWPSCTYTGVTQHNHASFVNLLNIETDYTKTFHFHSKRVTAHGDTPQLDLKARPTYGAGEITVLVEVADMELHTKKIEISGLKFAGLTCTGCYACSSGISCKVRIHVDEPDELTVHVKSDDPDVVAASSSLMARKLEFGTDSTFKAFSAMPKTSLCFYIVEREYCKSCNKEDTQKCVNTKLEQPQSILIEHKGTIIGKQNNTCTAKASCWLESVKSFFYGLKNMLGGIFGNVFIGIFTFLTPFILLILFFMFGWRILFCFKCCRRTRGLFKYRHLKDDEETGYRKIIERLNNKKGKNRLLDGERLADRKIAELFSTKTHIG

SEQ ID NO: 1667 - protein, 645 aa, Artificial Sequence
  derived and/or modified protein sequence (wt) from CCHFV(UCCR4413)__KY484038.1__Gc
FLSSIVKGKKNLLNSASLETSLSIEAPWGAINAQSTFKPTISTANIALSWSSVEHRGNKVLVSGRSESIMKLEERTGISWNLGVEDASESRMLTVSVMDLSQMYLPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPSEIVTLHPKIEEGFFDLMHVQKVLSASTVCKLQSCTHGVAGDLQVYHVGNLLKGDKINGHSIHKIEPHLNTSWMSWDGCDLDYYCNMGDWPSCTYTGVTQHNHAAFVNLLNIETDYTKSFHFHSKRVTAHGDTPQLDLKARPMYGAGEITVLVEVADMELHSKNIEISGLKFASLTCSGCYACSSGISCKVRIHVDEPDELAVHVKSDDLDVVAASSSLMARKIEFGTDSTFKAFSSMPKESLCFYIVERDFCKSCAAEDTQKCVKAKLEQPQSILIEHKGTIIGKQNDTCSTKTSCWLESFKSFFYGLKNMLSGVFGSAIMGILLFLAPFILLILFFFFGWRILFCLRCCRRTRGLFKYKHIKDDEEAGYKKIIEKLNNKKGGTSKLLDGERLADRKIAELFSTKAHIG

SEQ ID NO: 1668 - protein, 644 aa, Artificial Sequence
  derived and/or modified protein sequence (wt) from CCHFV(66019)__AB069669.1__Gc
FSDSIVKGMKNLLNSTSLETSLSIEAPWGAINVQSTFKPTVSTANIALSWSSVEHRGNKILVSGRSESIMKLEERTGISWDLGVEDASESKLLTVSVMDLSQMYSPVFEYLSGDRQVEEWPKATCTGNCPDRCGCTSSTCLHKEWPHSRNWRCNPTWCWGVGTGCTCCGLDVKDLFTDYMFVKWKVEYIKTEAIVCVELNSQERQCSLIEAGTRFNLGPVTITLSEPRNIQQKLPSEIITLHPRIEEGFFDLMHVQKVLSASTVCKLQSCTHGVPGDLQIYHIGNLLKGDRVNGHLIHKIEPHFNTSWMSWDGCDLDYYCNMGDWPSCTYTGVTQHNHAAFVNLLNIETDYTKNFHFHSKRVTAHGDTPQLDLKARPTYGAGEITVLVEVADMELHTKKIAISGLKFASLTCTGCYACSSGISCKVRIHVDEPDELTVHVKSEDPDIVAASSSLMARKLEFGTDSTFKAFSAMPKTSLCFYIVEREYCESCSKEDTQKCVNTKLEQPQSILIEHKGTIIGKQNDTCTAKASCWLESVKSFFYGLKNMLSGIFGNVFIGIFLFLAPFILLILFFMFGWRILFCFKCCRRTRGLFKYRYLKDDEESGYRRIIERLNNKKGKNKLLDGERLADRRIAELFSTKTHIG

SEQ ID NO: 1669 - protein, 644 aa, Artificial Sequence
  derived and/or modified protein sequence (wt) from CCHFV(7001)__AB069670.1__Gc
FLDNIAKGMKSLLNSTSLETSLSIEAPWGAINVQSTFKPTVSAANIALSWSSVEHRGNKILVSGRSESIMKLEERTGVSWNLGVEDASESKTLTVSVMDLSQMYSPVFEYLSGDRQVEEWPKATCTGDCPERCGCTSSTCLHKEWPHSRNWRCNPTWCWGVGTGCTCCGLDVKDFFTDYMLVKWKVEYIKTEAIVCVELTSQERQCSLIEAGTRFNLGPVTITLSEPRNVQQRLPPEIVTLHPKIEEGFFDLMHVQKILSASTVCKLQSCTHGVPGDFQVYHVGNLLRGDKVNGHSIHKIEPHFNTSWMSWDGCDLDYFCNMGDWPSCTYTGVTQHNRAAFINMLNIETDYTKTFHFHSKRVTAHGDTPQLDLKARPAYGAGEVTVLVEVADLELHTKKLEVSGLKIASLTCSGCYACSSGISCKVRIHVNEPDEFTVHVRSSDPDVVAAGSSLMARKIEFGADSTFKAFSSMPKDSLCFYIVEKDYCSSCTDDDTQKCVNTKLDHPQSILIEHKGTIIGKQNDTCSTKTSCWLESVKGFFYGLKNMLSGIFGNVFLGIFLFLAPFVLLIFFFFFGWRLLFCLKCCRRTRGLLKYKHLKDEEEAGYKKIIERLNGKKGKSQLFDGERLADRKIAELFSTKIHIG

SEQ ID NO: 1670 - protein, 644 aa, Artificial Sequence
  derived and/or modified protein sequence (wt) from CCHFV(75024)__AB069671.1__Gc
FLDSIVRGMKNQLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTTSTCLHKEWPHSRNWRCNPTWCWGVGTGCTCCGLDVKDLFTDYMIVKWKVEYIKTEAIVCVELTSQERQCSLIEAGTRFNLGSVTITLSEPRNIQQKLPPEIITLHPRIEEGFFDLMHVQKVLSASTVCKLQSCTHGVPGDLQVYHVGNLLKGDKVNGHLIHKIEPHLNTSWMSWDGCDLDYYCNMGDWPSCTYTGVTQHNHASFVNLLNIETDYTKSFHFHSKRVTAHGDTPQLDLKARPTYGAGEITVLVEVADMEFTPKKIEISGLKFASLTCTGCYACSSGISCKVRIHVDEPDELTVHVKSDDPDVVAASSSLMARKLEFGTDSTFKAFSAMPKTSLCFYIVEREYCKSCSKEDTQKCVNTKLEQPQSILIEHKGTIIGKQNNTCTAKASCWLESVKSFFYGLKNMLSGIFGNLFMGIFLFLAPFILLILFFMFGWRILFCFKCCRRTRGLFKYRHLKDDEETGYRRIIERLNNKKGKNKLLDGERLADRRIAELFSTKTHIG

SEQ ID NO: 1671 - protein, 644 aa, Artificial Sequence
  derived and/or modified protein sequence (wt) from CCHFV(7803)__AB069672.1__Gc
FLDSIVRGMKNPLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTTSTCLHKEWPHSRNWRCNPTWCWGVGTGCTCCGLDVKDLFTDYMIVKWKVEYIKTRGIVCVELTSQERQCSLIEAGTRFNLGSVTITLSEPRNIQQKLPPEIITLHPRIEEGFFDLMHVQKVLSASTVCKLQSCTHGVPGDLQVYHVGNLLKGDKVNGHLIHKIEPHLNTSWMSWDGCDLDYYCNMGDWPSCTYTGVTQHNHASFVNLLNIETDYTKSFHFHSKRVTAHGDTPQLDLKARPTYGAGEITVLVEVADMEFTPKKIEISGLKFASLTCTGCYACSSGISCKVRIHVDEPDELTVHVKSDDPDVVAASSSLMARKLEFGTDSTFKAFSAMPKTSLCFYIVEREYCKSCSKEDTQKCVNTKLEQPQSILIEHKGTIIGKQNNTCTAKASCWLESVKSFFYGLKNMLSGIFGNFFMGIFLFLAPFILLILFFMFGWRILFCFKCCRRTRGLFKYRHLKDDEETGYRRIIERLNNKKGKNKLLDGERLADRRIAELFSTKTHIG

SEQ ID NO: 1672 - protein, 644 aa, Artificial Sequence
  derived and/or modified protein sequence (wt) from CCHFV(79121)__AB069673.1__Gc
FLDSTAKGMKSLLNSTSLETSLSIEAPWGAINVQSTFKPTVSAANIALSWSSVEHRGNKILVSGRSESIMKLEERTGVSWNLGVEDASESKTLTVSVMDLSQMYSPVFEYLSGDRQVEEWPKATCTGDCPERCGCTSSTCLHKEWPHSRNWRCNPTWCWGVGTGCTCCGLDVKDFFTDYMLVKWKVEYIKTEAIVCVELTSQERQCSLIEAGTRFNLGPVTITLSEPRNVQQRLPPEIVTLHPKIEEGFFDLMHVQKILSASTVCKLQSCTHGVPGDFQIYHVGNLLRGDKVNGHSIHKIEPHFNTSWMSWDGCDLDYFCNMGDWPSCTYTGVTQHNRAAFINMLNIETDYTKTFHFHSKRVTAHGDTPQLDLKARPAYGAGEVTVLVEVADLELHTKNLEVSGLKIASLTCSGCYACSSGISCKVRIHVNEPDEFTVHVRSSDPDVVAAGSSLMARKIEFGADSTFKAFSSMPKDSLCFYIVEKDYCSSCTDDDTQKCVNTKLDHPQSILIEHKGTIIGKQNDTCSTKTSCWLESVKGFFYGLKNMLSGIFGNVFLGIFLFLAPFVLLIFFFFFGWRLLFCLKCCRRTRGLLKYKHLKDEEEAGYKKIIERLNGKKGKSQLFDGERLADRKIAELFSTKIHIG

SEQ ID NO: 1673 - protein, 644 aa, Artificial Sequence
  derived and/or modified protein sequence (wt) from CCHFV(8402)__AB069674.1__Gc
FSDSIVKGMKNLLNSTSLETSLSIEAPWGAINVQSTFKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFIKWKVEYIKTEAIVCVELTSQERQCTLIEAGTRFNLGPVTITLSEPRNIQQKLPPEIVTLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHAAFVNMLNIETDYTKNFHFHSKRVTAHGDTPQLDLKARPTYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSKEDTQKCVNTKLEQPQSILIEHKGTIIGKQSNTCTAKASCWLESVKSFFYGLKNMLSGIFGNVFIGVFLFFAPFILLILFFMFGWRILFCFKCCRRTRGLFKYRHLKDDEETGYRKIIERLNNKKGKNKLLDGERLADRKIAELFSTKTHIG

SEQ ID NO: 1674 - protein, 644 aa, Artificial Sequence
  derived and/or modified protein sequence (wt) from CCHFV(88166)__AB069675.1__Gc
FSDSIVKGMKNLLNSTSLETSLSIEAPWGAINVQSTFKPTMSAANIALSWSSVEHRGNKILVSGRSESIMKLEERTGISWNLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFIKWKVEYIKTEAIVCVELTSQERQCTLIEAGTRFNLGPVTITLSEPRNIQQKLPPEIVTLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHAAFVNMLNIETDYTKNFHFHSKRVTAHGDTPQLDLKARPTYGAGEITVLVEVADMELHTKKIEISGLKFASLTCTGCYACSSGISCKVRIHVDEPDELTVHVKSEDPDLVAASSSLMARKLEFGTDSTFKAFSAMPKTSLCFYIVEREYCKSCSKEDTQKCVNTKLEQPQSILIEHKGTIIGKQNNTCTAKASCWLESVKSFFYGLKNMLSGIFGNVFIGVFLFFAPFILLILFFMFGWRILFCFKCCRRTRGLFKYRHLKDDEETGYRKIIERLNNKKGKNKLLDGERLADRKIAELFSTKTHIG

SEQ ID NO: 1675 - protein, 644 aa, Artificial Sequence
  derived and/or modified protein sequence (wt) from CCHFV(BA88166)__AF338470.1__Gc
YLDSIVKGMKNLLNSTSLETSLSIEAPWGAINVQSTFKPTMSAANIALSWSSVEHRGNKILVSGRSESIMKLEERTGISWNLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFIKWKVEYIKTEAIVCVELTSQERQCTLIEAGTRFNLGPVIITLSEPRNIQQKLPPEIVTLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHAAFVNMLNIETDYTKNFHFHSKRVTAHGDTPQLDLKARPTYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSKEDTQKCVNTKLEQPQSILIEHKGTIIGKQNNTCTAKASCWLESVKSFFYGLKNMLSGIFGNVFIGVFLFFAPFILLILFFMFGWRILFCFKCCRRTRGLFKYRHLKDDEETGYRKIIERLNNKKGKNKLLDGERLADRKIAELFSTKTHIG

SEQ ID NO: 1676 - protein, 644 aa, Artificial Sequence
  derived and/or modified protein sequence (wt) from CCHFV(BA66019)__AF350448.1__Gc
FSDSIVKGMKNLLNSTSLETSLSIEAPWGAINVQSTFKPTVSTANIALSWSSVEHRGNKILVSGRSESIMKLEERTGISWDLGVEDASESKLLTVSVMDLSQMYSPVFEYLSGDRQVEEWPKATCTGDCPDRCGCTSSTCLHKEWPHSRNWRCNPTWCWGVGTGCTCCGLDVKDLFTDYMFVKWKVEYIKTEAIVCVELNSQERQCSLIEAGTRFNLGPVTITLSEPRNIQQKLPPEIITLHPRIEEGFFDLMHVQKVLSASTVCKLQSCTHGVPGDLQIYHIGNLLKGDRVNGHLIHKIEPHFNTSWMSWDGCDLDYYCNMGDWPSCTYTGVTQHNHAAFVNLLNIETDYTKNFHFHSKRVTAHGDTPQLDLKARPTYGAGEITVLVEVADMELHTKKIAISGLKFASLTCTGCYACSSGISCKVRIHVDEPDELTVHVKSEDPDIVAASSSLMARKLEFGTDSTFKAFSAMPKTSLCFYIVEREYCESCSKEDTQKCVNTKLEQPQSILIEHKGTIIGKQNDTCTAKASCWLESVKSFFYGLKNMLSGIFGNVFIGIFLFLAPFILLILFFMFGWRILFCFKCCRRTRGLFKYRYLKDDEESGYRRIIERLNNKKGKNKLLDGERLADRRIAELFSTKTHIG

SEQ ID NO: 1677 - protein, 644 aa, Artificial Sequence
  derived and/or modified protein sequence (wt) from CCHFV(BA8402)__AF350449.1__Gc
FSDSIVKGMKNLLNSTSLETSLSIEAPWGAINVQSTFKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFIKWKVEYIKTEAIVCVELTSQERQCTLIEAGTRFNLGPVTITLSEPRNIQQKLPPEIVTLHPRIEEGFFDLMHVQKVLSASTVCKLQSCTHGVPGDLQVYHIGNLLKGDKVNGHLIHKIEPHFNTSWMSWDGCDLHYYCNMGDWPSCTYTGVTQHNHAAFVNMLNIETDYTKNFHFHSKRVTAHGDTPQLDLKARPTYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCESCSKEDTQKCVNTKLEQPQSILIEHKGTIIGKQSNTCTAKASCWLESVKSFFYGLKNMLSGIFGNVFIGVFLFFAPFILLILFFMFGWRILFCFKCCRRTRGLFKYRHLKDDEETGYRKIIERLNNKKGKNKLLDGERLADRKIAELFSTKTHIG

SEQ ID NO: 1678 - protein, 644 aa, Artificial Sequence
  derived and/or modified protein sequence (wt) from CCHFV(Matin)__AF467769.2__Gc
FLDSIIKGMKNLLNSTSLETSLSIEAPWGAINVQSTFKPTMSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEVIVCVELTSQERQCSLIEAGTRFNLGPVTITLSEPRNIQQKLPPEIVTLHPRIEEGFFDLMHVQKVLSASTVCKLQSCTHGVPGDLQVYHIGNLLKGDKVNGHLIHKIEPHFNTSWMSWDGCDLDYYCNMGDWPSCSYTGVTQHNHAAFVNMLSIETDYTKNFHFHSKRVTAHGDTPQLDLKARPTYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSKEDTQKCVNTKLEQPQSILIEHKGTIIGKQNDTCTAKASCWLESVKSFFYGLKNMLSGIFGNVFIGIFLFLAPFALLILFFMFGWRILFCFKCCRRTRGLFKYRHLKDDEETGYRKIIERLNNKKGKNKLLDGERLADRKIAELFSTKTHVG

SEQ ID NO: 1679 - protein, 644 aa, Artificial Sequence
  derived and/or modified protein sequence (wt) from CCHFV(Baghdad 12)__AJ538197.2__Gc
FLDSIVKGTKNLLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTTSTCLHKEWPHSRNWRCNPTWCWGVGTGCTCCGLDVKDLFTDYMFVKWKVEYIKTDAIVCVELTSQERQCSLIEAGTRFNLGSVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFVNLLNIETDYTKSFHFHSKRVTAHGDTPQLDLKVRPTYGAGEITVLVEVADMELHTKKIEISGLKFASLTCTGCYACSSGISCKVRIHVDEPDELTVHVKSDDPDVVAASSSLMARKLEFGTDSTFKAFSAMPKTSLCFYIVEREYCKSCSKEDTQKCVNTKLEQPQSILIEHKGTIIGKQNNTCTAKTSCWLESVKSFFYGLKNMLSGIFGNFFMGIFLFLAPFILLILFFMFGWRILFCFKCCRRTRGLFKYRHLKDDEETGYRRIIERLNNKKGKNKLLDGERLADRRIAELFSTKTHIG

SEQ ID NO: 1680 - protein, 644 aa, Artificial Sequence
  derived and/or modified protein sequence (wt) from CCHFV(VLG/TI29414)__AY179961.1__Gc
FLDSIVKGMKNLLNSTNLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWEVGTGCTCCGWNVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRVNGHLIHKIEPHFNTSWMSWDGCDLDYYCNMGDWPSCTYTGMTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSNDPDVIAASTSLMARKLEFGTDSTFKAFSAMPKTSLCFYIAEREYCKSCSEEDTQKCVDTKLEQPQSILIEHKGTIIGKQNDTCTAKASCWLESVKSFFYGLKNMLGSVFGNFFIGILLFLAPFVLLVLFFMFGWKILFCFKCCRRTRGLLKYRLLKDDEETGYRRIIERLNNKKGKNRLLDGERLADRKIAELFSTKTHIG

SEQ ID NO: 1681 - protein, 644 aa, Artificial Sequence
  derived and/or modified protein sequence (wt) from CCHFV(TADJ/HU8966)__AY179962.1__Gc
FLDSIVKGMKNPLNSTSLETSLSIEAPWGAINVQSTYKPTVSTANIALSWSSIEHRGNNILVSGRSESIMKLEERTGISGDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFIDYMFVKWKVDYIKTEAIVCVELTSQERQCSLVEAGTRFNLGPVTITLSEPRNIQQKLPPEIITLHPRIEEGFFDLMHVQKVLSASTVCKLQSCTHGVPGDLQVYHIGNLLKGDKENGHLIHKIEPHFNTSWMSWDGCDLDYYCNMGDWPSCTYTGVTQHNHASFVNLLNIETDYTKSFHFHSKRVTAHGDTPQLDLKARPTYGAGEITVLVEVADMELHTKKIEITGLKFASLTCTGCYACSSGISCKVRIHVDEPDELTVHVKSDDPDVVAASSSLMARKLEFGTDSTFKAFSAMPKTSLCFYIVEREYRKSCSKEDTQKCVNTKLEQPQSILIEHKGTIIGKQNNTCTAKASCWLESVKSFFYGLKNMLSGIFGNVFVGIFLFLAPFILLILFFMFGWRILSCFKCCRRTRGLLKHRHLKDDEETGYRRIIERLNNKKGKNKLLDGERLADRRIAELFSTKTHIG

SEQ ID NO: 1682 - protein, 644 aa, Artificial Sequence
  derived and/or modified protein sequence (wt) from CCHFV(Hodzha)__AY223476.1__Gc
FLDSIVKGTKNLLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVDYIKTEAIVCVELTSQERQCSLVEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFVNLLNIETDYTKSFHFHSKRVTAHGDTPQLDLKARPTYGAGEITVLVEVADMELHTKKIEITGLKFASLTCTGCYACSSGISCKVRIHVDEPDELTVHVKSDDPDVVAASSSLMARKLEFGTDSTFKAFSAMPKTSLCFYIVEREYCKSCSKEDTQKCVNTKLEQPQSILIERKGTIIGKQNNTCTAKASCWLESVKSFFYGLKNMLSGIFGNVFVGIFLFLAPFILLILFFMFGWRILFCFKCCRRTRGLFKYKHLKDDEETGYRRIIERLNNKKGKNKLLDGERLADRRIAELFSTKTHIG

SEQ ID NO: 1683 - protein, 644 aa, Artificial Sequence
  derived and/or modified protein sequence (wt) from CCHFV(Kosovo/9553/2001)__AY675511.1__Gc
FLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEKEYCKSCSEDDTKKCVDTKLEQPQSILIEHRGTIIGKPNDTCPAKTSCWLESVKSFFYGLKNMLGSVFGNFFIGILLFLAPFFLWMLSFMFGWKILFCFKCCRRTRGLFKYRHLKDDEETGYRRIIERLNNKKGKNRLLDGERLADRKIAELFSTKTHIG

SEQ ID NO: 1684 - protein, 644 aa, Artificial Sequence
  derived and/or modified protein sequence (wt) from CCHFV(SPU41/84)__AY900142.1__Gc
FLDSIVKGMKNLLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLVHKIEPHFNTSWMSWDGCDLDYYCNMGDWPSCTYTGVTQHNHASFVNMLNIETDYTKNFHFHSKRVTAHGDTPQLDLKARPTYGAGEITVLVEVADMELHTKKIEISGLKFTSLTCTGCYACSSGISCKVRIHVDEPDELTVHVKSEDPDVVAASSSLMARKLEFGTDSTFKAFSAMPKTSLCFYIVEREYCKSCSEEDTQKCVNTKLEQPQSILIERKGTIIGKQNNTCKAKAGCWLESVKSFFYGLKNMLSGIFGNVFIGIFLFLAPFILLILFFMFGWRILFCFKCCRRTRGLFKYRHLKDDEETGYRKIIERLNNKKGKNKLLDGERLADRRIAELFSTKTHIG

SEQ ID NO: 1685 - protein, 644 aa, Artificial Sequence
  derived and/or modified protein sequence (wt) from CCHFV(UG3010)__AY900143.1__Gc
YLDSIAKGMKSLLNSTNLETSLSIEAPWGAINVQSTFKPTVSAANIALSWSSVEHRGNKILVSGRSESIMKLEERTGISWSLGVEDASESKTLTVSVMDLSQMYSPVFEYLSGDRQVEEWPKATCTGDCQERCGCTSSTCLHKEWPHSRNWRCNPTWCWGVGTGCTCCGLDVRDLFTDYMMVKWKVEYVKTEAIMCVELTSQERQCSLIEAGTRFNLGPVTITLSEPRNIQQRLPSEIVTLHPKIEEGFFDLMHVQKVLSASTVCKLQSCTHGVPGDLQVYHVGNLLKGDKVNGHSIHKIESHFNTSWMSWDGCDLDYFCNMGDWPSCTYTGVTQHNRAAFINMLNIETDYTKTFHFHSKRVTAHGDTPQLDLKARPTYGAGEVTVLVEVADLELHTKKIEVSGLKFASLTCSGCYACSSGISCKVRIHVNEPDEFTVHVKSSDPDVVAAGSSLMARKIEFGADSTFKAFSSMPKNSLCFYIVERDYCSSCTNDDTQKCVDTKLEHPQSILIEHKGTIIGKQNDTCSTKTSCWLESVKSFFYGLKNMLGGIFGNVFLGIFLFLAPFALLIFFFFFGWRLLFCLKCCRRTRGLLKYKQLKDEEEAGYKKIIERLNDKKGKSRLFDGERLADRKIAELFSTKTHIG

SEQ ID NO: 1686 - protein, 644 aa, Artificial Sequence
  derived and/or modified protein sequence (wt) from CCHFV(Hy13)__AY900145.1__Gc
FSDSIVKGMKNLLNSTSLETSLSIEAPWGAINVQSTFKPTVSAANIALSWSSVEHRGNKILVSGRSESIMKLEERTGISWDLGVEDASESKLLTVSIMDLSQMYSPVFEYLSGDRQVEEWPKATCTGDCPERCGCTSSTCLHKEWPHSRNWRCNPTWCWGVGTGCTCCGLDVKDLFTDHMFVKWKVEYIKTEAIVCVELTSQERQCSLIEAGTRFNLGPVTITLSEPRNIQQKLPPEIVTLHPRIEEGFFDLMHVKKVLSASTVCKLQSCTHGVPGDLQVYHIGNLLKGDKVNGHLIHKIEPHFNTSWMSWDGCDLDYYCNMGDWPSCSYTGVTQHNHAAFVNMLNIETDYTKIFHFHSKRVTAHGDTPQLDLKARPTYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSKEDTQKCVNTKLEQPQSILIEHKGTIIGKQNDTCTSKAGCWLESVKSFFYGLKNMLSGIFGNVFIGIFLFLAPFILLILFFMFGWRILFCFKCCRRTRGLFKYRHLKDDEETGYRKIIERLNNKKGKNKLLDGERLADRKIAELFSTKTHIG

SEQ ID NO: 1687 - protein, 644 aa, Artificial Sequence
  derived and/or modified protein sequence (wt) from CCHFV(Semunya)__DQ094832.1__Gc
FLDSIAKGKKSLLNSTNLETSLSIEAPWGAINVQSTFKPTVSAANIALSWSSVEHRGNKILVSGRSESIMKLEERTGISWSLGVEDASESKTLTVSVMDLSQMYSPVFEYLSGDRQVEEWPKATCTGDCPERCGCTSSTCLHKEWPHSRNWRCNPTWCWGVGTGCTCCGLDVRDLFTDYMMVKWKVEYVKTEAIMCVELTSQERQCSLIEAGTRFNLGPVTITLSEPRNVQQRLPSEIVTLHPKIEEGFFDLMHVQKVLFCKYSLQATSCTHGVPGDLQVYHVGNLLKGDKVNGHSIHKIESHFNTSWMSWDGCDLDYFCNMGDWPSCTYTGVTQHNRAAFVNMLNIETDYTKTFHFHSKRVTAHGDTPQLDLKARPTYGAGEVTVLVEVADLELHTKKIEVSGLKFASLTCSGCYACSSGISCKVRIHVNEPDEFTVHVKSNDPDVVAAGSSLMARKIEFGADSTFKAFSSMPKNSLCFYIVERDYCSSCTDDDTQKCVNIKLEHPQSILIEHKGTIIGKQNDTCPTKTSCWLESVKSFFYGLKNMLGGIFGNVFLGIFLFLAPFALLILFFFFGWRLLFCLKCCRRTRGLLKYKQLKDEEEAGYKKIIERLNDKKGKSRLFDGERLADRKIAKLFSTKTHIG

SEQ ID NO: 1688 - protein, 644 aa, Artificial Sequence
  derived and/or modified protein sequence (wt) from CCHFV(SPU128/81/7)__DQ157174.1__Gc
FLDSIVKGMKNLLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFVNLLNIETDYTKNFHFHSKRVTAHGDTPQLDLKARPTYGAGEITVLVEVADMELHTKKIEISGLKFASLTCTGCYACSSGISCKVRIHVDEPDELTVHVKSDDPDVVAASSSLMARKLEFGTDSTFKAFSAMPKTSLCFYIVEREHCKSCSEEDTKKCVNTKLEQPQSILIEHKGTIIGKQNSTCTAKASCWLESVKSFFYGLKNMLSGIFGNVFIGIFLFLGPFILLILFFMFGWRILFCFKCCRRTRGLLKYRHLKEDEETGYRRIIERLNNKKGKNKLLDGERLADRRIAELFSTKTHIG

SEQ ID NO: 1689 - protein, 644 aa, Artificial Sequence
  derived and/or modified protein sequence (wt) from CCHFV(ROS/HUVLV-100)__DQ206448.1__Gc
FLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEEDTQKCVDTKLEQPQSILIEHKGTIIGKQNDTCTAKASCWLESVKSFFYGLKNMLGSVFGNFFIGILLFLAPFVLLVLFFMFGWKILFCFKCCRRTRGLLKYRLLKDDEETGYRRIIERLNNKKGKNRLLDGERLADRKIAELFSTKTHIG

SEQ ID NO: 1690 - protein, 644 aa, Artificial Sequence
  derived and/or modified protein sequence (wt) from CCHFV(AP92)__DQ211625.1__Gc
FLDSIAKGVKNLLNSTSLETSLSIEAPWGAINAQSTYKPTASSANIALTWSSVEHRGNKILVSGRSESIMKLEERTGISWNLGVEDASESRTLTISVMDLSQMYSPVFEYLSGDRQVEEWPKATCTGNCPERCGCTSSTCLYKEWPHSRNWRCNPTWCWGVGTGCTCCGLDVKELFTDHMLVKWKVEYIKTEAIVCVELTSQERQCSLIEAGTRFSLGPVTITLSEPRNIQQKLPPELITLHPKIEDGYFDLMHVQKVMSASTVCKLQSCTHGVPGDLQIYHVGNLLKGDRVNGHLIHKVEPHLNTSWMSWDGCDLDYFCNMGDWPSCTYTGVTQHNHAAFANLLNIETDYTKTFHFHSKRVTAHGDTPQLDLKARPRYGAGEITVLVEVADMELHTKKVEVTGLKFASLTCSGCYACSSGISCKVRIHVDEPDELTVHVKSSDPDIVAASSSLMARKIEFGVDSTFKAFSSMPKDSLCFYIVERDYCNSCKNEETQRCVNAKLEQPQSILIEHTGTIIGKQNDTCGSRTSCWLDSFKSFFYGLKSMLSGIFGNVFLGIFLFLAPFALLLFFFFFGWRILFCFKCCRRTRGLFKYRHIKDDEEVGYKKIIERLNNKKGKHRLLDGERLADRKIAELFSTKTHIG

SEQ ID NO: 1691 - protein, 644 aa, Artificial Sequence
  derived and/or modified protein sequence (wt) from CCHFV(ArD8194)__DQ211626.1__Gc
FLDRIAKGMKSLLNSTSLETSLSIEAPWGAINVQSTFKPTVSAANIALSWSSVEHKGNKILVSGRSESIMKLEERTGISWCLGVEDASESKTLTVSVMDLSQMYSPVFEYLSGDRQVEEWPKATCTGDCPERCGCTSSTCLHKEWPHSRNWRCNPTWCWGVGTGCTCCGLDVKDLFTDYMLVKWKVEYIKTEAIICVELTSQERQCSLIEAGTRFNLGPVTITLSEPRNVQQRLPPEIITLHPKIEEGFFDLMHVQKVMSASTVCKLQSCTHGVPGDLQVYHVGNLLKGDKVNGHSIHKIESHLNTSWMSWDGCDLDYFCNMGDWPSCTYTGVTQHNHAAFINMLNIETDYTKTFHFHSKRVTAHGDTPQLDLKARPAYGAGEITVLVEVADLELHTKKIEVSGLKFASLSCSGCYACSSGISCKVRIHVNEPDEFTVHVKSNDPDVVAAGSSLMARKIESGADSTFKAFSSMPKNSLCFYIVERDYCSSCTDDDTQKCVDIKLEHPQSILIEHKGTIIGKQNDTCPTKTSCWLESIKSFFYGLKNMLSGIFGNVFLGMLLFLAPFILLILFFFFGWRLLFCLKCCRRTRKLLKYKHLRDEEESGYKKIIERLNDKKGKSRLFDGERLADRKIAELFSTKTHIG

SEQ ID NO: 1692 - protein, 644 aa, Artificial Sequence
  derived and/or modified protein sequence (wt) from CCHFV(ArD15786)__DQ211627.1__Gc
SLDSIAKGMKSLLNSTSLETSLSIEAPWGAINVQSTFKPTISAANIALSWSSVEHKGNKILVSGRSESIMKLEERTGISWCLGVEDASESKTLTVSVMDLSQMYSPVFEYLSGDRQVEEWPKATCTGDCPERCGCTSSTCLHKEWPHSRNWRCNPTWCWGVGTGCTCCGLDVKDLFTDYMLVKWKVEYIKTEAIICVELTSQERQCSLIEAGTRFNLGPVTITLSEPRNVQQRLPPEIITLHPKIEEGFFDLMHVQKVMSASTVCKLQSCTHGVPGDLQVYHVGNLLKGDKVNGHSIHKIESHLNTSWMSWDGCDLDYFCNMGDWPSCTYTGVTQHNRAAFINMLNIETDYTKTFHFHSKRVTAHGDTPQLDLKARPTYGAGEITVLVEVADLELHTKKIEVSGLKFASLTCSGCYACSSGISCKVRIHVNEPDEFTVHVKSNDPDVVAAGSSLMARKIESGADSTFKAFSSMPKNSLCFYIVERDYCSSCTDDDTQKCVDIKLEHPQSILIEHKGTIIGKQNDTCPTKTSCWLESIKSFFYGLKNMLSGIFGNIFLGMLLFLAPFVLLILFFFFGWRLLFCLKCCRRTRKLLKYKHLRDEEESGYKKIIERLNDKKGKSRLFDGERLADRKIAELFSTKTHVG

SEQ ID NO: 1693 - protein, 644 aa, Artificial Sequence
  derived and/or modified protein sequence (wt) from CCHFV(ArD39554)__DQ211628.1__Gc
FLDSTAKSMKSLLNSTSLETSLSIEAPWGAINVQSTFKPTASTANIALSWSSVEHRGNKILVTGRSESIMKLEERTGISWNLGVEDASESKTLTVSVMDLSQMYSTVFEYLSGDRQVEEWPKATCTGDCPERCGCTSSTCLHKAWPHSRNWRCNPTWCWGVGTGCTCCGLDVKNLFTDYMLIKWKVEFIKTEAIVCVELTSQERQCSLIEAGTRFNLGPVTITLSEPRNIQQKLPPELVTLHPRVEEGFFDLMHVQKVLSASTVCKLQSCTHGVPGDLQVYHVGNLLKGDKINGNSFHKIEPNLNTSWMSWDGCDLDYYCNMGDWPSCTYTGVTQHNHAAFVNLLNIETDYTKNFHFHSKRVTAHGETPQLDLKARPKYGAGEVTVLVEVADMELHTKKIEISGLKFASLTCTGCYACSSGISCKVRLHVDEPDELTVHVKSDDPDVVAASSSLMARKIEFGTDSTFKAFSSMPKDKLCFYIVERDYCSSCSKEDTQKCVNAKLEQPQSILIEHKGTIIGKQNDTCTVKASCWLESVKSFFYGLKNMLGGIFGNVILGIIMFLAPFALLLLFFLFGWRILFCLRCCRRTRGLFKYKHIKDDEESGYKRIIERLNNKKGKNKLFDGERLADKKIAELFSTKTHIG

SEQ ID NO: 1694 - protein, 644 aa, Artificial Sequence
  derived and/or modified protein sequence (wt) from CCHFV(C-68031)__DQ211629.1__Gc
FSDSIVKGMKNLLNSTSLETSLSIEAPWGAINVQSTFKPTVSAANIALSWSSVEHRGNKILVSGRSESIMKLEERTGISWDLGVEDASESKLLTVSIMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIVTLHPRIEEGFFDLMHVKKVLSASTVCKLQSCTHGVPGDLQVYHIGNLLKGDKVNGHLIHKIEPHFNTSWMSWDGCDLDYYCNMGDWPSCSYTGVTQHNHAAFVNMLNIETDYTKIFHFHSKRVTAHGDTPQLDLKARPTYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSKEDTQKCVNTKLEQPQSILIEHKGTIIGKQNDTCTSKAGCWLESVKSFFYGLKNMLSGIFGNVFIGIFLFLAPFILLILFFMFGWRILFCFKCCRRTRGLFKYRHLKDDEETGYRKIIERLNNKKGKNKLLDGERLADRKIAELFSTKTHIG

SEQ ID NO: 1695 - protein, 644 aa, Artificial Sequence
  derived and/or modified protein sequence (wt) from CCHFV(Drosdov)__DQ211630.1__Gc
FLDSTVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYMKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRVNGHLIHKIEPHFNTSWMSWDGCDLDYYCNMGNWPSCTYTGVTQHNHAAFVNLLNIETDYTKTFHFHSKRVTAHGDTPQLDLKARPTYGAGEITVLVEVADMELHTKKVEISGLKFASLVCTGCYACSSGISCKVRIHVDEPDELTVHVKSSDPDVVAASTSLMARKLEFGTDSIFKAFSAMPKTSLCFYIVEREYCKSCSEDDTKKCVDTKLEQPQSILIEHKGTIIGKQNDTCTAKASCWLESVKSFFYGLKNMLGSVFGNFFVGILLFLAPFVLLVLFFMFGWKILFCFKCCRRTRGLFKYRHLKDDEETGYRRIIERLNSKKGKNRLLDGERLADRKIAELFSTKTHIG

SEQ ID NO: 1696 - protein, 644 aa, Artificial Sequence
  derived and/or modified protein sequence (wt) from CCHFV(Kashmanov)__DQ211631.1__Gc
FLDSIVKGMKNSLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRINGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEEDTQKCVDTKLEQPQSILIEHKGTIIGKQNDTCTAKASCWLESVKSFFYGLKNMLGSVFGNFFIGILLFLAPFVLLVLFFMFGWKILFCFKCCRRTRGLLKYRHLKDDEETGYRRIIERLNNKKGKNRLLDGERLADRKIAELFSTKTHIG

SEQ ID NO: 1697 - protein, 644 aa, Artificial Sequence
  derived and/or modified protein sequence (wt) from CCHFV(Oman)__DQ211632.1__Gc
FLDSIAKGMKNLLNSTSLETSLSIEAPWGAINVQSTFKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIVTLHPRIEEGFFDLMHVQKVLSASTVCKLQSCTHGVPGDLQVYHIGNLLKGDKVNGHLIHKVEPHFNTSWMSWDGCDLDYYCNMGDWPSCTYTGVTQHNHAAFVNLLNIETDYTKNFHFHSKRVTAHGDTPQLDLKARPNYGAGEVTVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSKEDTQKCVNAKLERPQSILIEHKGTIIGKQNDTCTAKASCWLESVKSFFYGLKNMLSGIFGNVFIGIFLFLAPFILLILFFMFGWRILFCFKCCRRTRGLFKYRHLKDDEETGYRKIIERLNNKKGKNKLLDGERLADRKIAELFSTKTHIG

SEQ ID NO: 1698 - protein, 644 aa, Artificial Sequence
  derived and/or modified protein sequence (wt) from CCHFV(SPU97/85)__DQ211633.1__Gc
FLDSIVKGKKNLLNSTSLETSLSIEAPWGAINVQSTFKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHAAFVNLLNIETDYTKNFHFHSKRVTAHGDTPQLDLKARPTYGAGEVTVLVEVADMELHTKKIEISGLKFASLSCTGCYACSSGISCKVRIHVDEPDELTVHVKSEDPDIVAAGSSLMARKLEFGADSTFKAFSAMPKTSLCFYIVEREYCKSCSREDTQKCVNTKLERPQSILIEHKGTIIGKQNDTCTAKASCWLESVKSFFYGLKSMLSGIFGNVFIGIFLFIAPFVLLILFFMFGWRILFCFKCCRRTRGLFKYRHLKDDEETGYRKIIERLNNKKGKNKLLDGERLADRKIAELFSTKSHIG

SEQ ID NO: 1699 - protein, 644 aa, Artificial Sequence
  derived and/or modified protein sequence (wt) from CCHFV(SPU103/87)__DQ211634.1__Gc
FLDNIVKGMKNLLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKIEYIKTEAIVCVELTSQERQCSLIEAGTRFNLGPVTITLSEPRNIQQKLPSEIITLHPRIEEGFFDLMHVQKVLSASTVCKLQSCTHGVPGDLQVYHIGNLLKGDKVNGHLVHKIEPHFNTSWMSWDGCDLDYYCNMGDWPSCTYTGVTQHNHASFVNLLNIETDYTKNFHFHSKRVTAHGDTPQLDLKARPTYGAGEITVLVEVADMELHTKKIEISGLKFTSLTCTGCYACSSGISCKVRIHVDEPDELTVHVKSDDPDVVAASSSLMARKLEFGTDSTFKAFSAMPKTSLCFYIVEREYCKSCSEEDTQKCVNTKLEQPQSILIEHKGTIIGKQNNTCKARAGCWLESVKSFFYGLKNMLSGIFGNVFIGIFLFLAPFILLILFFMFGWRILFCFKCCRRTRGLFKYRHLKDDEETGYRKIIERLNNKKGKNKLLDGERLADRRIAELFSTKTHIG

SEQ ID NO: 1700 - protein, 644 aa, Artificial Sequence
  derived and/or modified protein sequence (wt) from CCHFV(SPU415/85)__DQ211635.1__Gc
FLDSIVKGMKNLLNSTSLETSLSIEAPWGAINVQSTFKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQRVLSASTVCKLQSCTHGVPGDLQVYHIGNLLKGDKVNGHLIHKIEPHFNTSWMSWDGCDLDYYCNMGDWPSCTYTGVTQHNHAAFVNLLNIETDYTKNFHFHSKRVTAHGDTPQLDLKARPTYGAGEVTVLVEVADMELHTKKIEISGLKFASLTCTGCYACSSGISCKVKIHVDEPDELTVHVKSEDPDIVAAGSSLMARKLEFGADSTFKAFSAMPKTSLCFYIVEREYCKSCSREDTRKCVNTKLDRPQSILIEHKGTIIGKQNNTCTAKASCWLESVKSFFYGLKNMLSGIFGNVFIGIFLFIAPFVLLILFFMFGWRILFCFKCCRRTRGLFKYRHLKDDEETGYRKIIERLNNKKGKNKLLDGERLADRKIAELFSTKSHIG

SEQ ID NO: 1701 - protein, 644 aa, Artificial Sequence
  derived and/or modified protein sequence (wt) from CCHFV(Turkey200310849)__DQ211636.1__Gc
FLDSIVKGMKNLLNSTSLETSLSIEAPWGAINVQSTFKPAVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQVYHIGNLLKGDRVNGHLIHKIESHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEDDTQKCVDTRLEQPQSILIEHKGTIIGKQNDTCTAKASCWLESVKSFFYGLKNMLGSVFGNLFIGILLFLAPFVLLVLFFMFGWKILFCFKCCRRTRGLFKYRHLKDDEETGYRRIIERLNSKKGKNRLLDGDRLADRKIAELFSTKTHIG

SEQ ID NO: 1702 - protein, 644 aa, Artificial Sequence
  derived and/or modified protein sequence (wt) from CCHFV(Iran-52)__DQ446215.1__Gc
FLDSIVKGMKNLLNSTSLETSLSIEAPWGAINVQSTYKPTVSTANIALSWSSVEHRGNKVLVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGSVTITLSEPRNIQQKLPPEIITLHPKIEEGFFDLMHVQKVLSASTVCKLQSCTHGVPGDLQVYHIGNLLKGDRVNGHLIHKIEQHFNTSWMSWDGCDLDYYCNMGDWPSCTYTGVTQHNHASFVNLLNIETDYTKTFHFHSKRVTAHGDTPQLDLKARPTYGAGEITVLVEVADMELHTKKIEISGLKFAGLTCTGCYACSSGISCKVRIHVEEPDELTVHVKSDDPDVVAASSSLMARKLEFGTDSTFKAFSAMPKTSLCFYIVEREYCKSCSKEDTQKCVNTKLEQPQSILIEHKGTIIGKQNNTCTAKASCWLESVKSFFYGLKNMLGGIFGNVFIGIFTFLTPFILLILFFMFGWRILFCFKCCRRTRGLFKYRHLKDDEETGYRKIIERLNNKKGKNRLLDGERLADRKIAELFSTKTHIG

SEQ ID NO: 1703 - protein, 644 aa, Artificial Sequence
  derived and/or modified protein sequence (wt) from CCHFV(Iran-53)__DQ446216.1__Gc
FLDSIVKGMKNLLNSTSLETSLSIEAPWGAINVQSTYKPTVSTANIALSWSSVEHRGNKVLVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGSVTITLSEPRNIQQKLPPEIITLHPKIEEGFFDLMHVQKVLSASTVCKLQSCTHGVPGDLQVYHIGNLLKGDRVNGHLIHKIEQHFNTSWMSWDGCDLDYYCNMGDWPSCTYTGVTQHNHASFVNLLNIETDYTKTFHFHSKRVTAHGDTPQLDLKARPTYGAGEVTVLVEVADMELHTKKIEISGLKFAGLTCTGCYACSSGISCKVRIHVDEPDELTVHVKSDDPDVVAASSSLMARKLEFGTDSTFKAFSAMPKTSLCFYIVEREYCKSCSKEDTQKCVNTKLEQPQSILIEHKGTIIGKQNNTCTAKASCWLESVKSFFYGLKNMLGGIFGNVFIGIFTFLTPFILLILFFMFGWRILFCFKCCRRTRGLFKYRHLKDDEETGYRKIIERLNNKKGKNRLLDGERLADRKIAELFSTKTHIG

SEQ ID NO: 1704 - protein, 644 aa, Artificial Sequence
  derived and/or modified protein sequence (wt) from CCHFV(Kosova Hoti)__EU037902.1__Gc
FLDSIVKGMKNLLNSTSLETSLSIEAPWGAINVQSTFKPTVSTANIALSWSSVEHRGNKILVTGRSESIMKLEERTGISWDLGVEDASESKLLTVSIMDLSQMYSPVFEYLSGDRQVEEWPKATCTGDCPQRCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAAGTSLMARKLEFGTDSTFKAFSAMPKTSLCFYIVEKEYCKSCSEDDTKKCVDTKLEQPQSILIEHRGTIIGKQNDTCTAKASCWLESVKSFFYGLKNMLGSVFGNFFIGILLFLAPFVLLVLFFMFGWKILFCFKCCRRTRGLFKYRHLKDDEETGYRRIIERLNNKKGKNRLLDGERLADRKIAELFSTKTHIG

SEQ ID NO: 1705 - protein, 644 aa, Artificial Sequence
  derived and/or modified protein sequence (wt) from CCHFV(YL04057)__FJ562094.1__Gc
FLDSIAKGKKSLLNSTSLETSLSIEAPWGAINVQSTFKPTVSAANIALSWSSVEHRGNKILVSGRSESIMKLEERTGVSWNLGVEDASESKTLTVSVMDLSQMYSPVFEYLSGDRQVEEWPKATCTGDCPERCGCTSSTCLHKEWPHSRNWRCSPTWCWGVGTGCTCCGLDVKDFFTDYMLVKWKVEYIKTEAIVCVELTSQERQCSLIEAGTRFNLGPVTITLSEPRNVQQRLPPEIVTLHPKIEEGFFDLMHVQKILSASTVCKLQSCTHGVPGDFQVYHVGNLLRGDKVNGHSIHKIEPHFNTSWMSWDGCDLDYFCNMGDWPSCTYTGVTQHNRAAFINMLNIETDYTKTFHFHSKRVTAHGDTPQLDLKARPAYGAGEVTVLVEVADLELHTKKLEVSGLKIASLTCSGCYACSSGISCKVRIHVNEPDEFTVHVRSSDPDVVAAGSSLMARKIEFGADSTFKAFSSMPKDSLCFYIVEKDYCSSCTDDDTQKCVNTKLDHPQSILIEHKGTIIGKQNDTCSTKTSCWLESVKGFFYGLKNMLSGIFGNVFLGILLFLAPFVLLIFFFFFGWRLLFCLKCCRRTRGLLKYKHLKDEEEAGYKKIIERLNGKKGKSQLFDGERLADRKIAELFSTKIHIG

SEQ ID NO: 1706 - protein, 644 aa, Artificial Sequence
  derived and/or modified protein sequence (wt) from CCHFV(V42/81)__GU477490.1__Gc
FLDSIVKGKKNLLNSTSLETSLSIEAPWGAINIQSTFKPTVSAANIALSWSSVEHRGNKILVSGRSESIMKLEERTGVSWNLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFIDHMFVKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGETPQLDLKARPAYGAGEITVLVEVADMELHTKKVEISGLKFASLACTGCYACSSGISCKVRIHVDEPDELTVHVKSNDPDVVAASTSLMARKLESGTDSTFKAFSAMPKTSLCFYIVEREYCKSCSEDDTQKCVETKLEQPQSILIEHKGTIIGKQNDTCTAKASCWLESVKSFFYGLKNMLGSVFGNFFIGILLFLAPFVLLVLFFMFGWKILFCFKCCRRTRGLFKYRHLKEDEETGYRRIIERLNSKKGKNRLLDGERLADRKIAELFSTKTHIG

SEQ ID NO: 1707 - protein, 644 aa, Artificial Sequence
  derived and/or modified protein sequence (wt) from CCHFV(79121M18)__GU477493.1__Gc
FLDSTAKGMKSLLNSTSLETSLSIEAPWGAINVQSTFKPTVSAANIALSWSSVEHRGNKILVSGRSESIMKLEERTGVSWNLGVEDASESKTLTVSVMDLSQMYSPVFEYLSGDRQVEEWPKATCTGDCPERCGCTSSTCLHKEWPHSRNWRCNPTWCWGVGTGCTCCGLDVKDFFTDYMLVKWKVEYIKTEAIVCVELTSQERQCSLIEAGTRFNLGPVTITLSEPRNVQQRLPPEIVTLHPKIEEGFFDLMHVQKILSASTVCKLQSCTHGVPGDFQIYHVGNLLRGDKVNGHSIHKIEPHFNTSWMSWDGCDLDYFCNMGDWPSCTYTGVTQHNRAAFINMLNIETDYTKTFHFHSKRVTAHGDTPQLDLKARPAYGAGEVTVLVEVADLELHTKKLEVSGLKIASLTCSGCYACSSGISCKVRIHVNEPDEFTVHVRSSDPDVVAAGSSLMARKIEFGADSTFKAFSSMPKDSLCFYIVEKDYCSSCTDDDTQKCVNTKLDHPQSILIEHKGTIIGKQNDTCSTKTSCWLESVKGFFYGLKNMLSGIFGNVFLGIFLFLAPFVLLIFFFFFGWRLLFCLKCCRRTRGLLKYKHLKDEEEAGYKKIIERLNGKKGKSQLFDGERLADRKIAELFSTKIHIG

SEQ ID NO: 1708 - protein, 644 aa, Artificial Sequence
  derived and/or modified protein sequence (wt) from CCHFV(Afg09-2990)__HM452306.1__Gc
FLDSIVKGMKNLLNSTSLETSLSIEAPWGAINVQSTYKPTVSTANIALSWSSVEHRGNKVLVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGSVTITLSEPRNIQQKLPPEIITLHPKIEEGFFDLMHVQKVLSASTVCKLQSCTHGVPGDLQVYHIGNLLKGDRVNGHLIHKIEQHFNTSWMSWDGCDLDYYCNMGDWPSCTYTGVTQHNHASFVNLLNIETDYTKTFHFHSKRVTAHGDTPQLDLKARPTYGAGEITVLVEVADMELHTKKIEISGLKFAGLTCTGCYACSSGISCKVRIHVDEPDELTVHVKSDDPDVVAASSSLMARKLEFGTDSTFKAFSAMPKTSLCFYIVEREYCKSCSKEDTQKCVNTKLEQPQSILIEHKGTIIGKQNNTCTAKASCWLESVKSFFYGLKNMLGGIFGNVFIGIFTFLTPFILLILFFMFGWRILFCFKCCRRTRGLFKYRHLKDDEETGYRKIIERLNNKKGKNRLLDGERLADRKIAELFSTKTHIG

SEQ ID NO: 1709 - protein, 644 aa, Artificial Sequence
  derived and/or modified protein sequence (wt) from CCHFV(Sudan Al-Fulah 3-2008)__HQ378184.1__Gc
FLDSIVKGMKNLLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFVNLLNIETDYTKNFHFHSKRVTAHGDTPQLDLKARPTYGAGEITVLVEVADMELHTKKIEISGLKFASLTCTGCYACSSGISCKVRIHVDEPDELTVHVKSDDPDVVAASSSLMARKLEFGTDSTFKAFSAMPKTSLCFYIVEKEYCKSCSEEDTKKCVNTKLEQPQSILIEHKGTIIGKQNSTCTAKVSCWLESAKSFFYGLKDMLSGIFGNVFIGIFLFLAPFVLLVLFFMFGWRILLCFRCCRRTRGLFKYRHLKDDEETGYRRIIERLNNKKGKNKLLDGERLADRKIAELFSTKTHIG

SEQ ID NO: 1710 - protein, 644 aa, Artificial Sequence
  derived and/or modified protein sequence (wt) from CCHFV(Sudan AB1-2009)__HQ378187.1__Gc
FLDSIAKGMKNLLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFVNLLNIETDYTKNFHFHSKRVTAHGDTPQLDLKARPTYGAGEITVLVEVADMELHTKKIEISGLKFASLTCTGCYACSSGISCKVRIHVDEPDELTVHVKSDDPDVVAASSSLMARKLEFGTDSTFKAFSAMPKTSLCFYIVEREHCKSCNEEDTKKCVNTKLEQPQSILIEHKGTIIGKQNSTCTARASCWLESVKSFFYGLKNMLSGIFGNVFMGIFLFLAPFILLILFFMFGWRILFCFKCCRRTRGLFKYRHLKDDEETGYRRIIERLNNKKGKNKLLDGERLADRRIAELFSTKTHIG

SEQ ID NO: 1711 - protein, 644 aa, Artificial Sequence
  derived and/or modified protein sequence (wt) from CCHFV(NIVA 118595)__JN572083.1__Gc
FLDSIVKGMKNLLNSTSLETSLSIEAPWGAINVQSTYKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGSVTITLSEPRNIQQKLPPEIITLHPRIEEGFFDLMHVQKVLSASTVCKLQSCTHGVPGDLQVYHIGNLLKGDRVNGHLIHKIEQHLNTSWMSWDGCDLDYYCNMGDWPSCTYTGVTQHNHASFVNLLNIETDYTKTFHFHSKRVTAHGDTPQLDLKARPTYGAGEITVLVEVADMELHTKKIEISGLKFASLSCTGCYACSSGISCKVRIHVDEPDELTVHVKSDDPDVVAASSSLMARKLESGTDSTFKAFSAMPKTSLCFYIVEREYCKGCSKEDTQKCVNTKLEQPQSILIEHKGTIIGKQNNTCTAKASCWLESVKSFFYGLKNMLSGIFGNVFLGIFSFLAPFVLLILFFMFGWRILFCFKCCRRTRGLFKYRHLKDDEETGYRKIIERLNNKKGKNKLLDGERLADRKIAELFSTKTHIG

SEQ ID NO: 1712 - protein, 644 aa, Artificial Sequence
  derived and/or modified protein sequence (wt) from CCHFV(NIV 112143)__JN572085.1__Gc
FLDSIVKGMKNLLNSTSLETSLSIEAPWGAINVQSTYKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGSVTITLSEPRNIQQKLPPEIITLHPRIEEGFFDLMHVQKVLSASTVCKLQSCTHGVPGDLQVYHIGNLLKGDRVNGHLIHKIEQHLNTSWMSWDGCDLDYYCNMGDWPSCTYTGVTQHNHASFVNLLNIETDYTKTFHFHSKRVTAHGDTPQLDLKARPTYGAGEITVLVEVADMELHTKKIEISGLKFASLSCTGCYACSSGISCKVRIHVDEPDELTVHVKSDDPDVVAASSSLMARKLEFGTDSTFKAFSAMPKTSLCFYIVEREYCKGCSKEDTQKCVNTKLEQPQSILIEHKGTIIGKQNNTCTAKASCWLESVKSFFYGLKNMLSGIFGNVFLGIFSFLAPFVLLILFFMFGWRILFCFKCCRRTRGLFKYRHLKDDEETGYRKIIERLNNKKGKNKLLDGERLADRKIAELFSTKTHIG

SEQ ID NO: 1713 - protein, 644 aa, Artificial Sequence
  derived and/or modified protein sequence (wt) from CCHFV(SCT ex Afghanistan)__KC344856.1__Gc
FLNSIVKGMKNLLNSTNLETSLSIEAPWGAINVQSTFKPTVSTANIALSWSSVEHRGNKILVSGRSESIMKLEERTGISWDLGVEDASESKSLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKLNGHMIHKIEPHFNTSWMSWDGCDLDYYCNMGDWPSCTYTGVTQHNHAAFVNLLNIETDYTKNFHFHSKRVTAHGDTPQLDLKARPTYGAGEITVLVEVADMELHTKKIDISGLKFASLTCAGCYACSSGISCKVRIHVDEPDELTVHVKSEDPDIVAASTSLIARKLELGTDSTFKAFSAMPKTSLCFYIVEREYCKSCSKEDTQKCVNTKLEHPQGILIEHKGTIIGKQNDTCTAKAGCWLESVKSFFYGLKNMLSGIFGNVFIGIFLFLAPFVLLILFFMFGWRLLFCFKCCRRTRGLFKYRHLKEDEESGYRRIIERLNNKKGKNKLLDGERLADRRIAELFSTKTHIG

SEQ ID NO: 1714 - protein, 644 aa, Artificial Sequence
  derived and/or modified protein sequence (wt) from CCHFV(Zahedan 2007)__KC867273.1__Gc
FLDSIVKDMKNLLNSTSLETSLSIEAPWGAINVQSTYKPTVSTANIALSWSSVEHRGNKVLVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGSVTITLSEPRNIQQKLPPEIITLHPKIEEGFFDLMHVQKVLSASTVCKLQSCTHGVPGDLQVYHIGNLLKGDRVNGHLIHKIEQHFNTSWMSWDGCDLDYYCNMGDWPSCTYTGVTQHNHASFVNLLNIETDYTKTFHFHSKRVTAHGDTPQLDLKARPTYGAGEITVLVEVADMELHTKKIEISGLKFAGLTCTGCYACSSGISCKVRIHVDEPDELTVHVKSDDPDVVAASSSLMARKLEFGTDSTFKAFSAMPKTSLCFYIVEREYCKSCSKEDTQKCVNTKLEQPQSILIEHKGTIIGKQNNTCTAKASCWLESVKSFFYGLKNMLGGIFGNVFIGIFTFLTPFILLIFFFMFGWRILFCFKCCRRTRGLFKYRHLKDDEETGYRKIIERLNNKKGKNRLLDGERLADRKIAELFSTKTHIG

SEQ ID NO: 1715 - protein, 644 aa, Artificial Sequence
  derived and/or modified protein sequence (wt) from CCHFV(SPU 44/08)__KJ682805.1__Gc
FLDSIVKGMKNLLNSTSLETSLSIEAPWGAINVQSTFKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVDYIKTEAIVCVELTSQERQCSLIEAGTRFNLGPVTITLSEPRNIQQKLPPEIVTLHPRIEEGFFDLMHIQKVLSASTVCKLQSCTHGVPGDLQIYHIGNLLKGDKVNGHLIHKIEPHFNTSWMSWDGCDLDYYCNMGDWPSCSYTGVTQHNHAAFVNMLNIETDYTKNFHFHSKRVTAHGDTPQLDLKARPTYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSKEDTQKCVNTKLEQPQSILIEHKGTIIGKQNDTCTAKASCWLESIKSFFYGLKNMLSGIFGNVFIGIFLFLAPFIMLILFFMFGWRILFCFKCCRRTRGLFKYRHLKDDEEIGYRKIIERLNNKKGKNKLLDGERLADRKIAELFSTKTHIG

SEQ ID NO: 1716 - protein, 644 aa, Artificial Sequence
  derived and/or modified protein sequence (wt) from CCHFV(SPU 383/87)__KJ682806.1__Gc
FLDSIVKGMKNLLNSTSLETSLSIEAPWGAINVQSTFKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVDYIKTEAIVCVELTSQERQCSLIEAGTRFNLGPVTITLSEPRNIQQKLPPEIVTLHPRIEEGFFDLMHIQKVLSASTVCKLQSCTHGVPGDLQIYHIGNLLKGDKVNGHLIHKIEPHFNTSWMSWDGCDLDYYCNMGDWPSCSYTGVTQHNHAAFVNMLNIETDYTKNFHFHSKRVTAHGDTPQLDLKARPTYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSKEDTQKCVNTKLEQPQSILIEHKGTIFGKQNDTCTAKASCWLESVKSFFYGLKNMLSGIFGNVFIGVFLFLAPFIMLILFFMFGWRILFCFKCCRRTRGLFKYRHLKDDEEIGYRKIIERLNNKKGKNKLLDGERLADRKIAELFSTKTHIG

SEQ ID NO: 1717 - protein, 644 aa, Artificial Sequence
  derived and/or modified protein sequence (wt) from CCHFV(SPU 130/89)__KJ682807.1__Gc
SLDSIVKGMKNLLNSTSLETSLSIEAPWGAINVQSTFKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVDYIKTEAIVCVELTSQERQCSLIEAGTRFNLGPVTITLSEPRNIQQKLPPEIVTLHPRIEEGFFDLMHIQKVLSASTVCKLQSCTHGVPGDLQIYHIGNLLKGDKVNGHLIHKIEPHFNTSWMSWDGCDLDYYCNMGDWPSCSYTGVTQHNHAAFVNMLNIETDYTKNFHFHSKRVTAHGDTPQLDLKARPTYGAGEITVLVEVADMELHTKKVEISGLKFASLTCTGCYACSSGISCKVRIHVDEPDELTVHVKSEDPDIVAASSSLMARKLEFGTDSTFKAFSAMPKTSLCFYIVEREHCKSCSKEDTQRCVNTKLEQPQSILIEHKGTIIGKQNDTCTAKASCWLESIKSFFYGLKNMLSGIFGNVFIGVFLFLAPFIILILFFMFGWRILFCFKCCRRTRGLLKYRHLKDDEEIGYRKIIERLNNKKGKNKLLDGERLADRKIAELFSTKTHIG

SEQ ID NO: 1718 - protein, 644 aa, Artificial Sequence
  derived and/or modified protein sequence (wt) from CCHFV(SPU 497/88)__KJ682808.1__Gc
FLDSIVKGMRNLLNSTSLETSLSIEAPWGAINVQSTFKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVDYIKTEAIVCVELTSQERQCSLIEAGTRFNLGPVTITLSEPRNIQQKLPPEIVTLHPRIEEGFFDLMHIQKVLSASTVCKLQSCTHGVPGDLQIYHIGNLLKGDKVNGHLIHKIEPHFNTSWMSWDGCDLDYYCNMGDWPSCSYTGVTQHNHAAFVNMLNIETDYTKNFHFHSKRVTAHGDTPQLDLKARPTYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSKEDTQKCVNTKLEQPQSILIEHKGTIIGKQNDTCTARASCWLESIKSFFYGLKNMLSGIFGNVFIGIFLFFAPFIMLILFFMFGWRILFCFKCCRRTRGLFKYRHLKDDEEVGYRKIIERLNNKKGKNKLLDGERLADRKIAELFSTKTHIG

SEQ ID NO: 1719 - protein, 644 aa, Artificial Sequence
  derived and/or modified protein sequence (wt) from CCHFV(SPU 18/88)__KJ682810.1__Gc
FLDSIVKGKKNLLNSTSLETSLSIEAPWGAINVQSTFKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVDYIKTEAIVCVELTSQERQCSLIEAGTRFNLGPVTITLSEPRNIQQKLPPEIVTLHPRIEEGFFDLMHIQKVLSASTVCKLQSCTHGVPGDLQIYHIGNLLKGDKVNGHLIHKIEPHFNTSWMSWDGCDLDYYCNMGDWPSCSYTGVTQHNHAAFVNMLNIETDYTKNFHFHSKRVTAHGDTPQLDLKARPTYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSKEDTQKCVNTKLEQPQSILIEHKGTIIGKQNDTCTGKAGCWLESIKSFFYGLKNMLSGIFGNVFIGIFLFLAPFIMLILFFMFGWRILFCFKCCRRTRGLFKYRHLKDDEEIGYRKIIERLKNKKGKNKLLDGERLADRKIAELFSTKTHIG

SEQ ID NO: 1720 - protein, 644 aa, Artificial Sequence
  derived and/or modified protein sequence (wt) from CCHFV(SPU 431/85)__KJ682812.1__Gc
FLDSIVKGRKNLLNSTSLETSLSIEAPWGAINVQSTFKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQRVLSASTVCKLQSCTHGVPGDLQVYHIGNLLKGDKVNGHLIHKIEPHFNTSWMSWDGCDLDYYCNMGDWPSCTYTGVTQHNHAAFVNLLNIETDYTKNFHFHSKRVTAHGDTPQLDLKARPTYGAGEVTVLVEVADMELHTKKIEISGLKFASLTCTGCYACSSGISCKVKIHVDEPDELTVHVKSEDPDIVAAGSSLMARKLEFGADSTFKAFSAMPKTSLCFYIVEREYCKSCSREDTRKCVNTKLDRPQSILIEHKGTIIGKQNNTCTAKASCWLESVKSFFYGLKNMLSGIFGNVFIGIFLFIAPFVLLILFFMFGWRILFCFKCCRRTRGLFKYRHLKDDEETGYRKIIERLNNKKGKNKLLDGERLADRKIAELFSTKSHIG

SEQ ID NO: 1721 - protein, 644 aa, Artificial Sequence
  derived and/or modified protein sequence (wt) from CCHFV(SPU 48/90)__KJ682813.1__Gc
FRDSIVKGMKNLLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNRASFVNLLNIETDYTKNFHFHSKRVTAHGDTPQLDLKARPTYGAGEITVLVEVADMELHTKKIEISGLKFASLTCTGCYACSSGISCKVRIHVDEPDELTVHVKSDDPDVVAASSSLMARKLEFGTDSTFKAFSAMPKTSLCFYIVEKEYCKSCSEEDTKKCVNTKLEQPQSILIEHKGTIIGKQNSTCTAKVSCWLESAKSFFYGLKDMLSGIFGNVFIGIFLFLAPFILLILFFMFGWRILLCFKCCRRTRGLFKYRHLKDDEETGYRRIIERLNNKKGKNKLLDGERLADRRIAELFSTKTHIG

SEQ ID NO: 1722 - protein, 644 aa, Artificial Sequence
  derived and/or modified protein sequence (wt) from CCHFV(SPU 187/90)__KJ682814.1__Gc
FLDSIVKGMKNLLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFVNLLNIETDYTKNFHFHSKRVTAHGDTPQLDLKARPTYGAGEITVLVEVADMELHTKKIEISGLKFASLTCTGCYACSSGISCKVRIHVDEPDELTVHVKSDDPDVVAASSSLMARKLEFGTDSIFKAFSAMPKTSLCFYIVEREHCKSCSEEDTKKCVNTKLEQPQSILIEHKGTIIGKQNSTCTAKTSCWLESVKSFFYGLKNMLSGIFGNVFIGIFLFLAPFILLILFFMFGWRILFCFKCCRRTRGLFKYRHLKDDEETGYRRIIERLNNKKGKNKLLDGERLADRRIAELFSTKTHIG

SEQ ID NO: 1723 - protein, 644 aa, Artificial Sequence
  derived and/or modified protein sequence (wt) from CCHFV(Haskovo-V46/13)__KR092379.1__Gc
FLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLTCTGCYACSSGISCKVRIHVDEPDELTVHVKSSDPDVVAAGTSLMARKLEFGTDSTFKAFSAMPKTSLCFYIVEREYCKSCSEDDTQKCVDTKLEQPQSILIEHKGTIIGKQNDTCTARASCWLESVKSFFYGLKNMLGSVFGNFLIGILLFLAPFVLLVLFFMFGWKILFCFKCCRRTRGLFKYRHLKDDEETGYRRIIERLNSKKGKNRLLDGERLADRKIAELFSTKTHIG

SEQ ID NO: 1724 - protein, 644 aa, Artificial Sequence
  derived and/or modified protein sequence (wt) from CCHFV(24-R-2012)__KR814856.1__Gc
FLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSNDPDVVAASTSLMARKLEFGTDSTFKAFSAMPKTSLCFYIVEREYCKSCSEEDTQKCVDTKLEQPQSILIEHKGTIIGKQNDTCTAKASCWLESVKSFFYGLKNMLGSVFGNFFIGILLFLAPFVLLVLFFMFGWKILFCFKCCRRTRGLLKYRLLKDDEETGYRRIIERLNNKKGKNRLLDGERLADRKIAELFSTKTHIG

SEQ ID NO: 1725 - protein, 644 aa, Artificial Sequence
  derived and/or modified protein sequence (wt) from CCHFV(36-ST-2014)__KR814857.1__Gc
FLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRLNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEDDTKKCVDTKLDQPQSILIEHKGTIIGKQNDTCTAKASCWLESVKSFFYGLKNMLGSVFGNFFVGILLFLAPFVLLVLFFMCGWKFLFCFKCCRRTRGLFKYRHLKDDEETGYRRIIERLNSKKGKNRLLDGERLADRKIAELFSTKSHIG

SEQ ID NO: 1726 - protein, 644 aa, Artificial Sequence
  derived and/or modified protein sequence (wt) from CCHFV(37-R-2013)__KR814858.1__Gc
FLDSIVKGMKNLLNSTSLETSLSIEAPWGAINVQSTFKPTVSTANIALSWSSVEHRGNKILVTGRSESIMKLEERTGVSWDLGVDDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSNDPDVVAASTSLMARKLEFGTDSTFKAFSAMPKTSLCFYIVEREYCKSCSEEDTQKCVDTKLEQPQSILIEHKGTIIGKQNVTCTAKASCWLESVKSFFYGLKNMLGSVFGNFFIGILLFLAPFVLLVLFFMFGWKILFCFKCCRRTRGLLKYRLLKDDEETGYRRIIERLNNKKGKNRLLDGERLADRKIAELFSTKTHIG

SEQ ID NO: 1727 - protein, 644 aa, Artificial Sequence
  derived and/or modified protein sequence (wt) from CCHFV(44-ST-2010)__KR814859.1__Gc
FLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRLNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEDDTKKCVDTKLDQPQSILIEHKGTIIGKQNDTCTAKASCWLESVKSFFYGLKNMLGSVFGNFFVGILLFLAPFVLLVLFFMCGWKILFCFKCCRRTRGLFKYRHLKDDEETGYRRIIERLNSKKGKNRLLDGERLADRKIAELFSTKSHIG

SEQ ID NO: 1728 - protein, 644 aa, Artificial Sequence
  derived and/or modified protein sequence (wt) from CCHFV(46-ST-2012)__KR814860.1__Gc
FLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRINGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEEDTQKCVDTRLEQPQSILIEHKGTIIGKQNDTCTAKASCWLESVKSFFYGLKNMLGSVFGNFFIGILLFLAPFVLLVLFFMFGWKILFCFKCCRRTRGLLKYRHLKDDEETGYRRIIERLNNKKGKNRLLDGERLADRKIAELFSTKTHIG

SEQ ID NO: 1729 - protein, 644 aa, Artificial Sequence
  derived and/or modified protein sequence (wt) from CCHFV(47-ST-2013)__KR814861.1__Gc
FLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGECPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEVSGLKFASLACTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGNFFVGILLFLAPFVLLVLFFMFGWKILFCFKCCRRTRGLFKYRHLKDDEETGYRRIIERLNSKKGKNRLLDGERLADRKIAELFSTKTHIG

SEQ ID NO: 1730 - protein, 644 aa, Artificial Sequence
  derived and/or modified protein sequence (wt) from CCHFV(52-R-2014)__KR814862.1__Gc
FLDSIVKGMKNLLNSTSLETSLSIEAPWGAINVQSTFKPTVSTANIALSWSSVEHRGNKILVTGRSESIMKLEERTGVSWDLGVDDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSNDPDVVAASTSLMARKLEFGTDSTFKAFSAMPKTSLCFYIVEREYCKSCSEEDTQKCVDTKLEQPQSILIEHKGTIIGKQNDTCTAKAGCWLESVKSFFYGLKNMLGSVFGNFFIGILLFLAPFVLLVLFFMFGWKILFCFKCCRRTRGLLKYRLLKDDEETGYRRIIERLNNKKGKNRLLDGERLADRKIAELFSTKTHIG

SEQ ID NO: 1731 - protein, 644 aa, Artificial Sequence
  derived and/or modified protein sequence (wt) from CCHFV(75-R-2012)__KR814863.1__Gc
FLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEEDTQKCVDTKLEQPQSILIEHKGTIIGKQNDTCTAKASCWLESVKSFLYGLKNMLGSVFGNFFIGILLFLAPFVLLVLFFMFGWKILFCFKCCRRTRGLLKYRLLKDDEETGYRRIIERLNNKKGKNRLLDGERLADRKIAELFSTKTHIG

SEQ ID NO: 1732 - protein, 644 aa, Artificial Sequence
  derived and/or modified protein sequence (wt) from CCHFV(75-ST-2010)__KR814864.1__Gc
FLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEEDTQKCVDTKLEQPQSILIEHKGTIIGKQNDTCTAKASCWLESVKSFFYGLKNMLGSVFGNFFIGILLFLAPFVLLVLFFMFGWKILFCFKCCRRARGLLKYRHLKDDEETGYRKIIERLNNKKGKNRLLDGERLADRKIAELFSTKTHIG

SEQ ID NO: 1733 - protein, 644 aa, Artificial Sequence
  derived and/or modified protein sequence (wt) from CCHFV(3756-ST-2007)__KR814866.1__Gc
FLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLTCTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGSFFVGILLFLTPFVLLVLFFMFGWKILFCFKCCRRTRGLFKYRHLKDDEETGYRRIIERLNSKKGKNRLLDGERLADRKIAELFSTKTHIG

SEQ ID NO: 1734 - protein, 644 aa, Artificial Sequence
  derived and/or modified protein sequence (wt) from CCHFV(3809-ST-2007)__KR814867.1__Gc
FLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEKEYCRSCSEEDTQKCVDTKLEQPQSILIEHKGTIIGKQNDTCTAKASCWLESVKSFFYGLKNMLGSVFGNFFIGILLFLTPFVLLVLFFMFGWKILFCFKCCRRTRGLLKYRHLKDDEETGYRRIIERLNNKKGKNRLLDGERLADRKIAELFSTKTHIG

SEQ ID NO: 1735 - protein, 644 aa, Artificial Sequence
  derived and/or modified protein sequence (wt) from CCHFV(3820-ST-2007)__KR814868.1__Gc
FLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLTCTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGSFFVGILLFLAPFVLLVLFFMFGWKILFCFKCCRRTRGLFKYRHLKDDEETGYRRIIERLNSKKGKNRLLDGERLADRKIAELFSTKTHIG

SEQ ID NO: 1736 - protein, 644 aa, Artificial Sequence
  derived and/or modified protein sequence (wt) from CCHFV(4495-ST-2008)__KR814869.1__Gc
FLDSIVKGMKNLLNSTSLETSLSIEAPWGAINVQSTFKPTVSTANIALSWSSVEHRGNKILVTGRSESIMKLEERTGISWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEEDTQRCVDTKLEQPQSILIEHKGTIIGKQNDTCTAKASCWLESVKSFFYGLKNMLGSVFGNFFIGILLFLAPFVLLVLFFMFGWKILFCFKCCRRARGLLKYRHLKDDEETGYRKIIERLNNKKGKNRLLDGERLADRKIAELFSTKTHIG

SEQ ID NO: 1737 - protein, 644 aa, Artificial Sequence
  derived and/or modified protein sequence (wt) from CCHFV(4691-ST-2009)__KR814871.1__Gc
FLDSIVKGMKNLLNSTSLETSLSIEAPWGAINVQSTFKPAVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGNFFVGILLFLAPFVLLVLFFMFGWKILFCFKCCRRTRGLFKYRHLKDDEETGYRRIIERLNSKKGKNRLLDGERLADRKIAELFSTKTHIG

SEQ ID NO: 1738 - protein, 644 aa, Artificial Sequence
  derived and/or modified protein sequence (wt) from CCHFV(4701-ST-2009)__KR814872.1__Gc
FLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLTCTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGGFFVGILLFLAPFVLLVLFFMFGWKILFCFKCCRRTRGLFKYRHLKDDEETGYRRIIERLNSKKGKNRLLDGERLADRKIAELFSTKTHIG

SEQ ID NO: 1739 - protein, 644 aa, Artificial Sequence
  derived and/or modified protein sequence (wt) from CCHFV(Oman-199809166)__KR864901.1__Gc
FLDSIAKGMKNLLNSTSLETSLSIEAPWGAINVQSTFKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIVTLHPRIEEGFFDLMHVQKVLSASTVCKLQSCTHGVPGDLQVYHIGNLLKGDKVNGHLIHKVEPHFNTSWMSWDGCDLDYYCNMGDWPSCTYTGVTQHNHAAFVNLLNIETDYTKNFHFHSKRVTAHGDTPQLDLKARPNYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSKEDTQKCVNAKLERPQSILIEHKGTIIGKQNDTCTAKASCWLESVKSFFYGLKNMLSGIFGNVFIGIFLFLAPFILLILFFMFGWRILFCFKCCRRTRGLFKYRHLKDDEETGYRKIIERLNNKKGKNKLLDGERLADRKIAELFSTKTHIG

SEQ ID NO: 1740 - protein, 644 aa, Artificial Sequence
  derived and/or modified protein sequence (wt) from CCHFV(200406546-Turkey)__KR864902.1__Gc
FLDSIVKGMKNLLNSTSLETSLSIEAPWGAINVQSTFKPTVSTANIALSWSSIEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLTARKLEFGTDSTFKAFSAMPKTSLCFYIVEKEYCKSCNEDDTQKCVDTKLEQPQSILIEHKGTIIGKQNDTCTAKASCWLESVKSFFYGLKNMLGSVFGNFFIGILLFLAPFVLLVLFFMFGWKILFCFKCCRRTRGLFKYRHLKDDEETGYKRIIERLNNKKGKNRLLDGERLADRKIAELFSTKTHIG

SEQ ID NO: 1741 - protein, 644 aa, Artificial Sequence
  derived and/or modified protein sequence (wt) from CCHFV(1-CR/HU-2015)__KU161584.1__Gc
FLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGNFFIGILLFLAPFVLLVLFFMFGWKILFCFKCCRRTRGLFKYRHLKDDEETGYRRIIERLNNKKGKNRLLDGERLADRKIAELFSTKTHIG

SEQ ID NO: 1742 - protein, 644 aa, Artificial Sequence
  derived and/or modified protein sequence (wt) from CCHFV(Gaib)__KX013445.1__Gc
FSDSIVKGMKNLLNSTSLETSLSIEAPWGAINVQSTFKPTVSTANIALSWSSIEHRGNKILVSGRSESIMKLEERTGISWDLGVEDASESRLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHAAFVNLLNIETDYTKNFHFHSKRVTAHGDTPQLDLKARPTYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSREDTQKCVSTKLEQPQSILIEHKGTIIGKQNNTCTTKTTCWLESVKSFFYGLKNMLSSIFGNVFVGIFSFLAPFILLILFFMFGWRILFCFKCCRRTRGLFKYRHLKDDEETGYRRIIERLNNKKGKSKLLDGERLADRKIAELFSTKTHIG

SEQ ID NO: 1743 - protein, 644 aa, Artificial Sequence
  derived and/or modified protein sequence (wt) from CCHFV(Hodzha)__KX013448.1__Gc
FLDSIVKGKKNLLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCSERCGCTSSTCLHKEWPHSRNWRCNPTWCWGVGTGCTCCGLDVKDLFTDYMFVKWKVDYIKTEAIVCVELTSQERQCSLVEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFVNLLNIETDYTKSFHFHSKRVTAHGDTPQLDLKARPTYGAGEITVLVEVADMELHTKKIEITGLKFASLTCTGCYACSSGISCKVRIHVDEPDELTVHVKSDDPDVVAASSSLMARKLEFGTDSTFKAFSAMPKTSLCFYIVEREYCKSCSKEDTQKCVNTKLEQPQSILIEQKGTIIGKQNNTCTAKASCWLESVKSFFYGLKNMLSGIFGNVFVGIFLFLAPFILLILFFMFGWRILFCFKCCRRTRGLFKYKHLKDDEETGYRRIIERLNNKKGKNKLLDGERLADRRIAELFSTKTHIG

SEQ ID NO: 1744 - protein, 644 aa, Artificial Sequence
  derived and/or modified protein sequence (wt) from CCHFV(IbAn7620)__KX013451.1__Gc
FLDSIAKGMKNPLNSTSLETSLSIEAPWGAIDVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFVNLLNIETDYTKNFHFHSKRVTAHGDTPQLDLKARPTYGAGEITVLVEVANMELHTKKIEISGLKFASLTCTGCYACSSGISCKVRIHVDEPDELTVHVKSDDPDVVAASSSLMARKLEFGTDSTFKAFSAMPKTSLCFYIVEREHCKSCSEEDTKKCVNTKLEQPQSILIEHKGTIIGKQNSTCTAKASCWLESVKSFFYGLKNMLSGIFGNVFMGIFLFLAPFILLILFFMFGWRILFCFKCCRRTRGLFKYRHLKDDEETGYRRIIERLNNKKGKNKLLDGERLADRRIAELFSTKTHIG

SEQ ID NO: 1745 - protein, 644 aa, Artificial Sequence
  derived and/or modified protein sequence (wt) from CCHFV(K128_76)__KX013454.1__Gc
FQDSIVKGMKNLLNSTSLETSLSIEAPWGAINVQSTYKPAVSAANIALSWSSVEHRGSKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDRVNGHLIHKIEPHFNTSWMSWDGCDLDYYCNMGDWPSCTYTGVTQHNHASFVNLLNIETDYTKSFHFHSKRVTAHGDTPQLDLKARPNYGAGEITVLVEVADMELHTKKIEISGLKFASLTCTGCYACSSGISCKVRIHVDEPDELTVHVKSDDPDVVAASSSLMARKLEFGTDSTFKAFSAMPKTSLCFYIVEREYCKSCSKEDTQKCVNTKLEQPQSILIEHKGTIIGKQNNTCTAKTSCWLESVKSFFYGLKNMLSGIFGNVFVGIFLFLAPFILLILFFMFGWRILFCFKCCRRTRGLFRYKHLENDEETGYRRIIERLNNKKGKNKLLDGERLADRRIAELFSTKTHIG

SEQ ID NO: 1746 - protein, 644 aa, Artificial Sequence
  derived and/or modified protein sequence (wt) from CCHFV(K168_40)__KX013457.1__Gc
FLDGIVKGMKNLLNSTSLETSLSIEAPWGAINVQSTYKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFINLLNIETDYTKSFHFHSKRVTAHGDTPQLDLKARPNYGAGEITVLVEVADMELHTKKIEISGLKFASLTCTGCYACSSGISCKVRIHVDEPDELTVHVKSDDPDVVAASSSLMARKLEFGTDSTFKAFSAMPKTSLCFYIVEREYCKSCSKEDTQKCVNTKLEHPQSILIEHKGTIIGKQNNTCTAKTSCWLESVKSFFYGLKNMLSGIFGNVFVGIFLFLAPFILLILFFMFGWRILFCFKCCRRTRGLFRYKHLEDDEETGYRRIIERLNNKKGKNKLLDGERLADRRIAELFSTKTHIG

SEQ ID NO: 1747 - protein, 644 aa, Artificial Sequence
  derived and/or modified protein sequence (wt) from CCHFV(K168_125)__KX013460.1__Gc
FLDSIVKGKKNLLNSTSLETSLSIEAPWGAINVQSTYKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFINLLNIETDYTKSFHFHSKRVTAHGDTPQLDLKARPNYGAGEITVLVEVADMELHTKKIEISGLKFASLTCTGCYACSSGISCKVRIHVDEPDELTVHVKSDDPDVVAASSSLMARKLEFGTDSTFKAFSAMPKTSLCFYIVEREYCKSCSKEDTQKCVNTKLEHPQSILIEHKGTIIGKQNNTCTAKTSCWLESVKSFFYGLKNMLSGIFGNVFVGIFLFLAPFILLILFFMFGWRILFCFKCCRRTRGLFRYKHLEDDEETGYRRIIERLNNKKGKNKLLDGERLADRRIAELFSTKTHIG

SEQ ID NO: 1748 - protein, 644 aa, Artificial Sequence
  derived and/or modified protein sequence (wt) from CCHFV(K229_194)__KX013463.1__Gc
FLDSIVKGKKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRLNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYSCSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGNFFVGILLFLAPFVLLVLFFMFGWKILFCFKCCRRTRGLFKYRHLKDDEETGYRKIIERLNSKKGKNRLLDGERLADRKIAELFSTKTHIG

SEQ ID NO: 1749 - protein, 644 aa, Artificial Sequence
  derived and/or modified protein sequence (wt) from CCHFV(K229_243)__KX013466.1__Gc
FLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEKEYCKSCSEEDTQKCVDTKLEQPQSILIEHKGTIIGKQNDTCTAKASCWLESVKSFFYGLKNMLGSVFGNFFIGILLFLTPFVLLVLFFMFGWKILFCFKCCRRTRGLLKYRHLKDDEETGYRRIIERLNNKKGKNRLLDGERLADRKIAELFSTKTHIG

SEQ ID NO: 1750 - protein, 644 aa, Artificial Sequence
  derived and/or modified protein sequence (wt) from CCHFV(K315_14)__KX013469.1__Gc
FLDSIVKGMKKLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLTCTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGSFFVGILLFLAPFVLLVLFFMFGWKILFCFKCCRRTRGLFKYRHLKDDEETGYRRIIERLNSKKGKNRLLDGERLADRKIAELFSTKTHIG

SEQ ID NO: 1751 - protein, 644 aa, Artificial Sequence
  derived and/or modified protein sequence (wt) from CCHFV(K323_27)__KX013472.1__Gc
FLDSIAKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTGQERQCSLIEAGTRFNLGPVTITLSEPRNIQQKLPPEIITLHPKIEEGFFDLMHVQKVLSASTVCKLQSCTHGIPGDLQIYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLTCTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGSFFVGILLFLAPFVLLVLFFMFGWKILFCFKCCRRTRGLFKYRHLNDDEETGYRRIIERLNSKKGKNRLLDGERLADRKIAELFSTKTHIG

SEQ ID NO: 1752 - protein, 644 aa, Artificial Sequence
  derived and/or modified protein sequence (wt) from CCHFV(K340_6)__KX013475.1__Gc
SLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVTDMELHTKKVEISGLKFASLTCTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGSFFVGILLFLAPFVLLVLFFMFGWKILFCFKCCRRTRGLFKYRHFKDDEETGYRRIIERLNSKKGKNRLLDGERLADRKIAELFSTKTHIG

SEQ ID NO: 1753 - protein, 644 aa, Artificial Sequence
  derived and/or modified protein sequence (wt) from CCHFV(Mamon)__KX013478.1__Gc
FLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEEDTQKCVDTKLEQPQSILIEHKGTIIGKQNDTCTAKTSCWLESVKSFFYGLKNMLGSVFGNFFIGILLFLAPFVLLVLFFMFGWKILFCFKCCRRTRGLLKYRHLKDDEETGYRRIIERLNNKKGKNRLLDGERLADRKIAELFSTKTHIG

SEQ ID NO: 1754 - protein, 644 aa, Artificial Sequence
  derived and/or modified protein sequence (wt) from CCHFV(Min)__KX013481.1__Gc
FLDSIVKGTKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRINGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLACTGCYACSSGISCKVRIHVDEPDELTVHVKSSDPDVVAASTSLMARKLEFGTDSTFKAFSAMPKTSLCFYIVEREYCKSCSEEDTQKCVDTKLEQPQSILIEHKGTIIGKQNDTCTAKASCWLESVKSFFYGLKNMLGSVFGNFFIGILLFLAPFVLLVLFFMFGWKILFCFKCCRRTRGLLKYRHLKDDEETGYRRIIERLNNKKGKNRLLDGERLADRKIAELFSTKTHIG

SEQ ID NO: 1755 - protein, 644 aa, Artificial Sequence
  derived and/or modified protein sequence (wt) from CCHFV(Nakiwogo)__KX013484.1__Gc
YLDSIAKGMKSLLNSTNLETSLSIEAPWGAINVQSTFKPTVSAANIALSWSSVEHRGNKILVSGRSESIMKLEERTGISWSLGVEDASESKTLTVSVMDLSQMYSPVFEYLSGDRQVEEWPKATCTGDCPERCGCTSSTCLHKEWPHSRNWRCNPTWCWGVGTGCTCCGLDVRDLFTDYMMVKWKVEYVKTEAIMCVELTSQERQCSLIEAGTRFNLGPVTITLSEPRNVQQRLPSEIVTLHPKIEEGFFDLMHVQKVLFCKHSLQATSCTHGVPGDLQVYHVGNLLKGDKVNGHSIHKIESHFNTSWMSWDGCDLDYFCNMGDWPSCTYTGVTQHNRAAFVNMLNIETDYTKTFHFHSKRVTAHGDTPQLDLKARPTYGAGEVTVLVEVADLELHTKKIEVSGLKFASLTCSGCYACSSGISCKVRIHVNEPDEFTVHVKSNDPDVVAAGSSLMARKIELGADSTFKAFSSMPKNSLCFYIVERDYCSSCTDDDTQKCVNTKLEHPQSILIEHKGTIIGKQNDTCPTKTSCWLESVKSFFYGLKNMLGGIFGNVFLGIFLFLAPFALLILFFFFGWRLLFCLKCCRRTRGLLKYKQLKDEEEAGYKKIIERLNDKKGKSRLFDGERLADRKIAELFSTKTHIG

SEQ ID NO: 1756 - protein, 644 aa, Artificial Sequence
  derived and/or modified protein sequence (wt) from CCHFV(Saf)__KX013487.1__Gc
FSDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKVEEGFFDLMHVQKVLSASTVCKLQSCTHGIPGDLQVYHIGNLLKGDRVNGHLIHKIEPHFNTSWMSWDGCDLDYYCNMGDWPSCTYTGVTQHNHAAFVNLLNIETDYMKTFHFHSKRVTAHGDTPQLDLKARPTYGAGEITVLVEVADMELHTKKVEISGLKFVSLACTGCYACSSGISCKVRIHVDEPDELTVHVKSSDPDVVAASTSLMARKLEFGTDSTFKAFSAMPKTSLCFYIVEREYCKSCSEEDTQKCVDTKLEQPQSILIEHKGTIIGKQNDTCTAKASCWLESVKSFFYGLKNMLGSVFGNFFIGILLFLAPFVLLVLFFMFGWKILFCFKCCRRTRGLLKYRHLKDDEETGYRRIIERLNNKKGKNRLLDGERLADRKIAELFSTKTHIG

SEQ ID NO: 1757 - protein, 644 aa, Artificial Sequence
  derived and/or modified protein sequence (wt) from CCHFV(Ast199)__KX056051.1__Gc
FLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRLNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEVSGLKFASLACTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGNFFVGILLFLAPFVLLVLFFIFGWKILFCFKCCRRTRGLFKYRHLKDDEETGYRKIIERLNSKKGKNRLLDGERLADRKIAELFSTKTHIG

SEQ ID NO: 1758 - protein, 644 aa, Artificial Sequence
  derived and/or modified protein sequence (wt) from CCHFV(Ast149)__KX056054.1__Gc
FLDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRLNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEVSGLKFASLACTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGNFFVGILLFLAPFVLLALFFIFGWKILFCFKCCRRTRGLFKYRHLKDDEETGYRKIIERLNSKKGKNRLLDGERLADRKIAELFSTKTHIG

SEQ ID NO: 1759 - protein, 644 aa, Artificial Sequence
  derived and/or modified protein sequence (wt) from CCHFV(Ast137)__KX056057.1__Gc
FLDSIVKGTKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRLNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEVSGLKFASLACTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGNFFVGILLFLAPFVLLVLFFIFGWKILFCFKCCRRTRGLFKYRHLKDDEETGYRKIIERLNSKKGKNRLLDGERLADRKIAELFSTKTHIG

SEQ ID NO: 1760 - protein, 644 aa, Artificial Sequence
  derived and/or modified protein sequence (wt) from CCHFV(Ast133)__KX056060.1__Gc
FSDSIVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFIKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRVNGHLIHKIEPHFNTSWMSWDGCDLDYYCNMGDWPSCTYTGVTQHNHAAFVNLLNIETDYTKTFHFHSKRVTAHGDTPQLDLKARPTYGAGEITVLVEVADMELHTKKVEISGLKFASLTCTGCYACSSGISCKVRIHVDEPDELTVHVKSSDPDVVAASTSLMARKLEFGTDSTFKAFSAMPKTSLCFYIVEREYCKSCSEDDTKKCVDTKLEQPQSILIEHKGTIIGKQNDTCTAKASCWLESVKSFFYGLKNMLGSVFGSFFVGILLFLAPFVLLVLFFMFGWKILFCFKCCRRTRGLFKYRHLKDDEETGYRRIIERLNSKKGKNRLLDGERLADRKIAELFSSKTHIG

SEQ ID NO: 1761 - protein, 644 aa, Artificial Sequence
  derived and/or modified protein sequence (wt) from CCHFV(SK/2015/human)__KX458183.1__Gc
FLDSIVRGMKNLLNSTSLETSLSIEAPWGAINVQSTYKPTVSTANIALSWSSVEHRGNKILVSGRSESIMKLEERTGVSWDLGVEDASESKLLTVSVMDLSQMYSPVFEYLSGDRQVEEWPKATCTGDCPERCGCTTSTCLHKEWPHSRNWRCNPTWCWGVGTGCTCCGLDVKDLFTDYMFVKWKVEYIKTEAIVCVELTSQGRQCSLIEAGTRFNLGSVTITLSEPRNIQHKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFVNLLNIETDYTKNFHFHSKRVTAHGDTPQLDLKARPTYGAGEITVLVEVADMELHTKKIEISGLKFASLTCTGCYACSSGISCKVRIHVDEPDELTVHVKSDDPDVVAASSSLMARKLEFGTDSTFKAFSAMPKTSLCFYIVEREYCKSCSKEDTQKCVNTKLEQPQSILIEHRGTIIGKQNNTCIAKASCWLESVKSFFYGLKNMLSGIFGNLFLGIFLFLAPFILLILFFMFGWRILFCFKCCRRTRGLFKYRHLKDDEETGYRRIIERLNNKKGKNKLLDGERLADRRIAELFSTKTHIG

SEQ ID NO: 1762 - protein, 644 aa, Artificial Sequence
  derived and/or modified protein sequence (wt) from CCHFV(YL16070)__KY354081.1__Gc
FLDSIAKGMKSLLNSTSLETSLSIEAPWGAINVQSTFKPTVSAANIALSWSSVEHRGNKILVSGRSESIMKLEERTGVSWNLGVEDASESKTLTVSVMDLSQMYSPVFEYLSGDRQVEEWPKATCTGDCPERCGCTSSTCLHKEWPHSRNWRCNPTWCWGVGTGCTCCGLDVKDFFTDYMLVKWKVEYIKTEAIVCVELTSQERQCSLIEAGTRFNLGPVTITLSEPRNVQQRLPPEIVTLHPKIEEGFFDLMHVQKILSASTVCKLQSCTHGVPGDFQVYHVGNLLRGDKVNGHSIHKIEPHFNTSWMSWDGCDLDYFCNMGDWPSCTYTGVTQHNRAAFINMLNIETDYTKTFHFHSKRVTAHGDTPQLDLKARPAYGAGEVTVLVEVADLELHTKKLEVSGLKIASLTCSGCYACSSGISCKVRIHVNEPDEFTVHVRSSDPDVVAAGSSLMARKIEFGADSTFKAFSSMPKDSLCFYIVEKDYCSSCTDDDTQKCVNTKLDHPQSILIEHKGTIIGKQNDTCSTKTSCWLKSFKGFFYGLKNMLSGIFGNVFLGILLFLAPFVLLIFFFFFGWRLLFCLKCCKKTKGLLKYKHLKDKEEAGYKKIIERLNGKKGKSQLFDGERLANRKIAELFSTKIHIG

SEQ ID NO: 1763 - protein, 644 aa, Artificial Sequence
  derived and/or modified protein sequence (wt) from CCHFV(Oman_812956)__KY362518.1__Gc
FFDSIAKGMKNLLNSTSLETSLSIEAPWGAINVQSTFKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIVTLHPRIEEGFFDLMHVQKVLSASTVCKLQSCTHGVPGDLQVYHIGNLLKGDKVNGHLIHKVEPHFNTSWMSWDGCDLDYYCNMGDWPSCTYTGVTQHNHAAFVNLLNIETDYTKNFHFHSKRVTAHGDTPQLDLKARPNYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSKEDTQKCVNAKLERPQSILIEHKGTIIGKQNDTCTAKASCWLESVKSFFYGLKNMLSGIFGNVFIGIFLFLAPFILLILFFMFGWRILFCFKCCRRTRGLFKYRHLKDDEETGYRKIIERLNNKKGKNKLLDGERLADRKIAELFSTKTHIG

SEQ ID NO: 1764 - protein, 644 aa, Artificial Sequence
  derived and/or modified protein sequence (wt) from CCHFV(UCCR4405)__KY484029.1__Gc
FLDSTVKGMKNLLNSTSLETSLSIEAPWGAINVQSTFKPTVSTANIALSWSSVEHRGNKILVTGRSESIMKLEERTGVSWDLGVEDASESKLLTVSIMDLSQMYSPVFEYLSGDRQVEEWPKATCTGDCPERCGCTSSTCLHKEWPHSRNWRCNPTWCWGVGTGCTCCGVDVKDLFTDHMFVKWKVEYIKTEAIVCVELTSQERQCSLIEAGTRFNLGPVTITLSEPRNIQQKLPPEIITLHPKIEEGFFDLMHVQKVLSASTVCKLQSCTHGIPGDLQIYHIGNLLKGDRVNGHLIHKIEPHFNTSWMSWDGCDLDYYCNMGNWPSCTYTGVTQHNHAAFVNLLNIETDYTKTFHFHSKRVTAHGDTPQLDLKARPTYGAGEITVLVEVADMELHTKKVEISGLKFASLVCTGCYACSSGISCKVRIHVDEPDELTVHVKSSDPDVVAASTSLMARKLEFGTDSIFKAFSAMPKTSLCFYIVEREYCKSCSEDDTKKCVDTKLEQPQSILIEHKGTIIGKQNDTCTAKASCWLESVKSFFYGLKNMLGSVFGNFFVGILLFLAPFVLLVLFFMFGWKILFCFKCCRRTRGLFKYRHLKDDEETGYRRIIERLNSKKGKNRLLDGERLADRKIAELFSTKTHIG

SEQ ID NO: 1765 - protein, 644 aa, Artificial Sequence
  derived and/or modified protein sequence (wt) from CCHFV(UCCR4401)__KY484035.1__Gc
FLDSTAKGMKNLLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFVNLLNIETDYTKNFHFHSKRVTAHGDTPQLDLKARPTYGAGEITVLVEVADMELHTKKIEISGLKFASLACTGCYACSSGISCKVRIHVDEPDELTVHVKSDDPDVVAASSSLMARKLEFGTDSTFKAFSAMPKTSLCFYIVEREHCKSCSEEDTKKCVNTKLEQPQSILIEHKGTIIGKQNSTCTAKASCWLESVKSFFYGLKNMLSGIFGNVFMGIFLFLAPFILLILFFMFGWRILFCFKCCRRTRGLFKYRHLKDDEETGYRRIIEKLNNKKGKNKLLDGERLADRRIAELFSTKTHIG

SEQ ID NO: 1766 - protein, 644 aa, Artificial Sequence
  derived and/or modified protein sequence (wt) from CCHFV(UCCR4448)__KY484042.1__Gc
FLDSIVKGMKNLLNSTSLETSLSIEAPWGAINVQSTYKPTVSTANIALSWSSVEHRGNKILVSGRSESIMKLEEKTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFVNLLNIETDYTKNFHFHSKRVTAHGDTPQLDLKARPTYGAGEITVLVEVADMELHTKKIEISGLKFASLTCTGCYACSSGISCKVRIHVDEPDELTVHVKSDDPDVVAASSSLMARKLEFGTDSTFKAFSAMPKTSLCFYIVEREHCKSCSEEDTKKCVNTKLEQPQSILIEHKGTIIGKQNSTCTAKASCWLESVKSFFYGLKNMLSGIFGNVFIGIFLFLAPFILLILFFMFGWKILFCFKCCRRTRGLFKYRHLKDDEETGYRRIIERLNNKKGKNKLLDGEILADRRIAELFSTKTHIG

SEQ ID NO: 1767 - protein, 644 aa, Artificial Sequence
  derived and/or modified protein sequence (wt) from CCHFV(U2-2-002/U-6415)__AY900144.1__Gc
FQDSIVKGMKNLLNSTSLETSLSIEAPWGAINVQSTYKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFVNLLNIETDYTKSFHFHSKRVTAHGDTPQLDLKARPSYGAGEITVLVEVADMELHTKKIEISGLKFASLTCTGCYACSSGISCKVRIHVDEPDEFTVHVKSDDPDVVAASSSLMARKLEFGTDSTFKAFSAMPKTSLCFYIVEREYCKSCSEEDTQKCVNTKLEQPQSILIEHKGTIIGKQNNTCTAKASCWLESVKSFFYGLKNMLSGIFGNVFVGIFLFLAPFILLILFFMFGWRILFCFKCCRRTRGLFRYKHLENDEETGYRRIIERLNNKKGKNKLLDGERLADRRIAELFSTKTHIG

SEQ ID NO: 1768 - protein, 644 aa, Artificial Sequence
  derived and/or modified protein sequence (wt) from CCHFV(SPU 45/88)__KJ682809.1__Gc
FLDSIVKGKKNLLNSTSLETSLSIEAPWGAINVQSTFKPTVSAANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVDYIKTEAIVCVELTSQERQCSLIEAGTRFNLGPVTITLSEPRNIQQKLPPEIVTLHPRIEEGFFDLMHVQNVLSASTVCKLQSCTHGVPGDLQIYHIGNLLKGDKVNGHLIHKIEPHFNTSWMSWDGCDLDYYCNMGDWPSCSYTGVTQHNHAAFVNMLNIETDYTKNFHFHSKRVTAHGDTPQLDLKARPTYGAGEITVLVEVADMELHTKKIEISGLKFASLTCTGCYACSSGISCKVRIHVDEPDELTVHVKSEDPDIVAASSSLMARKLEFGTDSTFKAFSAMPKTSLCFYIVEREYCKSCSKEDTQKCVNTKLEQPQSILIEHKGTIIGKQNDTCTAKASCWLESVKSFFYGLKNMLSGIFGNVFIGILLFLAPFIMLILFFMFGWRILFCFKCCRRTRGLFKYRHLKDDEEIGYRKIIERLNNKKGKNKLLDGERLADRKIAELFSTKTHIG

SEQ ID NO: 1769 - protein, 644 aa, Artificial Sequence
  derived and/or modified protein sequence (wt) from CCHFV(SR3)__AJ538199.1__Gc
FLDSIVKGMKNLLNSTSLETSLSIEAPWGAINVQSTYKPTVSTANIALSWSSVEHRGNKVLVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGSVTITLSEPRNIQQKLPPEIITLHPKIEEGFFDLMHVQKVLSASTVCKLQSCTHGVPGDLQVYHIGNLLKGDRVNGHLIHKIEQHFNTSWMSWDGCDLDYYCNMGDWPSCTYTGVTQHNHASFVNLLNIETDYTKTFHFHSKRVTAHGDTPQLDLKARPTYGAGEITVLVEVADMELHTKKIEISGLKFAGLTCTGCYACSSGISCKVRIHVDEPDELTVHVKSDDPDVVAASSSLMARKLEFGTDSTFKAFSAMPKTSLCFYIVEREYCKSCNKEDTQKCVNTKLEQPQSILIEHKGTIIGKQNNTCTAKASCWLESVKSFFYGLKNMLGGIFGNVFIGIFTFLTPFILLILFFMFGWRILFCFKCCRRTRGLFKYRHLKDDEETGYRKIIERLNNKKGKNRLLDGERLADRKIAELFSTKTHIG

SEQ ID NO: 1770 - protein, 1551 aa, Artificial Sequence
  derived and/or modified protein sequence (wt) from DUGV(ArD44313)__NC_004158.1__GP
MSKRVLIIAVVVYLVFTTQNQITGNHTTINSSSPSTTEASSTPTVSRTPQTTTTSTAVSTTITATTTPTASWTTQSQYFNKTTQHHWREETMISRNPTVLDRQSRASSVRELLNTKFLMLLGFIPKGEVNHLENACNREGKNCTELILKERIARFFSETEKESCYNTYLEKHLRSVSPEVSLTPYRVLGLREDILLKEIDRRIIRFETDSQRVTCLSASLLKPDVFIREQRIDAKPSNGPKIVPVDSVACMNLEANVDVRSNKLVIQSLMTTVKISLKNCKVVVNSRQCIHQQTGSGVIKVPKFEKQQGGTWSSYIAGVYTATIDLLDENNQNCKLFTECIVKGRELVKGQSELKSFNIEVLLPRVMKTRRKLLAVTDGSTECNSGTQLIEGKSIEVHKQDIGGPGKKLTICNGTSVLDVPLDEGHGCYTINVITSKRACRPKNSKLQCSIDKELKPCDSGKCLSISQKGAGHIKVSRGKTILITECKEHCQIPVPTGKGDIMVDCSGGRQHYLEVNIVDIHCPNTKFLGGIMLYFCRMSSRPTVALLLGIWIGCGYILTCIFSFLLYHLILFFANCIKQCRKKGERLGEICVKCEQQTVNLMDQELHDLNCNFNLCPYCCNRMSDEGMSRHVGKCPKRLERLNEIELYLTTSECLCLSVCYQLLISVGIFLKRTTWLVVLLVLLGLAISPVQGAPTEVSNVKQDGDYSICYFIFGCLVTAALLLKVKRTNSNGIVVVVDSFGRCPYCNEFTDSLFEEVLHDTLCSLCVCPFCEKQALDLVTLEEHVKECYKVATRKDIFKILGRKFTNALVRREKLFTTGLQLFINKTNVVVFALIMCFLLLLTGHNASAFDSGDLPDGVWEESSQLVKSCTQFCYIEEDVCYCPAEDGVGRKLLFFNGLQNSVKRLSDSHKLLTSVSIDAPWGRINVESTWKPTLAASNIAMSWSSTDIKGEKVILSGRSTSIIKLKEKTGVMWKLVGSGLASEKKKPFRFPIMDFAQVYNSVFQYITGDRLLSEWPKAVCTGDCPHRCGCQTSTCMAKECHTQECVSTHMVLGIGTGCTCCGMDVERPFNKYLGVKWSTEYLRTEVLVCVEVTEEERHCEIVEAGTRFNIGPITITISDPQNIGSKLPESLMTVQEIDDSNFVDIMHVGNVISADNSCRLQSCTHGSAVTTRFTALTALIKDDHSSGLNLAVLDPKVNSSWLSWEGCDMDYYCNVGDWPTCTYTGVVTQKLREFLKLDQHRKRLHTTLSFSLKKNLSKRSHTSVRLEGKTVTRMEVKVTALIEVDGMELHSKTIRLSGIRLTGLKCSGCFSCTSGISCSVNAKLTSPDEFTLHLRSTSPNVVVAETSIIARKGPSATTSRFKVFSVRDTKKICFEVVEREYCKDCTPDELTTCTGVELEPTKDILLEHRGTIVQHQNDTCKSKIDCWSNSISSFASGIGDFFKHYIGSIAVGVLGTVLPFALLILFFIYGDKMLWPFKVFCRPCRRCCRKNEGYNKLAEEEELRDIIRKFSKSGELINKDAKDKRTLARLFMSDNPKLKKEKKLSEIA

SEQ ID NO: 1771 - protein, 1551 aa, Artificial Sequence
  derived and/or modified protein sequence (wt) from DUGV(IbAr1792)__KU925456.1__GP
MSKRVLIIAVVVCLVFTTQNQIAGNHTTANSGSPSTKEASSMPTVSDTPQTTTTSTAVSTTITATTTPTASWTTQSQYFNKTTQHHWREETMVSRNPTVLNRQRRASSVKELLNTKFLMLLGFIPKGEVNHLENACNREGKNCTELILKERIARFFSETEKESCYNTYLEKHLCSVSPEVSLTPYRVLGLREDILLKKIDRRIIRFEADSQRVTCLSASLLKPDVFIREQRIDAKPSNGPKIVPVDSVRCINLEANVDVRSNKLVIQSLMTTVKISLKNCKVVVNSRQCIHQQTGSGVIKVPKFEKQQGGTWSSYIAGVYTATIDLLDEKNQNCKLFTECIVKGRELVKGQSELKSFNIEVLLPRVMKTRRKLLAVTDGSTECNSGTQLIEGKSIEVHKQDIGGPGKKLTICNGTSVLDVPLDEGHGCYTINVITSKRACRPKNSKLQCSIDKELKPCDSGKCLSISQKGAGHIKVSRGKTILITECKEHCQIPVPTGKGDIMVDCSGGRQHYLEVNIVDIHCPNTKFLGGIMLYFCRMSSRPTVALLLGIWIGCGYILTCIFSFLLYHLILFFANCIKQCRKKGERLGEICVKCEQQTVNLMDQELHDLNCNFNLCPYCCNRMSDEGMSRHVGKCPKRLERLNEIELYLNYKRVPSCLRCMLSTSISVGIFLKRTTWLVVLLVLLGLAISPVQGAPAEVSNVKQDGDYSICYFIFGCLVTAALLLKVKRTNSNGIVVVVDSFGRCPYCNEFTDSLFEEVLHDTLCSLCVCPFCEKQALDLVTLEEHVKECYKVTTRKDIFKILGRKFTNALVRREKLFTTGLQLFINKTNVVVFALIMCFLLLLTGHNASAFDSGDLPDGIWEESSQLVKSCTQFCYIEEDVCYCPAENGVGRKLLFFNGLQNSVKRLSDSHKLLTSVSIDAPWGAINVESTWKPTLAASNIAMSWSSTDIKGEKVILSGRSTSIIKLKEKTGVMWELGSELASEKKKLLVSIMDFAQVYNSVFQYITGDRLLSEWPKAVCTGDCPHRCGCQTSTCMAKEWPHTRNWRCNPTWCWGIGTGCTCCGMDVERPFNKYLGVKWSTEYLRTEVLVCVEVTDEERHCEIVEAGTRFNIGPITITISDPQNIGSKLPESLMTVQEIDDSNFVDIMHVGNVISADNSCRLQSCTHGSAGDYQIYSTDSLIKDDHSSGLNLAVLDPKVNSSWLSWEGCDMDYYCNVGDWPTCTYTGVVTQNSESFSNLINIEKDYTQRFHFHSKRISAKGHTLQLDLKARPNQDGGEVTALIEVDGMELHSKTIRLSGIRLTGLKCSGCFSCTSGISCSVNAKLTSPDEFTLHLRSTSPNVVVAETSIIARKGPSATTSKFKVFSVRDTKKICFEVVEREYCKDCSPDELTTCTGVELEPPKDILLEHRGTIVQHQNDTCKSKIDCWSNSISSFASGIGDFFKHYIGSIAVGILGTVLPFALLILFFIYGDKMLWPFKVFCRPCRRCCRKNEGYNKLAEEEELRDIIRKFSKSGELINKDAKDKRTLARLFMSDNPKLKKEKKLSEIA

SEQ ID NO: 1772 - protein, 1627 aa, Artificial Sequence
  derived and/or modified protein sequence (wt) from NSDV(Jilin)__NC_034391.1__GP
MVSLEKGLILLLLMHIAIASTGGSLGLPGLNGEDHTDDPEVGGDGPTEEYTEDDPESTTVSIPTTPPVLGQGTEEVPATSGEAEAGYSTTDVPDTVSEKVEDEQDTTPSTQVTPDQPEQSTTSLPDPWTAISTRIGRELLSVESDTTKSSLVTVGHPQQPIFLDGQPVEEVTHPVNERDVTEALRKYDKMKKLLSQRILSKMGMARDFTDEELDVWCHERFDNCSSNDIENRIRDFFLISDQTECFDEVLVKRLCESTNPIVGEPWQVAGIKEEIVRREMGRRIFRFFTPTLKVTCVSGSLNPSDQFVRFYDPVIERTSGPTIQNYDSMHCLNIENGLAKPSKMVVLNVLMTTVEVRLESCRAFINAHQCIYTQHADGQVMVPTFVDHSGTRRTIGAYTMSFNLTDERNRACIIRTTCVVKGKEVKKGQSQLRGFPTSIRLFKSVTGKRRLMAEEGDWTDCGSGTQLDMTMAVSVHNDKKGGPGKKLTICNGTTVSDSTLNEGLGCYTINKVITGKACKVGNSTGSCEVQTELQKCETGKCILVKQKSKGVVKLKRGKTVIITECQGSCLFAIPQDTGDITIDCSGGRQHYLEINIVDIHCPGKDKWKGFMLYICRVSSRPLIALTFGLWLAAGYLITCLVSFIIYNAVLLLSIAIKKVRQGREKKGDLCIKCEQHCMNLYDQELHELNCSFNLCPYCANRLSDEGLPRHVPRCPKKSERLEEIELYINYTRVPCILRWILSTSVQVGTAVKRLSWFSVLVTLFILTISPVQGFPLESPPIGAATDSRIMYGVVGFMFALIMMLNLKKSHYGSIFHVIDGFGRCNLCDTRIDSLMEETAHDLCCMFDCCPYCHRVSESNGSHCFHVRICVAKEISKKMLKAGGRLFTNKLVSREGTFANRIQLLYRRSKVVSTLVVTVLLLLVLLKPTTAFDSGPLPDGTWEEEEKLVRNCGQECILDQGECLCPGEHRAGRKLLFLNGLQDAARRMTESHRLLTSVSIDAPWGAINIESTFKPVLAASNIDLSWNSAEEQGDKIILSGRSTGIIKLQERTGLMWKMSSEKASESKNLLVSVMDFSQLYNSIFQYITGDRSLSEWPKAVCTGDCPDRCGCQTSTCYHKEWPHTRNWRCNPTWCWGIGTGCTCCGMDVERYFNKYFGVKWALEYVRTDVVVCVELTNEERHCDLVQAGSRFSIGPVSVTLSDPQNVVNRLSSNIMTIQEIADNGILDLMHVSKVISAENACKLQSCTHGSPGDLQILHTDNLIKGDMSGGINLAHLDPQVNTSWMSWEGCDLDYYCTVGDWPSCTYTGVNSINTDSFTNLINTETDYTGKFHFHSKRISARDDTLQMDLKARPNSGGGEMTVLVEVNGLELHSKRISLKGLRLTNLKCDGCFACSQGLTCTITAKLESPDEFTIHLRSTSRDVVVAETSVTARKVETGARSGFRAFAVRDVKKLCLEVVEKDYCPSCTVEDLKICVDVSLEPPKDILIEHKGTIIQHYNKSCDEGYNCWVGSVSGFFVGVKDFFEKNLGGVLIGLVSTILPLVLTVLFFIYGKKLFCLCRLCHKKCCRGSGRGRDGYSRLSQEEEIKEIIKKFSRNGELLGKGENDKRTVARMFMDGQSTKKAIKEVA

SEQ ID NO: 1773 - protein, 1627 aa, Artificial Sequence
  derived and/or modified protein sequence (wt) from NSDV(708)__EU697952.1__GP
MVSLEKGFFFLLLLHIVTASTGGPPGLPGPNGKDQTDGPEGGGDGPTEEYTEDDFESTTFSIPTTPPVSEQDAKEVSATSEEAEVEDSTLIVPKTMSEKVGDEQSTTSNMQVTTSQPEQSTTGMPGPWMASSIKIGRELLSVESDTTKSSLVTVGYPQQPIFLDGQPVEEVTHPVSERDVAEALRKYDKMKKLLSQRILSKMGMARDFTDDELDAWCHERFDNCSSNDIENRIKDFFLISDQTECFDEVLVKRLCESTNPIIGEPWQVAGIKEEVVRREMGRRIFRFFTPTLKVTCVSGSLNPSDQFVRFYNPVIERTSGPTIQNYDSMHCLNIENGLIKPSKVVILNVLMTTVEVRLESCRAFVNAHQCIYTQHADGQVRVPTFVDHSGTKRTIGAYTMSFNLTDERNKACIIRTTCVVKGKEVKKGQSQLRGFPTSIRLFKSVTGKRRLMAEEGDWTDCGSGTQLDMTTAVSVHNDRKGGPGKKLTICNGTTVSDSTLNEGLGCYTINKVMTGKACKVGNSTGSCEVQPELQKCETGKCILVKQKNKGVVKLKRGKTVIITECQGSCLFAIPQDTGDITIDCSGGRQHYLEVNIVDIHCPGKDKWKGFMLYMCRVSSRPLIALTFGLWLAAGYLITCLVSFIIYNAVLLLSIAIKKVRQGRERKGDLCIKCEQHCMNLYDQELHELNCSFNLCPYCANRLSDEGLPRHVPRCPKKTERLEEIELYINYTRVPCILRWILSTSVQVGTAVKRLSWFSVLVILFVLTISPVQGFPLENTPIGSTTDSRIIYGVVGFIFALIMMLNLKKSHYGSIFHVIDGFGRCNLCDTRIDSLMEETAHDLCCIFDCCPYCHRVSESNGSHCFHVRMCVAKEISKKMLKAAGRLFTNKLVSREGIFANRVQLLYRRSKVVSTFVVTVLLLLVFLRPATAFDSGPLPDGTWEEEERLVRNCGQECVLDQDECLCPGENRAGRRLLFLNGLQDAVRRMTESHRLLTSVSIDAPWGAINIESTFKPVLAASNIDLSWNSAEEQGDKIILSGRSTGIIKLQERTGLMWRMSSEKASESKNLLVSVMDFSQLYNSIFQYITGDRSLSEWPKAVCTGDCPDRCGCQTSTCYHKEWPHTRNWRCNPTWCWGIGTGCTCCGMDVEKYFNKYFGVKWALEYVRTDVVVCVELTNEERHCDLVQAGSRFSIGPVSVTLSDPQNVVNRLSSNIMTIQEIADNGILDLMHVSKVISAENACKLQSCTHGSPGDLQILHTDNLIKGDMSGGINLAHLDPQVNTSWMSWEGCDLDYYCTVGDWPSCTYTGVNSINTDSFTNLINTETDYTSKFHFHSKRISARDDTLQMDLKARPNTGGGEMTVLVEVNGLELHSKRINLKGLRLTNLKCDGCFACSQGLTCTVIAKLVSPDEFTIHLRSTSRDVVVAETSITARKVDTGARSSFRAFAVRDVKKLCLEVVEKDYCPSCTVDDLKMCVDVSLEPPKDILIEHKGTIIQHYNKSCDEGYNCWVGSVSGFFVGVKDFFEKNLGGVLIGLVGTILPLVLTILFFIYGKKLFYLCRLCHKKCCKGSGRGRDGYSRISREEEIKEIIKKFSRNGELLGKGENDKRTVARMFMDGQSTKKAIKEVA

SEQ ID NO: 1774 - protein, 1624 aa, Artificial Sequence
  derived and/or modified protein sequence (wt) from NSDV(779)__HQ286599.1__GP
MALVAKGLILMLLLYMFKASEVNLELPSWNSTEGTEYADELPTEPPSEEEPKLAAVSTVTTPAPPKESTEDTIESPDGGETMAPTTPAPVTDSASKLEEEPGTTQQAQSTQMQNSQAPIGMPEAWSTSPSRVGRKPLSASPDVSEPDQNTEAQTHPPVFLDGRPVEEEEHSVGTRDVASDLREYNQMKQLLSQRILAKMGMAVDFTDDELDTWCYRRYSNCSSNDIESRIRDFFLITDRSECFDEVLVKRLCETTSPIIDRAWKIAGLKEEVVLREMGRRIFRFFTPALKVTCMSGSLNPSNQFVRFYNPTLERTSGPTIQNYDGMHCLNIENGLIKPSKVVVINVLMTTVDIRLESCRAFINAQQCTYTQHADGLVRVPTFVGPHGEKRIIGAYTMSFNLTDEKNKACTIKTTCVVKGKEVKKGQSQLRGFPTTIRLFKSVTGKRRLMSNEEEWTECGSGTQLNMATAVSVHNDKLGGPGKKLTICNGTTVSDIALNEGLGCYTINKIITGKVCKTGNTTGSCEVQPELQKCETGKCILIKQKNKGVVKLKRGKTVIITECQGSCLFAIPQDTGDITIDCSGGRQHYLEINIVDIHCPGKDKWKGFMLYICRVSSRPLVALTFGIWLTAGYLITCLASFILYNAILLISIAIKKLKQKREKKGDLCIKCEQHCMNLYDQELHELNCSFNLCPYCANRLSDDGLPRHVPRCPKRGERLEEIELYINYTRVPCLLRWALSTSVQVGTVIKRLSWFGVLLTLFFLTISPVQGFPLENPPIGTATDSNIIYGLAGFIFALVLMLNLKKTHYGSVFHVIDGLGLCSLCDTRIDSLMEETAHELCCAFDCCPYCHQVSESNGSHCFHMRICVSKEISKKMLKAAGKLFTNKLVSREGFFANKIQLLYQRSKVVSTLILTVLLLLIILKPAAAFDSGPLPDGTWEEEESLIRSCDQECVLEQDECLCPGEHRAGRRLLFLSGLQDAARRMTESHRLLTSVSIDAPWGAINIESTFKPLLAASNIDLSWNSAEEQGDKIVLSGRSTGIIKLQERTGLMWKMSSEKASESKNLLVSIMDFSQLYNSIFQYITGDRSLSEWPKAVCTGECPDRCGCQTSTCYHKEWPHTRNWRCNPTWCWGIGTGCTCCGMDVERYFNKYFGVKWALEYVRTDVVVCVELTNEERHCDLVQAGSRFSIGPVSVTLSDPQNVVNRLSSSIMTIQEISDNGILDVMHVSKVISAENACKLQSCTHGSPGDLQILHTDNLIKGEMSSGINLAHLDPQVNTSWMSWEGCDLDYFCTVGDWPSCTYTGVNSINTDSFTNLINTETDYTSKFHFHSKRISARGDTLQMDLKARPNVGGGEMTVLVEVNGLELHSKKISLKGLKLSNLKCSGCFACSPGLSCTVIARLESPDEFTIHLRSTSRDVVVAETSVTARKAETGAKSSFRAFAVKDVKEICLEVVEKEYCPSCSIEDLKICISVTLEPPKDILIEHKGTIVQHYNKSCDEGYNCWIGSVSGFFVGVKDFFEKNFGSVIIGIVSTVLPLILTVLFFVYGRRLFCLCRLCHKKCCRGSSRGRDGYSRLSQEEEIKEIIKKFNRNGELLGRGENDKRTVARMFMDSQSARKAVKEVA

SEQ ID NO: 1775 - protein, 1433 aa, Artificial Sequence
  derived and/or modified protein sequence (wt) from BUNV__NC_001926.1__GP
MRILILLLAVTQLAVSSPVITRCFHGGQLIAERKSQTSISEFCIKDDVSMLKSEIVYTKNDTGIFGHSKVFRHWTITDWKACNPVVTAGGSINVIEVDKNLNLVTRNYVCTGDCTITVDRKNAQIIFQTDKLNHFEVTGTTISTGWFKSKASVTLDRTCEHIKVSCGKKTLQFHACFKQHMSCVRFLHRSILPGSMAISICQNIELIIITILALCIFIIMIILTKTYICYVLIPVFMPIAFAYGWAYNRSCKKCTCCGLAYHPFTNCGSYCVCGSKFETSDRMRMHRESGLCQGFKSLRVARRLCKSKGSSLIISILLSVLILSFVTPIEGTLTNYPTDQKYTLDEIADVLQAKTHEDSTKYYIILYTSLFGAGLTIIFAGVALGLTIILEVLTKINVIFCNECNMYHSKKSIKYVGDFTNKCGFCTCGLLEDPEGVVVHKAKKSCTYSYQINWVRGIMIFVAFLFVIQNTIIMVAAEEDCWKNEELKEDCVGPLIAPKDCTDKDHKTYLSEASLLATAKKITQVDAENVEILGKTMESAIRVIERQKTYHRMHLLEAVFLNKHCDYYKMFEHNSGYSQVKWRMMIKTQHFDICALQANSPFCAQCIADNSCAQGSWEFDTHMNSTYSSKVDNFKHDFSLFLRIFEAAFPGTAYVHLLTNIKEKKPYQAVSMIEKIKKKFPNNKLLIGYLDFGKYLLGLSHASTYELQQRQLDKLYQPTELTRSGGQQTSLANSVVGQATKECKKYKDVSCLSPRFGIPLEDLISCCDQPNYNIYKKPKKVYKAHDKEETWCINDQHCLVDFVPAEADTVEKLKPMKCWLVDPGKNDDVYSIAIKTCRVVDKGVCTVNSQKWNIIKCDSGPLYYSDHIPGEDTGNDIGHYCVSAGCKTDRYPINPDVVTDCVWEFTSRKSQYIGKISMQSLEDYEKALTDRLTHTLETYSFAPLENLPHIKPVYKYITAQGVENSDGIEGAFITASIPAAGGTSIGYNVRSKDGFPLLDLIVFVKSAVIKSTYNHIYDTGPTISINTKHDEHCTGQCPSNIEHEANWLTFSQERTSRWGCEEFGCLAVNTGCVFGSCQDVIRPETKVYRKAVDEVVILTVCITYPGHTFCTEINAIEPKITEEIELQFKTVDTKTLPYIVAVNNHKLYSGQINDLGTFGQMCGNVQKTNSSILGTGTPKFDYTCHGASRKDIIVRRCYNNNFDSCKLLKEETQLIFNDDHDTITVYNTNHLIGELAIKLILGDIQYKLFTETLDLQIDAKCVGCPDCFESYSCNFQIVSNIDTICSLEGPCDTFHNRISIKAMQQNYAVKLSCQKDPRPSGTFKICNREYTVVFHTVAKDDKIEINVGDQTSFIKEKDDRCKTWLCRVRDEGISVIFEPIKAFFGSYFSIFFYIIVVVVVGFLIIYIFMPMFMKLKEVLKANEKLYLQEIKQK

SEQ ID NO: 1776 - protein, 1436 aa, Artificial Sequence
  derived and/or modified protein sequence (wt) from BUNV(SFCrEq231)__KP063893.1__GP
MKMILLIIILCVNLAAANPVATRCFHGGQLIAETRSATSISEFCLKDDVSMIKSEITYTKNDTGIFGHSKIYKSWLIKDWKLCNPVPTAGGSINVIEVNSDLSLTTKAYVCSRDCTITIDKEEAQIIFQTDKLNHFEVSGTTLSSGWFKTKASVTLDRTCEHIKVTCGKKTLQFHACFRHHMSCVRFFHNTILPGTMVNSMCQNIELIIILGLTLIIFTLMVILTKTYICYILMPLFMPIAYAYGWAYNKSCKKCNCCGLAYHPFTNCGSHCVCGLKFEASDRMRIHRESGLCQGYKSLRIARLLCKSKGSSLIISTLLSMLLLSFITPIEGTMTNYPETRQYSLEEIADVVEGLLSEQNIKEYVVFYTSLFGSLILLLAFILSITLTKVTNALARTNVIYCEECSMYHAKKGIKYNGDFTNKCGFCTCDEQEDEEGIIIHKVSKKCTYRYQLQWAKIIMIILVMLLMMQNTILIVAAETDCWTKNSLELDCIGPLLTISDCSNKESKNYEEEAAKLVSQSKITQADAEQVTILGNTIDTALKAIRSQKTYQTMHLLESVFLMKNCDYYSSFEPNSGYSQAKWRLIAKTSHFDICSRHSMHHFCRCVADGTKCQNGDWDFAGEMNNIYSTKNDFYLHDLNLFFTLHETAFPGTTESLFYQLIAKKNTTGASKLLGKLITKYGNNKLFVGIWKFGQYLLTLPYVNTTELSKTRRETILKTHQILTRSQGGRSESMSSAEVGQIAKECANAKNVGCISPRFGIPIGNLTACGNSPNYKIYKTPNKIYKSNNRGEVWCSEDVHCLADFEPADTEVVNKVKKMTCFLSDVNTRADIFSIAISACRMVDKGVCTVNGAKWNILKCESGLYYFTDHREGQDTGNDFGEYCISHSCNTERYPINPDILKECIWEYHSRKSKYISTINLESLEEFKRAMSDKLSHTLMVYNFKPTANLPHIKPSYKFITANGIENSDGLESAYILSSIPAIGGMSIGYNIQTKDNFPLLDLIVFVKSAVIKTTYNHIYDTGPTIGINTNHDEHCTGPCPTIIPHKENWLTFSQERTSRWGCEEFGCLAINTGCVFGSCQDVIHPETKIYRKAVEEEVVLTVCINFPGNTFCTEINAIEPKITDEIELQFKTVDTKTLPNLLAVQNHKLYSGQINDLGSFSQGCGNVQKTNQSILGAGTVKFDYVCHGASRKDIIVRRCYTNNYDSCKLLKEERSLIFADNHETLEVANTRHLIGELQFKIMLGDIRYKAFAEKPELEIDAKCVGCPSCFESYSCNFQIVTSIDTVCSVEGPCTLFHNRIIITAAKQSYGVKMSCKTKPGPVEEFTICNRNYRVSFATIDKNDKIEINTGDQTSYIVEKDSRCKTWLCRVRDEGISVIFEPLKAFFGSYFSIAFYIIIGIAALFLIIYIFLPMFFKLRDVLKKNEYLYLQELKHK

SEQ ID NO: 1777 - protein, 1433 aa, Artificial Sequence
  derived and/or modified protein sequence (wt) from BUNV(GSA/S4/11232/WT)__KM507339.1__GP
MRILILLLAVTKLAVGSPVVTRCFHGGQLIAERKSQTSISEFCIKDDVSMLKSEIVYTKNDTGIFGHSKVFRHWTITDWKACNPVVTAGGSINVIEVDKNLNLVTRNYVCTGDCTITVDKENAQIIFQTDRLNHFEVTGTTISTGWFKSKASVTLDRTCEHIKVSCGKKTLQFHACFKQHMSCVRFLHRSILPGSMAISICQNIELIIITILALCIFIIMIILTKTYICYVLIPVFMPIAFAYGWAYNRSCKKCTCCGLAYHPFTNCGSYCVCGSKFETSDRMRMHRESGLCQGFKSLRVARRLCKSKGSSLIISILLSVLILSFVTPIEGTLTNYPTDQKYTLDEIADVLQAKTHEDSTKYYIILYTSLFGAGLTIIFAGVALGLTIILEVLTKINVIFCNECNMYHSKKSIKYVGDFTNKCGFCTCGLLEDPEGVVVHKAKKSCTYSYQISWVKGIMIFVAFLFVIQNTIIMVAAEEDCWKNEELKEDCVGPLIAPKDCTDKDRKTYLSEASLLATAKKITQVDAENVEILGKTMESAIRVIERQKTYHRMHLLEAVFLNKHCDYYKMFEHNSGYSQVKWRMMIKTQHFDICALQASSPFCAQCIADNSCAQGSWEFDTHMNSTYSSKVDNFKHDFSLFLRIFEAAFPGTAYVHLLTNIKEKKPYQAVSMIEKIKKKFPNNKLLIGYLDFGKYLLGLSHASTYELQQSQLDKLYQPTELTRSGGQQTSLASSVVGQATKECKKYKDVSCLSPRFGIPLEDLISCGDQPNYNIYKKPKKVYKAHNKEETWCINDQHCLVDFVPAEADTVEKLKPMKCWLVDPGKNDDVYSIAIKTCRVIDKGVCTVNSQKWNIIKCDSDLLYYSDHVPGEDTGNDIGHYCVSAGCKTDRYPINPDVVTDCVWEFTSRRSQYIGKISMQSLEDYKKALTDRLTHTLETYSFAPLENLPHIKPVYKYITAQGVENSDGIEGAFITASIPAAGGTSIGYNVRSKDGFPLLDLIVFVKSAVIKSTYNHIYDTGPTISINTKHDEHCTGQCPSNIEHEANWLTFSQERTSRWGCEEFGCLAVNTGCVFGSCQDVIRPETKVYRKAVDEIVILTVCITYPGHTFCTEINAIEPKITEEIELQFKTVDTKTLPYIVAVNNHKLYSGQINDLGTFGQMCGNVQKTNSSILGTGTPKFDYTCHGASRKDIIVRRCYNNNFDSCKLLKEETQLIFNDDHDTITVYNTNHLIGELAIKLILGDIQYKLFTETLDLQIDAKCVGCPDCFESYSCNFQIVSNIDTICNLEGPCDTFHNRISIKAMQQNYAVKLSCQKDPGPSGTFKICNREYTVVFHTVAKDDKIEINVGDQTSFIKEKDDRCKTWLCRVRDEGISVIFEPIKAFFGSYFSIFFYIIIIVVVGFLIIYIFMPMFMKLKEVLKANEKLYLQEIKQK

SEQ ID NO: 1778 - protein, 1433 aa, Artificial Sequence
  derived and/or modified protein sequence (wt) from BUNV(MGD/S1/12060/WT)__KM507340.1__GP
MRILILLLAVTKLAVGSPVVTRCFHGGQLIAERKSQTSISEFCIKDDVSMLKSEIVYTKNDTGIFGHSKVFRHWTITDWKACNPVVTAGGSINVIEVDKNLNLVTRNYVCTGDCTITVDKENAQIIFQTDRLNHFEVTGTTISTGWFKSKASVTLDRTCEHIKVSCGKKTLQFHACFKQHMSCVRFLHRSILPGSMAISICQNIELIIITILALCIFIIMIILTKTYICYVLIPVFMPIAFAYGWAYNRSCKKCTCCGLAYHPFTNCGSYCVCGSKFETSDRMRMHRESGLCQGFKSLRVARRLCKSKGSSLIISILLSVLILSFVTPIEGTLTNYPTDQKYTLDEIADVLQAKTHEDSTKYYIILYTSLFGAGLTIIFAGVALGLTIILEVLTKINVIFCNECNMYHSKKSIKYVGDFTNKCGFCTCGLLEDPEGVVVHKAKKSCTYSYQISWVKGIMIFVAFLFVIQNTIIMVAAEEDCWENEELKEDCVGPLIAPKDCTDKDRKTYLSEASLLATAKKITQVDAENVEILGKTMESAIRVIERQKTYHRMHLLEAVFLNKHCDYYKMFEHNSGYSQVKWRMMIKTQHFDICALQASSPFCAQCIADNSCAQGSWEFDTHMNSTYSSKVDNFKHDFSLFLRIFEAAFPGTAYVHLLTNIKEKKPYQAVSMIEKIKKKFPNNKLLIGYLDFGKYLLGLSHASTYELQQSQLDKLYQPTELTRSGGQQTSLASSVVGQATKECKKYKDVSCLSPRFGIPLEDLISCGDQPNYNIYKKPKKVYKAHNKEETWCINDQHCLVDFVPAEADTVEKLKPMKCWLVDPGKNDDVYSIAIKTCRVIDKGVCTVNSQKWNIIKCDSDLLYYSDHVPGEDTGNDIGHYCVSAGCKTDRYPINPDVVTDCVWEFTSRRSQYIGKISMQSLEDYKKALTDRLTHTLETYSFAPLENLPHIKPVYKYITAQGVENSDGIEGAFITASIPAAGGTSIGYNVRSKDGFPLLDLIVFVKSAVIKSTYNHIYDTGPTISINTKHDEHCTGQCPSNIEHEANWLTFSQERTSRWGCEEFGCLAVNTGCVFGSCQDVIRPETKVYRKAVDEIVILTVCITYPGHTFCTEINAIEPKITEEIELQFKTVDTKTLPYIVAVNNHKLYSGQINDLGTFGQMCGNVQKTNSSILGTGTPKFDYTCHGASRKDIIVRRCYNNNFDSCKLLKEETQLIFNDDHDTITVYNTNHLIGELAIKLILGDIQYKLFTETLDLQIDAKCVGCPDCFESYSCNFQIVSNIDTICNLEGPCDTFHNRISIKAMQQNYAVKLSCQKDPGPSGTFKICNREYTVVFHTVAKDDKIEINVGDQTSFIKEKDDRCKTWLCRVRDEGISVIFEPIKAFFGSYFSIFFYIIIIVVVGFLIIYIFMPMFMKLKEVLKANEKLYLQEIKQK

SEQ ID NO: 1779 - protein, 1435 aa, Artificial Sequence
  derived and/or modified protein sequence (wt) from Ab-BUNV(Cu20-XJ)__KJ710423.1__GP
MAISIVLMIIFSTTSCLARAAPSISKCFQDGVLIAEKKSSSGISEFCIKDDISILKSEINYSKNDTGIFMHSKVFRHWTVADWKQCQPIPSAGGSINVLEVDKNLNLVAKNYMCTRPCVITIDKENAQLLFQTEQLNQFEVTGTTISTGWFKSKTSVSLDNTCEHIKVTCGKKSLQFHACFKQHMSCVRFLHRSVLPGYMANSICQNIELIIIITLTLAIFIFMCIITRTYICYIMLPLFAPIAYIYGWLYNRSCKKCICCGLAYHPFTNCGSYCVCGSRFETSDRMRLHRESGLCQGFKSLRVARTLCKSKGSSLVISVLTAMLILSFVTPLEAISTNYPTDRKYTLNEVNDIVLGKGTENELKTSILALVSICGIGIIIIFIALTMLLDIVLEAIAKRSTIFCTECNLIHDKKAMKFVGDFTNKCGFCPCGELEDPEGLVIHTTRKSCTYYIKIRNLKLIMLVFSIAILMQNTAMLVVADENCWTNTEIKADCVGPLIGPTTCTNKGSKTYKAVAQELVTSNKITQLDADKYTLLGDTIESALSAITEQKHYSAIHLLETIFLMKHCDYYKVYEHNSGYSQTKWRLIAKTNSFDICSIPSTPNFCKCLSDSSCSTSTLNFATSMNSTYTSKAEYFNHDFTLFLNIFEAAFPGSATAFLFKKIKEKAPYQAFEMMGKIANKYPNNKLLVVLLKYGQYMVGLSHASTYQLKQEWIAKSLSLVRSTKTGLKMAMTNAEPGPATKECSDAKTIACLTPKFQVEVNNLMSCGASPNFKIYMKSGELYKAHDRNSVWCLNDMHCLTPYTPANAELVATMKKMECWQDNPKQPTNDYATPRRSCQMKDRGLCNVGADKWKVIKCDDDLMFYTDALESPDPAADIGQYCFSEKCQIERYPINPTSLTNCEWLYRAVKPQYIKRLSLQTIEEYKKAITDKLTHTLQLYHFAPLENLPHIRPTYEYITAQGTYTADGIEGASIITSIPALSGTSVGFKINAKDGTALLDIVVYIKSSVVKSVYNHIYDTGPTININSKHDELCTGQCPKRIPADPNWLTFSQERTSRWGCEEFGCLAINTGCVYGSCQDVIRTETKVYRKANEETVMLTVCITYPGHTFCTDVNALEPKITDELELQFKTIDIKSLPNLVAITNHKLYTGQINDLGTFGQMCGNVQKTNTSILGAGTPKFDYTCYSASRKDIIIRRCYNNNYDSCRLLKQEGDLLFDDNHETLIVYNNKRLNGELTMKLLLGDIQYKLYTENMELELEAKCVGCVGCFESYQCNLQITSSLDGNCAISGPCETFHDRIQIKTTKKDYALKLACTKDPGDKATFRVCGKDYDFNFHTVVKNDKIEVNVGDETSYIKEKDARCGTWLCRVRDEGLSVIFEPLKNFFGNYLNMFLYILGGVLLLFLSLYIIMPVCARLRDELKKNEKLHQMEMKKR

SEQ ID NO: 1780 - protein, 1434 aa, Artificial Sequence
  derived and/or modified protein sequence (wt) from ANADV(EIV-13128Kam)__KT313718.1__GP
MFLILVLLIPFYITATPVTTRCFHGGQLIAESKSLTAISEFCLKDDVSTVKSEITYLKNDTGIFAHSKVLRNWIIKDWKNCNPVPTAGGSINVIEVNTDLSLSTKTYVCSRDCTITVDKEDAQIIFQTDKLNHFEVSGTTLSSGWFKTKASVTLDRTCEHIKVTCGKKTLQFHACFKHHMSCIRFFHNTILPGTMAVSICQNIELIIITSLTLIIFILMVILTKTYICYVLMPLFMPVAYLYGWAYNRSCKKCSCCGLAYHPFTNCGSHCVCGLKFEASDRMRIHRESGLCQGYKSLRVARLLCKSKGSSLIISILLSVLILSFVTPIEGTLTNYPESKKYSLEEIADVIEGFIAEKGIKEYIVLYTSIFGALLLLIALIITVSLNRITEYLTNLNVIYCHECSMYHSKKNIKYIGDFTNKCGFCTCGELEDQEGLNMHKVSKKCIYRYQLTWSKVIMTILVCLLIAQNTVLIVAANDDCWAKQSLEIECVGPLQQVDACEDKSSRSYNGEAKKLVGTSKVTELDAGQVNLLGQTIESAIIAIRKQRTYATMHFLESVFLGRHCDYYKVFEHNSGYSQAKWRLLAKTNHFDICSRHSTHHFCRCMSDGTKCENGNWDFAGEMNTTYHSKRDFFKHDFNLFCTLLENAFPGTTESLYYQLLSKRNTTGASKLLGKLITKFGNNNLFVGIWKFGQFLLSLPYVNNTELSALQSSKILESPEPLLRSASGRQESLSSTTPGEASKECRNAKKISCISPRFGVPMENLTACGESPNYKIYKTPTRIYKSNNKGEIWCAGDVHCFQEFTPVLQEVVDKLKKMTCFLTEPEAEEDAFSIAIAMCKILDKGVCTINSERWNIIKCDSGLMYYTDQRDGQDTGNDFGEYCISHNCKTERFPINPSIISDCIWEYHSRKSRYISTLNLESLEEFKRAISEKLSHTLVVYQFKPTSNLPHMKPVYKYITAQGVENSDGIDSAFITASMPALSGTSIGYNVMSKDNFPLFDIIIFIKSAVIKTTYNHIYDTGPTIGINVMHDEHCTGQCPIEIPHKENWLTFSQERTSRWGCEEFGCLAINTGCVFGSCQDIIRPETKVYRKAIEESVLLTVCVTYPGNTFCTEINAIEPKITDELELQFKTVDTKTLPNLLAVQNHKLYSGQINDLGSFAQGCGNIQKTNLSVIGTGTAKFDYICHGASRKDIVVRRCYNNNYESCKLLKEEPSLIFSDNHETIEVANIRHLLGELQFKLMLGDLRYKSFAENPELEIEAKCVGCPSCFSSYSCNFRISSSIDTVCAIDGPCTIFHNRLIISSTKQDYGIKMSCKEKPNPVEKFNICKRIYSVLFTTIDKSDKIEINTGDQTSFIQEKDDRCKTWLCRVRDEGISVIFEPIKAFFGSYFSIAFYVVIGIIALFITIYIFLPMVFKLKDILKKNELLYLQEMKYK

SEQ ID NO: 1781 - protein, 1434 aa, Artificial Sequence
  derived and/or modified protein sequence (wt) from ANADV(EIV-13130Kam)__KT313721.1__GP
MFLILVLLIPFYITATPVTTRCFHGGQLIAESKSLTAISEFCLKDDVSTVKSEITYLKNDTGIFAHSKVLRNWIIKDWKNCNPVPTAGGSINVIEVNADLSLSTKTYVCSRDCTITVDKEDAQIIFQTDKLNHFEVSGTTLSSGWFKTKASVTLDRTCEHIKVTCGKKTLQFHACFKHHMSCIRFFHNTILPGTMAVSICQNIELIIITSLTLIIFILMVILTKTYICYVLMPLFMPVAYLYGWAYNRSCKKCSCCGLAYHPFTNCGSHCVCGLKFEASDRMRIHRESGLCQGYKSLRVARLLCKSKGSSLIISILLSVLILSFVTPIEGTLTNYPESKKYSLEEIADVIEGFIAEKGIKEYIVLYTSIFGALLLLIALIITVSLNRITEYLTNLNVIYCHECSMYHSKKNIKYIGDFTNKCGFCTCGELEDQEGLNMHKVSKKCIYRYQLTWSKVIMTILVCLLIAQNTVLIVAANDDCWAKQSLEIECVGPLQQVDACEDKSSRSYNGEAKKLVGTSKVTELDAGQVNLLGQTIESAIIAIRKQRTYATMHFLESVFLGRHCDYYKVFEHNSGYSQAKWRLLAKTNHFDICSRHSTHHFCRCMSDGTKCENGNWDFAGEMNTTYHSKRDFFKHDFNLFCTLLENAFPGTTESLYYQLLSKRNTTGASKLLGKLITKFGNNNLFVGIWKFGQFLLSLPYVNNTELSALQSSKILESPEPLLRSASGRQESLSSATPGEASKECRNAKKISCISPRFGVPMENLTACGESPNYKIYKTPTRIYKSNNKGEIWCAGDVHCFQEFTPVLQEVVDKLKKMTCFLTEPEAEEDAFSIAIAMCKILDKGVCTINSERWNIIKCDSGLMYYTDQRDGQDTGNDFGEYCISHNCKTERFPINPSIISDCIWEYHSRKSRYISTLNLESLEEFKRAISEKLSHTLIVYQFKPTSNLPHMKPVYKYITAQGVENSDGIDSAFITASMPALSGTSIGYNVMSKDNFPLFDIIIFIKSAVIKTTYNHIYDTGPTIGINVMHDEHCTGQCPIEIPHKENWLTFSQERTSRWGCEEFGCLAINTGCVFGSCQDIIRPETKVYRKAIEESVLLTVCVTYPGNTFCTEINAIEPKITDELELQFKTVDTKTLPNLLAVQNHKLYSGQINDLGSFAQGCGNIQKTNLSVIGTGTAKFDYICHGASRKDIVVRRCYNNNYESCKLLKEEPSLIFSDNHETIEVANIRHLLGELQFKLMLGDLRYKSFAENPELEIEAKCVGCPSCFSSYSCNFRISSSIDTVCAIDGPCTIFHNRLIISSTKQDYGIKMSCKEKPNPVEKFNICKRVYSVLFTTIDKNDKIEINTGDQTSFIQEKDDRCKTWLCRVRDEGISVIFEPIKAFFGSYFSIAFYVVIGIIALFITIYIFLPMVFKLKDILKKNELLYLQEMKYK

SEQ ID NO: 1782 - protein, 1434 aa, Artificial Sequence
  derived and/or modified protein sequence (wt) from ANADV(EIV-13395Mg)__KU159765.1__GP
MFLILVLLIPFYITATPVTTRCFHGGQLIAESKSLTAISEFCLKDDVSTVKSEITYLKNDTGIFAHSKVLRNWIIKDWKNCNPVPTAGGSINVIEVNADLSLSTKTYVCSRDCTITVDKEDAQIIFQTDKLNHFEVSGTTLSSGWFKTKASVTLDRTCEHIKVTCGKKTLQFHACFKHHMSCIRFFHNTILPGTMAVSICQNIELIIITSLTLIIFILMVILTKTYICYVLMPLFMPVAYLYGWAYNRSCKKCSCCGLAYHPFTNCGSHCVCGLKFEASDRMRIHRESGLCQGYKSLRVARLLCKSKGSSLIISILLSVLILSFVTPIEGTLTNYPESKKYSLEEIADVIEGFIAEKGIKEYIVLYTSIFGALLLLIALIITVSLNRITEYLTNLNVIYCHECSMYHSKKNIKYIGDFTNKCGFCTCGELEDQEGLNMHKVSKKCIYRYQLTWSKVIMTILVCLLIAQNTVLIVAANDDCWAKQSLEIECVGPLQQVDACEDKSSRSYNGEAKKLVGTSKVTELDAGQVNLLGQTIESAIIAIRKQRTYATMHFLESVFLGRHCDYYKVFEHNSGYSQAKWRLLAKTNHFDICSRHSTHHFCRCMSDGTKCENGNRDFAGEMNTTYHSKRDFFKHDFNLFCTLLENAFPGTTESLYYQLLSKRNTTGASKLLGKLITKFGNNNLFVGIWKFGQFLLSLPYVNNTELSALQSSKILESPEPLLRSASGRQESLSSATPGEASKECRNAKKISCISPRFGVPMENLTACGESPNYKIYKTPTRIYKSNNKGEIWCAGDVHCFQEFTPVLQEVVDKLKKMTCFLTEPEAEEDAFSIAIAMCKILDKGVCTINSERWNIIKCDSGLMYYTDQRDGQDTGNDFGEYCISHNCKTERFPINPSIISDCIWEYHSRKSRYISTLNLESLEEFKRAISEKLSHTLVVYQFKPTSNLPHMKPVYKYITAQGVENSDGIDSAFITASMPALSGTSIGYNVMSKDNFPLFDIIIFIKSAVIKTTYNHIYDTGPTIGINVMHDEHCTGQCPIEIPHKENWLTFSQERTSRWGCEEFGCLAINTGCVFGSCQDIIRPETKVYRKAIEESVLLTVCVTYPGNTFCTEINAIEPKITDELELQFKTVDTKTLPNLLAVQNHKLYSGQINDLGSFAQGCGNIQKTNLSVIGTGTAKFDYICHGASRKDIVVRRCYNNNYESCKLLKEEPSLIFSDNHETIEVANIRHLLGELQFKLMLGDLRYKSFAENPELEIEAKCVGCPSCFSSYSCNFRISSSIDTVCAIDGPCTIFHNRLIISSTKQDYGIKMSCKEKPNPVEKFNICKRVYSVLFTTIDKNDKIEINTGDQTSFIQEKDDRCKTWLCRVRDEGISVIFEPIKAFFGSYFSIAFYVVIGIIALFITIYIFLPMVFKLKDILKKNELLYLQEMKYK

SEQ ID NO: 1783 - protein, 1434 aa, Artificial Sequence
  derived and/or modified protein sequence (wt) from ANADV(EIV-16002Mg)__KT313724.1__GP
MFLILVLLIPFYITATPVTTRCFHGGQLIAESKSLTAISEFCLKDDVSTVKSEITYLKNDTGIFAHSKVLRNWIIKDWKNCNPVPTAGGSINVIEVNADLSLSTKTYVCSRDCTITVDKEDAQIIFQTDKLNHFEVSGTTLSSGWFKTKASVTLDRTCEHIKVTCGKKTLQFHACFKHHMSCIRFFHNTILPGTMAVSICQNIELIIITSLTLIIFILMVILTKTYICYVLMPLFMPVAYLYGWAYNRSCKKCSCCGLAYHPFTNCGSHCVCGLKFEASDRMRIHRESGLCQGYKSLRVARLLCKSKGSSLIISILLSVLILSFVTPIEGTLTNYPESKKYSLEEIADVIEGFIAEKGIKEYIVLYTSIFGALLLLIALIITVSLNRITEYLTNLNVIYCHECSMYHSKKNIKYVGDFTNKCGFCTCGELEDQEGLNMHKVSKKCIYRYQLTWSKVIMTILVCLLIAQNTVLIVAANDDCWAKQSLEIECVGPLQQVDACEDKSSRSYNGEAKKLVGTSKVTELDAGQVNLLGQTIESAIIAIRKQRTYATMHFLESVFLGRHCDYYKVFEHNSGYSQAKWRLLAKTNHFDICSRHSTHHFCRCMSDGTKCENGNWDFAGEMNTTYHSKRDFFKHDFKLFCTLLENAFPGTTESLYYQLLSKRNTTGASKLLGKLITKFGNNNLFVGIWKFGQFLLSLPYVNNTELSALQSSKILESPEPLLRSASGRQESLSSATPGEASRECRNAKKISCISPRFGVPMENLTACGESPNYKIYKTPARIYKSNNKGEIWCAGDVHCFQEFTPVLQEVVDKLKKMTCFLTEPEAEEDAFSIAIAMCKILDKGVCTINSERWNIIKCDSGLMYYTDQRDGQDTGNDFGEYCISHNCKTERFPINPSIISDCIWEYHSRKSRYISTLNLESLEEFKRAISEKLSHTLVVYQFKPTSNLPHMKPVYKYITAQGVENSDGIDSAFITASMPALSGTSIGYNVMSKDNFPLFDIIIFIKSAVIKTTYNHIYDTGPTIGINVMHDEHCTGQCPIEIPHKENWLTFSQERTSRWGCEEFGCLAINTGCVFGSCQDIIRPETKVYRKAIEESVLLTVCVTYPGNTFCTEINAIEPKITDELELQFKTVDTKTLPNLLAVQNHKLYSGQINDLGSFAQGCGNIQKTNLSVIGTGTAKFDYICHGASRKDIVVRRCYNNNYESCKLLKEEPSLIFSDNHETIEVANIRHLLGELQFKLMLGDLRYKSFAENPELEIEAKCVGCPSCFSSYSCNFRISSSIDTVCAIDGPCTVFHNRLIISSTKQDYGIKMSCKEKPNPVEKFNICKRVYSVLFTTIDKNDKIEINTGDQTSFIQEKDDRCKTWLCRVRDEGISVIFEPIKAFFGSYFSIAFYVVIGIIALFITIYIFLPMVFKLKDILKKNELLYLQEMKYK

SEQ ID NO: 1784 - protein, 1434 aa, Artificial Sequence
  derived and/or modified protein sequence (wt) from ANADV(EIV-16199Mg)__KT313730.1__GP
MFLILVLLIPFYITATPVTTRCFHGGQLIAESKSLTAISEFCLKDDVSTVKSEITYLKNDTGIFAHSKVLRNWIIKDWKNCNPVPTAGGSINVIEVNADLSLSTKTYVCSRDCTITVDKEDAQIIFQTDKLNHFEVSGTTLSSGWFKTKASVTLDRTCEHIKVTCGKKTLQFHACFKHHMSCIRFFHNTILPGTMAVSICQNIELIIITSLTLIIFILMVILTKTYICYVLMPLFMPVAYLYGWAYNRSCKKCSCCGLAYHPFTNCGSHCVCGLKFEASDRMRIHRESGLCQGYKSLRVARLLCKSKGSSLIISILLSVLILSFVTPIEGTLTNYPESKKYSLEEIADVIEGFIAEKGIKEYIVLYTSIFGALLLLIALIITVSLNRITEYLTNLNVIYCHECSMYHSKKNIKYIGDFTNKCGFCTCGELEDQEGLNMHKVSKKCIYRYQLTWSKVIMTILVCLLIAQNTVLIVAANDDCWAKQSLEIECVGPLQQVDACEDKSSRSYNEEAKKLVGTSKVTELDAGQVNLLGQTIESAIIAIRKQRTYATMHFLESVFLGRHCDYYKVFEHNSGYSQAKWRLLAKTNHFDICSRHSTHHFCRCMSDGTKCENGNWDFAGEMNTTYHSKRDFFKHDFNLFCTLLENAFPGTTESLYYQLLSKRNTTGASKLLGKLITKFGNNNLFVGIWKFGQFLLSLPYVNNTELSALQSSKILESPEPLLRSASGRQESLSSATPGEASKECRNAKKISCISPRFGVPMENLTACGESPNYKIYKTPTRIYKSNNKGEIWCAGDVHCFQEFTPVLQEVVDKLKKMTCFLTEPEAEEDAFSIAIAMCKILDKGVCTINSERWNIIKCDSGLMYYTDQRDGQDTGNDFGEYCISHNCKTERFPINPSIISDCIWEYHSRKSRYISTLNLESLEEFKRAISEKLSHTLIVYQFKPTSNLPHMKPVYKYITAQGVENSDGIDSAFITASMPALSGTSIGYNVMSKDNFPLFDIIIFIKSAVIKTTYNHIYDTGPTIGINVMHDEHCTGQCPIEIPHKENWLTFSQERTSRWGCEEFGCLAINTGCVFGSCQDIIRPETKVYRKAIEESVLLTVCVTYPGNTFCTEINAIEPKITDELELQFKTVDTKTLPNLLAVQNHKLYSGQINDLGSFAQGCGNIQKTNLSVIGTGTAKFDYICHGASRKDIVVRRCYNNNYESCKLLKEEPSLIFSDNHETIEVANIRHLLGELQFKLMLGDLRYKSFAENPELEIEARCVGCPSCFSSYSCNFRISSSIDTVCAIDGPCTIFHNRLIISSTKQDYGIKMSCKEKPNPVEKFNICKRVYSVLFTTIDKNDKIEINTGDQTSFIQEKDDRCKTWLCRVRDEGISVIFEPIKAFFGSYFSIAFYVVIGIIALFIIIYIFLPMVFKLKDILKKNELLYLQEMKYK

SEQ ID NO: 1785 - protein, 1434 aa, Artificial Sequence
  derived and/or modified protein sequence (wt) from ANADV(EIV-16208Mg)__KT313733.1__GP
MFLILVLLIPFYITATPVTTRCFHGGQLIAESKSLTAISEFCLKDDVSTVKSEITYLKNDTGIFAHSKVLRNWIIKDWKNCNPVPTAGGSINVIEVNADLSLSTKTYVCSRDCTITVDKEDAQIIFQTDKLNHFEVSGTTLSSGWFKTKASVTLDRTCEHIKVTCGKKTLQFHACFKHHMSCIRFFHNTILPGTMAVSICQNIELIIITSLTLIIFILMVILTKTYICYVLMPLFMPVAYLYGWAYNRSCRKCSCCGLAYHPFTNCGSHCVCGLKFEASDRMRIHRESGLCQGYKSLRVARLLCKSKGSSLIISILLSVLILSFVTPIEGTLTNYPESKKYSLEEIADVIEGFIAEKGIKEYIVLYTSIFGALLLLIALIITVSLNRITEYLTNLNVIYCHECSMYHSKKNIKYIGDFTNKCGFCTCGELEDQEGLNMHKVSKKCIYRYQLTWSKVIMTILICLLIAQNAVLIVAANDDCWAKQSLEIECVGPLQQVDACEDKSSRSYNGEAKKLVGTSKVTELDAGQVNLLGQTIESAIIAIRKQRTYATMHFLESVFLGRHCDYYKVFEHNSGYSQAKWRLLAKTNHFDICSRHSTHHFCRCMSDGTKCENGNWDFAGEMNTTYHSKRDFFKHDFKLFCTLLENAFPGTTESLYYQLLSKRNTTGASKLLGKLITKFGNNNLFVGIWKFGQFLLSLPYVNNTELSALQSSKILESPEPLLRSASGRQESLSSATPGEASKECRNAKKISCISPRFGVPMENLTACGESPNYKIYKTPTRIYKSNNKGEIWCAGDVHCFQEFTPVLQEVVDKLKKMTCFLTEPEAEEDAFSIAIAMCKILDKGVCTINSERWNIIKCDSGLMYYTDQRDGQDTGNDFGEYCISHNCKTERFPINPSIISDCIWEYHSRKSKYISTLNLESLEEFKRAISEKLSHTLVVYQFKPTSNLPHMKPVYKYITAQGVENSDGIDSAFITASMPALSGTSIGYNVMSKDNFPLFDIIIFIKSAVIKTTYNHIYDTGPTIGINVMHDEHCTGQCPIEIPHKENWLTFSQERTSRWGCEEFGCLAINTGCVFGSCQDIIRPETKVYRKAIEESVLLTVCVTYPGNTFCTEINAIEPKITDELELQFKTVDTKTLPNLLAVQNHKLYSGQINDLGSFAQGCGNIQKTNLSVIGTGTAKFDYICHGASRKDIIVRRCYNNNYESCKLLKEEPSLIFSDNHETIEVANIRHLLGELQFKLMLGDLRYKSFAENPELEIEAKCVGCPSCFSSYSCNFRISSSIDTVCAIDGPCTIFHNRLIISSTKQDYGIKMSCKEKPNSVEKFNICKRVYSVLFTTIDKNDKIEINTGDQTSFIQEKDDRCKTWLCRVRDEGISVIFEPIKAFFGSYFSIAFYVVIGIIALFIIIYIFLPMVFKLKDILKKNELLYLQEMKYK

SEQ ID NO: 1786 - protein, 1434 aa, Artificial Sequence
  derived and/or modified protein sequence (wt) from ANADV(EIV-16356Mg)__KT313736.1__GP
MFLILVLLIPFYITATPVTTRCFHGGQLIAESKSLTAISEFCLKDDVSTVKSEITYLKNDTGIFAHSKVLRNWIIKDWKNCNPVPTAGGSINVIEVNADLSLSTKTYVCSRDCTITVDKEDAQIIFQTDKLNHFEVSGTTLSSGWFKTKASVTLDRTCEHIKVTCGKKTLQFHACFKHHMSCIRFFHNTILPGTMAVSICQNIELIIITSLTLIIFILMVILTKTYICYVLMPLFMPVAYLYGWAYNRSCKKCSCCGLAYHPFTNCGSHCVCGLKFEASDRMRIHRESGLCQGYKSLRVARLLCKSKGSSLIISILLSVLILSFVTPIEGTLTNYPESKKYSLEEIADVIEGFIAEKGIKEYIVLYTSIFGALLLLIALIITVSLNRITEYLTNLNVIYCHECSMYHSKKNIKYIGDFTNKCGFCTCGELEDQEGLNMHKVSKKCIYRYQLTWSKVIMTILVCLLIAQNTVLIVAANDDCWAKQSLEIECVGPLQQVDACEDKSSRSYNGEAKKLVGTSKVTELDAGQVNLLGQTIESAIIAIRKQRTYATMHFLESVFLGRHCDYYKVFEHNSGYSQAKWRLLAKTNHFDICSRHSTHHFCRCMSDGTKCENGNWDFAGEMNTTYHSKRDFFKHDFKLFCTLLENAFPGTTESLYYQLLSKRNTTGASKLLGKLITKFGNNNLFVGIWKFGQFLLSLPYVNNTELSALQSSKILESPEPLLRSASGRQESLSSATPGEASKECRNAKKISCISPRFGVPMENLTACGESPNYKIYKTPTRIYKSNNKGEIWCAGDVHCFQEFTPLLQEVVDKLKKMTCFLTEPEAEEDAFSIAIAMCKILDKGVCTINSERWNIIKCDSGLMYYTDQRDGQDTGNDFGEYCISHNCKTERFPINPSIISDCIWEYHSRKSRYISTLNLESLEEFKRAISEKLSHTLVVYQFKPTSNLPHMKPVYKYITAQGVENSDGIDSAFITASMPALSGTSIGYNVMSKDNFPLFDIIIFIKSAVIKTTYNHIYDTGPTIGINVMHDEHCTGQCPIEIPHKENWLTFSQERTSRWGCEEFGCLAINTGCVFGSCQDIIRPETKVYRKAIEESVLLTVCVTYPGNTFCTEINAIEPKITDELELQFKTVDTKTLPNLLAVQNHKLYSGQINDLGSFAQGCGNIQKTNLSVIGTGTAKFDYICHGASRKDIVVRRCYNNNYESCKLLKEEPSLIFSDNHETIEVANIRHLLGELQFKLMLGDLRYKSFAENPELEIEAKCVGCPSCFSSYSCNFRISSSIDTVCAIDGPCTIFHNRLIISSTKQDYGIKMSCKEKPNPVEKFNICKRVYSVLFTTIDKNDKIEINTGDQTSFIQEKDDRCKTWLCRVRDEGISVIFEPIKAFFGSYFSIAFYVVIGIIALFITIYIFLPMVFKLKDILKKNELLYLQEMKYK

SEQ ID NO: 1787 - protein, 1434 aa, Artificial Sequence
  derived and/or modified protein sequence (wt) from ANADV(EIV-17769Yak)__KT313739.1__GP
MFLILVLLIPFYITATPVATRCFHGGQLIAESKSLTAISEFCLKDDVSTVKSEITYLKNDTGIFAHSKVLRNWIIKDWKNCNPVPTAGGSINVIEVNADLSLSTKTYVCSRDCTITVDKEDAQIIFQTDNLNHFEVSGTTLSSGWFKTKASVTLDRTCEHIKVTCGKKTLQFHACFKHHMSCIRFFHNTILPGTMAVSICQNIELIIITSLTLIIFILMVILTKTYICYVLMPLFMPVAYLYGWAYNRSCKKCSCCGLAYHPFTNCGSHCVCGLKFEASDRMRIHRESGLCQGYKSLRVARLLCKSKGSSLIISILLSVLILSFVTPIEGTLTNYPESKKYSLEEIADVIEGFIAEKGIKEYIVLYTSIFGALLLLIALIITVSLNRITEYLTNLNVIYCHECSMYHSKKNIKYVGDFTNKCGFCTCGELEDQEGLNMHKVSKKCIYRYQLTWSKVIMTILVCLLIAQNTVLIVAANDDCWAKQSLEIECVGPLQQVDACEDKSSRSYNGEAKKLVGTSKVTELDAGQVNLLGQTIESAIIAIRKQRTYATMHFLESVFLGRHCDYYKVFEHNSGYSQAKWRLLAKTNHFDICSRHSTHHFCRCMSDGTKCENGNRDFAGEMNTTYHSKRDFFKHDFNLFCTLLENAFPGTTESLYYQLLSKRNTTGASKLLGKLITKFGNNNLFVGIWKFGQFLLSLPYVNNTELSALQSSKILESPEPLLRSASGRQESLSSATPGEASRECRNAKKISCISPRFGVPMENLTACGESPNYKIYKTPTRIYKSNNKGEIWCAGDVHCFQEFTPVLQEVVDKLKKMTCFLTEPEAEEDAFSIAIAMCKILDKGVCTINSERWNIIKCDSGLMYYTDQRDGQDTGNDFGEYCISHNCKTERFPINPSIISDCIWEYHSRKSRYISTLNLESLEEFKRAISEKLSHTLVVYQFKPTSNLPHMKPVYKYITAQGVENSDGIDSAFITASMPALSGTSIGYNVMSKDNFPLFDIIIFIKSAVIKTTYNHIYDTGPTIGINVMHDEHCTGQCPIEIPHKENWLTFSQERTSRWGCEEFGCLAINTGCVFGSCQDIIRPETKVYRKAIEESVLLTVCVTYPGNTFCTEINAIEPKITDELELQFKTVDTKTLPNLLAVQNHKLYSGQINDLGSFAQGCGNIQKTNLSVIGTGTAKFDYICHGASRKDIVVRRCYNNNYESCKLLKEEPSLIFSDNHETIEVANIRHLLGELQFKLMLGDLRYKSFAENPELEIEAKCVGCPSCFSSYSCNFRISSSIDTVCAIDGPCTIFHNRLIISSTKQDYGIKMSCKEKPNPVEKFNICKRVYSVLFTTIDKNDKIEIDTGDQTSFIQEKDDRCKTWLCRVRDEGISVIFEPIKAFFGSYFSIAFYVVIGIIALFITIYIFLPMVFKLKDILKKNELLYLQEMKYK

SEQ ID NO: 1788 - protein, 1434 aa, Artificial Sequence
  derived and/or modified protein sequence (wt) from ANADV(EIV-18098Yak)__KT313742.1__GP
MFLILVLLIPFYITATPVTTRCFHGGQLIAESKSLTAISEFCLKDDVSTVKSEITYLKNDTGIFAHSKVLRNWIIKDWKNCNPVPTAGGSINVIEVNADLSLSTKTYVCSRDCTITVDKEDAQIIFQTDKLNHFEVSGTTLSSGWFKTKASVTLDRTCEHIKVTCGKKTLQFHACFKHHMSCIRFFHNTILPGTMAVSICQNIELIIITSLTLIIFILMVILTKTYICYVLMPLFMPVAYLYGWAYNRSCKKCSCCGLAYHPFTNCGSHCVCGLKFEASDRMRIHRESGLCQGYKSLRVARLLCKSKGSSLIISILLSVLILSFVTPIEGTLTNYPESKKYSLEEIADVIEGFIAEKGIKEYIVLYTSIFGALLLLIALIITVSLNRITEYLTNLNVIYCHECSMYHSKKNIKYVGDFTNKCGFCTCGELEDQEGLNMHKVSKKCIYRYQLTWSKVIMTILVCLLIAQNTVLIVAANDDCWAKQSLEIECVGPLQQVDACEDKSSRSYNGEAKKLVGTSKVTELDAGQVNLLGQTIESAIIAIRKQRTYATMHFLESVFLGRHCDYYKVFEHNSGYSQAKWRLLAKTNHFDICSRHSTHHFCRCMSDGTKCENGNWDFAGEMNTTYHSKRDFFKHDFNLFCTLLENAFPGTTESLYYQLLSKRNTTGASKLLGKLITKFGNNNLFVGIWKFGQFLLSLPYVNNTELSALQSSKILESPEPLLRSASGRQESLSSATPGEASRECRNAKKISCISPRFGVPMENLTACGESPNYKIYKTPARIYKSNNKGEIWCAGDVHCFQEFTPVLQEVVDKLKKMTCFLTEPEAEEDAFSIAIAMCKILDKGVCTINSERWNIIKCDSGLMYYTDQRDGQDTGNDFGEYCISHNCKTERFPINPSIISDCIWEYHSRKSRYISTLNLESLEEFKRAISEKLSHTLVVYQFKPTSNLPHMKPVYKYITAQGVENSDGIDSAFITASMPALSGTSIGYNVMSKDNFPLFDIIIFIKSAVIKTTYNHIYDTGPTIGINVMHDEHCTGQCPIEIPHKENWLTFSQERTSRWGCEEFGCLAINTGCVFGSCQDIIRPETKVYRKAIEESVLLTVCVTYPGNTFCTEINAIEPKITDELELQFKTVDTKTLPNLLAVQNHKLYSGQINDLGSFAQGCGNIQKTNLSVIGTGTAKFDYICHGASRKDIVVRRCYNNNYESCKLLKEEPSLIFSDNHETIEVANIRHLLGELQFKLMLGDLRYKSFAENPELEIEAKCVGCPSCFSSYSCNFRISSSIDTVCAIDGPCTVFHNRLIISSTKQDYGIKMSCKEKPNPVEKFNICKRVYSVLFTTIDKNDKIEINTGDQTSFIQEKDDRCKTWLCRVRDEGISVIFEPIKAFFGSYFSIAFYVVIGIIALFITIYIFLPMVFKLKDILKKNELLYLQEMKYK

SEQ ID NO: 1789 - protein, 1434 aa, Artificial Sequence
  derived and/or modified protein sequence (wt) from ANADV(EIV-18136Yak)__KT313745.1__GP
MFLILVLLIPFYITATPVTTRCFHGGQLIAESKSLTAISEFCLKDDVSTVKSEITYLKNDTGIFAHSKVLRNWIIKDWKNCNPVPTAGGSINVIEVNADLSLSTKTYVCSRDCTITVDKEDAQIIFQTDKLNHFEVSGTTLSSGWFKTKASVTLDRTCEHIKVTCGKKTLQFHACFKHHMSCIRFFHNTILPGTMAVSICQNIELIIITSLTLIIFILMVILTKTYICYVLMPLFMPVAYLYGWAYNRSCKKCSCCGLAYHPFTNCGSHCVCGLKFEASDRMRIHRESGLCQGYKSLRVARLLCKSKGSSLIISILLSVLILSFVTPIEGTLTNYPESKKYSLEEIADVIEGFIAEKGIKEYIVLYTSIFGALLLLIALIITVSLNRITEYLTNLNVIYCHECSMYHSKKNIKYIGDFTNKCGFCTCGELEDQEGLNMHKVSKKCIYRYQLTWSKVIMTILVCLLIAQNTVLIVAANDDCWAKQSLEIECVGPLQQVDACEDKSSRSYNGEAKKLVGTSKVTELDAGQVNLLGQTIESAIIAIRKQRTYATMHFLESVFLGRHCDYYKVFEHNSGYSQAKWRLLAKTNHFDICSRHSTHHFCRCMSDGTKCENGNWDFAGEMNTTYHSKRDFFKHDFKLFCTLLENAFPGTTESLYYQLLSKRNTTGASKLLGKLITKFGNNNLFVGIWKFGQFLLSLPYVNNTELSALQSSKILESPEPLLRSASGRQESLSSATPGEASKECRNAKKISCISPRFGVPMENLTACGESPNYKIYKTPTRIYKSNNKGEIWCVGDVHCFQEFTPVLQEVVDKLKKMTCFLTEPEAEEDAFSIAIAMCKILDKGVCTINSERWNIMKCDSGLMYYTDQRDGQDTGNDFGEYCISHNCKTERFPINPSIISDCIWEYHSRKSRYIGTLNLESLEEFKRAISEKLSHTLVVYQFKPTSNLPHMKPVYKYITAQGVENSDGIDSAFITASMPALSGTSIGYNVMSKDNFPLFDIIIFIKSAVIKTTYNHIYDTGPTIGINVMHDEHCTGQCPIEIPHKENWLTFSQERTSRWGCEEFGCLAINTGCVFGSCQDIIRPETKVYRKAIEESVLLTVCVTYPGNTFCTEINAIEPKITDELELQFKTVDTKTLPNLLAVQNHKLYSGQINDLGSFAQGCGNIQKTNLSVIGTGTAKFDYICHGASRKDIVVRRCYNNNYESCKLLKEEPSLIFSDNHETIEVANIRHLLGELQFKLMLGDLRYKSFAENPELEIEARCVGCPSCFSSYSCNFRISSSIDTVCAIDGPCTIFHNRLIISSTKQDYGIKMSCKEKPNPVEKFNICKRVYSVLFTTIDKNDKIEINTGDQTSFIQEKDDRCKTWLCRVRDEGISVIFEPIKAFFGSYFSIAFYVVIGIIALFIIIYIFLPMVFKLKDILKKNELLYLQEMKYK

SEQ ID NO: 1790 - protein, 1434 aa, Artificial Sequence
  derived and/or modified protein sequence (wt) from ANADV(EIV-18146Yak)__KT313748.1__GP
MFLILVLLIPFYITATPVTTRCFHGGQLIAESKSLTAISEFCLKDDVSTVKSEIIYLKNDTGIFAHSKVLRNWIIKDWKNCNPVPTAGGSINVIEVNADLSLSTKTYVCSRDCTITVDKEDAQIIFQTDKLNHFEVSGTTLSSGWFKTKASVTLDRTCEHIKVTCGKKTLQLHACFKHHMSCIRFFHNTILPGTMAVSICQNIELIIITSLTLIIFILMVILTKTYICYVLMPLFMPVAYLYGWAYNRSCKKCSCCGLAYHPFTNCGSHCVCGLKFEASDRMRIHRESGLCQGYKSLRVARLLCKSKGSSLIVSILLSVLILSFVTPIEGTLTNYPESKKYSLEEIADVIEGFIAEKGIKEYIVLYTSIFGALLLLIALIITVSLNRITEYLTNLNVIYCHECSMYHSKKNIKYIGDFTNKCGFCTCGELEDQEGLNMHKVSKKCIYRYQLTWSKVIMTILVCLLIAQNTVLIVAANDDCWAKQSLEIECVGPLQQVDACEDKSSRSYNEEAKKLVGTSKVTELDAGQVNLLGQTIESAIIAIRKQRTYATMHFLESVFLGRHCDYYKVFEHNSGYSQAKWRLLAKTNHFDICSRHSTHHFCRCMSDGTKCENGNWDFAGEMNTTYHSKRDFFKHDFNLFCTLLENAFPGTTESLYYQLLSKRNTTGASKLLGKLITKFGNNNLFVGIWKFGQFLLSLPYVNNTELSALQSSKILESPEPLLRSASGRQESLSSATPGEASKECRNAKKISCISPRFGVPMENLTACGESPNYKIYKTPTRIYKSNNKGEIWCAGDVHCFQEFTPVLQEVVDKLKKMTCFLTEPEAEEDAFSIAIAMCKILDKGVCTINSERWNIIKCDSGLMYYTDQRDGQDTGNDFGEYCISHNCKTERFPINPSIISDCIWEYHSRKSRYISTLNLESLEEFKRAISEKLSHTLIVYQFKPTSNLPHMKPVYKYITAQGVENSDGIDSAFITASMPALSGTSIGYNVMSKDNFPLFDIIIFIKSAVIKTTYNHIYDTGPTIGINVMHDEHCTGQCPIEIPHKENWLTFSQERTSRWGCEEFGCLAINTGCVFGSCQDIIRPETKVYRKAIEESVLLTVCVTYPGNTFCTEINAIEPKITDELELQFKTVDTKTLPNLLAVQNHKLYSGQINDLGSFAQGCGNIQKTNLSVIGTGTAKFDYICHGASRKDIVVRRCYNNNYESCKLLKEEPSLIFSDNHETIEVANIRHLLGELQFKLMLGDLRYKSFAENPELEIEARCVGCPSCFSSYSCNFRISSSIDTVCAIDGPCTIFHNRLIISSTKQDYGIKMSCKEKPNPVEKFNICKRVYSVLFTTIDKNDKIEINTGDQTSFIQEKDDRCKTWLCRVRDEGISVIFEPIKAFFGSYFSIAFYVVIGIIALFIIIYIFLPMVFKLKDILKKNELLYLQEMKYK

SEQ ID NO: 1791 - protein, 1434 aa, Artificial Sequence
  derived and/or modified protein sequence (wt) from ANADV(EIV-18353Yak)__KT313751.1__GP
MFLILVLLIPFYITATPVTTRCFHGGQLIAESKSLTAISEFCLKDDVSTVKSEIIYLKNDTGIFAHSKVLRNWIIKDWKNCNPVPTAGGSINVIEVNADLSLSTKTYVCSRDCTITVDKEDAQIIFQTDKLNHFEVSGTTLSSGWFKTKASVTLDRTCEHIKVTCGKKTLQFHACFKHHMSCIRFFHNTILPGTMAVSICQNIELIIITSLTLIIFILMVILTKTYICYVLMPLFMPVAYLYGWAYNRSCKKCSCCGLAYHPFTNCGSHCVCGLKFEASDRMRIHRESGLCQGYKSLRVARLLCKSKGSSLIISILLSVLILSFVTPIEGTLTNYPESKKYSLEEIADVIEGFIAEKGIKEYIVLYTSIFGALLLLIALIITVSLNRITEYLTNLNVIYCHECSMYHSKKNIKYIGDFTNKCGFCTCGELEDQEGLNMHKVSKKCIYRYQLTWSKVIMTILVCLLIAQNTVLIVAANDDCWAKQSLEIECVGPLQQVDACEDKSSRSYNEEAKKLVGTSKVTELDAGQVNLLGQTIESAIIAIRKQRTYATMHFLESVFLGRHCDYYKVFEHNSGYSQAKWRLLAKTNHFDICSRHSTHHFCRCMSDGTKCENGNWDFAGEMNTTYHSKRDFFKHDFNLFCTLLENAFPGTTESLYYQLLSKRNTTGASKLLGKLITKFGNNNLFVGIWKFGQFLLSLPYVNNTELSALQSSKILESPEPLLRSASGRQESLSSATPGEASKECRNAKKISCISPRFGVPMENLTACGESPNYKIYKTPTRIYKSNNKGEIWCAGDVHCFQEFTPVLQEVVDKLKKMTCFLTEPEAEEDAFSIAIAMCKILDKGVCTINSERWNIIKCDSGLMYYTDQRDGQDTGNDFGEYCISHNCKTERFPINPSIISDCIWEYHSRKSRYISTLNLESLEEFKRAISEKLSHTLIVYQFKPTSNLPHMKPVYKYITAQGVENSDGIDSAFITASMPALSGTSIGYNVMSKDNFPLFDIIIFIKSAVIKTTYNHIYDTGPTIGINVMHDEHCTGQCPIEIPHKENWLTFSQERTSRWGCEEFGCLAINTGCVFGSCQDIIRPETKVYRKAIEESVLLTVCVTYPGNTFCTEINAIEPKITDELELQFKTVDTKTLPNLLAVQNHKLYSGQINDLGSFAQGCGNIQKTNLSVIGTGTAKFDYICHGASRKDIVVRRCYNNNYESCKLLKEEPSLIFSDNHETIEVANIRHLLGELQFKLMLGDLRYKSFAENPELEIEARCVGCPSCFSSYSCNFRISSSIDTVCAIDGPCTIFHNRLIISPTKQDYGIKMSCKEKPNPVEKFNICKRVYSVLFTTIDKNDKIEINTGDQTSFIQEKDDRCKTWLCRVRDEGISVIFEPIKAFFGSYFSIAFYVVIGIIALFIIIYIFLPMVFKLKDILKKNELLYLQEMKYK

SEQ ID NO: 1792 - protein, 1434 aa, Artificial Sequence
  derived and/or modified protein sequence (wt) from ANADV(EIV-18560Yak)__KT313754.1__GP
MFLILVLLIPFYITATPVTTRCFHGGQLIAESKSLTAISEFCLKDDVSTVKSEIIYLKNDTGIFAHSKVLRNWIIKDWKNCNPVPTAGGSINVIEVNADLSLSTKTYVCSRDCTITVDKEDAQIIFQTDKLNHFEVSGTTLSSGWFKTKASVTLDRTCEHIKVTCGKKTLQFHACFKHHMSCIRFFHNTILPGTMAVSICQNIELIIITSLTLIIFILMVILTKTYICYVLMPLFMPVAYLYGWAYNRSCKKCSCCGLAYHPFTNCGSHCVCGLKFEASDRMRIHRESGLCQGYKSLRVARLLCKSKGSSLIISILLSVLILSFVTPIEGTLTNYPESKKYSLEEIADVIEGFIAEKGIKEYIVLYTSIFGALLLLIALIITVSLNRITEYLTNLNVIYCHECSMYHSKKNIKYIGDFTNKCGFCTCGELEDQEGLNMHKVSKKCIYRYQLTWSKVIMTILVCLLIAQNTVLIVAANDDCWAKQSLEIECVGPLQQVDACEDKSSRSYNEEAKKLVGTSKVTELDAGQVNLLGQTIESAIIAIRKQRTYATMHFLESVFLGRHCDYYKVFEHNSGYSQAKWRLLAKTNHFDICSRHSTHHFCRCMSDGTKCENGNRDFAGEMNTTYHSKRDFFKHDFNLFCTLLENAFPGTTESLYYQLLSKRNTTGASKLLGKLITKFGNNNLFVGIWKFGQFLLSLPYVNNTELSALQSSKILESPEPLLRSASGRQESLSSATPGEASKECRNAKKISCISPRFGVPMENLTACGESPNYKIYKTPTRIYKSNNKGEIWCAGDVHCFQEFTPVLQEVVDKLKKMTCFLTEPEAEEDAFSIAIAMCKILDKGVCTINSERWNIIKCDSGLMYYTDQRDGQDTGNDFGEYCISHNCKTERFPINPSIISDCIWEYHSRKSRYISTLNLESLEEFKRAISEKLSHTLIVYQFKPTSNLPHMKPVYKYITAQGVENSDGIDSAFITASMPALSGTSIGYNVMSKDNFPLFDIIIFIKSAVIKTTYNHIYDTGPTIGINVMHDEHCTGQCPIEIPHKENWLTFSQERTSRWGCEEFGCLAINTGCVFGSCQDIIRPETKVYRKAIEESVLLTVCVTYPGNTFCTEINAIEPKITDELELQFKTVDTKTLPNLLAVQNHKLYSGQINDLGSFAQGCGNIQKTNLSVIGTGTAKFDYICHGASRKDIVVRRCYNNNYESCKLLKEEPSLIFSDNHETIEVANIRHLLGELQFKLMLGDLRYKSFAENPELEIEARCVGCPSCFSSYSCNFRISSSIDTVCAIDGPCTIFHNRLIISPTKQDYGIKMSCKEKPNPVEKFNICKRVYSVLFTTIDKNDKIEINTGDQTSFIQEKDDRCKTWLCRVRDEGISVIFEPIKAFFGSYFSIAFYVVIGIIALFIIIYIFLPMVFKLKDILKKNELLYLQEMKYK

SEQ ID NO: 1793 - protein, 1434 aa, Artificial Sequence
  derived and/or modified protein sequence (wt) from ANADV(EIV-18715Yak)__KT313757.1__GP
MFLILVLLIPFYITATPVTTRCFHGGQLIAESKSLTAISEFCLKDDVSTVKSEITYLKNDTGIFAHSKVLRNWIIKDWKNCNPVPTAGGSINVIEVNADLSLSTKTYVCSRDCTITVDKEDAQIIFQTDKLNHFEVSGTTLSSGWFKTKASVTLDRTCEHIKVTCGKKTLQFHACFKHHMSCIRFFHNTILPGTMAVSICQNIELIIITSLTLIIFILMVILTKTYICYVLMPLFMPVAYLYGWAYNRSCKKCPCCGLAYHPFTNCGSHCVCGLKFEASDRMRIHRESGLCQGYKSLRVARLLCKSKGSSLIISILLSVLILSFVTPIEGTLTNYPESKKYSLEEIADVIEGFIAEKGIKEYIVLYTSIFGALLLLIALIITVSLNRITEYLTNLNVIYCHECSMYHSKKNIKYIGDFTNKCGFCTCGELEDQEGLNMHKVSKKCIYRYQLTWSKVIMTILICLLIAQNTVLIVAANDDCWAKQSLEIECVGPLQQVDACEDKSSRSYNGEAKKLVGTSRVTELDAGQVNLLGQTIESAIIAIRKQRTYATMHFLESVFLGRHCDYYKVFEHNSGYSQAKWRLLAKTNHFDICSRHSTHHFCRCMSDGTKCENGNWDFAGEMNTTYHSKRDFFKHDFSLFCTLLENAFPGTTESLYYQLLSKRNTTGASKLLGKLITKFGNNNLFVGIWKFGQFLLSLPYVNNTELSALQSSKILESPEPLLRSASGRQESLSSATPGEASKECRNAKKISCISPRFGVPMENLTACGESPNYKIYKTPTRIYKSNNKGEIWCAGDVHCFQEFTPVLQEVVDKLKKMTCFLTEPEAEEDAFSIAIAMCKILDKGVCTINSERWNIIKCDSGLMYYTDQRDGQDTGNDFGEYCISHNCKTERFPINPSIISDCVWEYHSRKSRYISTLNLESLEEFKRAISEKLSHTLVVYQFKPTSNLPHMKPVYKYITAQGVENSDGIDSAFITASMPALSGTSIGYNVMSKDNFPLFDIIIFIKSAVIKTTYNHIYDTGPTIGINVMHDEHCTGQCPIEIPHKENWLTFSQERTSRWGCEEFGCLAINTGCVFGSCQDIIRPETKVYRKAIEESVLLTVCVTYPGNTFCTEINAIEPKITDELELQFKTVDTKTLPNLLAVQNHKLYSGQINDLGSFAQGCGNIQKTNLSVIGTGTAKFDYICHGASRKDIVVRRCYNNNYESCKLLKEEPSLIFSDNHETIEVANIRHLLGELQFKLMLGDLRYKSFAENPELEIEARCVGCPSCFSSYSCNFRISSSIDTVCAIDGPCTIFHSRLIISSTKQDYGIKMSCKEKPNPVEKFNICKRVYSVLFTTIDKNDKIEINTGDQTSFIQEKDDRCKTWLCRVRDEGISVIFEPIKAFFGSYFSIAFYVVIGIIALFIIIYIFLPMVFKLKDILKKNELLYLQEMKYK

SEQ ID NO: 1794 - protein, 1434 aa, Artificial Sequence
  derived and/or modified protein sequence (wt) from ANADV(EIV-23263Tyum)__KT313760.1__GP
MFLILVLLIPFYITATPVTTRCFHGGQLIAESKSLTAISEFCLKDDVSTVKSEITYLKNDTGIFAHSKVLRNWIIKDWKNCNPVPTAGGSINVIEVNADLSLSTKTYVCSRDCTITVDKEDAQIIFQTDKLNHFEVSGTTLSSGWFKTKASVTLDRTCEHIKVTCGKKTLQFHACFKHHMSCIRFFHNTILPGTMAVSICQNIELIIITSLTLIIFILMVILTKTYICYVLMPLFMPVAYLYGWAYNRSCKKCSCCGLAYHPFTNCGSHCVCGLKFEASDRMRIHRESGLCQGYKSLRVARLLCKSKGSSLIISILLSVLILSFVTPIEGTLTNYPESKKYSLEEIADVIEGFIAERGIKEYIVLYTSIFGALLLLIALIITVSLNRITEYLTNLNVIYCHECSMYHSKKNIKYIGDFTNKCGFCTCGELEDQEGLNMHKVSKKCIYRYQLTWSKVIMTILVCLLIAQNTVLIVAANDDCWAKQSLEIECVGPLQQVDACEDKSSRSYNGEARKLVGTSKVTELDAGQVNLLGQTIESAIIAIRKQRTYATMHFLESVFLGRHCDYYKVFEHNSGYSQAKWRLLAKTNHFDICSRHSTHHFCRCMSDGTKCENGNWDFAGEMNTTYHSKRDFFKHDFKLFCTLLENAFPGTTESLYYQLLSKRNTTGASKLLGKLITKFGNNNLFVGIWKFGQFLLSLPYVNNTELSALQSSKILESPEPLLRSASGRQESLSSATPGEASKECRNAKKISCISPRFGVPMENLTACGESPNYKIFKTPTRIYKSNNKGEIWCAGDVHCFQEFTPILQEVVDKLKKMTCFLTEPEAEEDAFSIAIAMCKILDKGVCTINSERWNIIKCDSGLMYYTDQRDGQDTGNDFGEYCISHNCKTERFPINPSIISDCIWEYHSRKSRYISTLNLESLEEFKRAISEKLSHTLVVYQFKPTSNLPHMKPVYKYITAQGVENSDGIDSAFITASMPALSGTSIGYNVMSKDNFPLFDIIIFIKSAVIKTTYNHIYDTGPTIGINVMHDEHCTGQCPIEIPHKENWLTFSQERTSRWGCEEFGCLAINTGCVFGSCQDIIRPETKVYRKAIEESVLLTVCVTYPGNTFCTEINAIEPKITDELELQFKTVDTKTLPNLLAVQNHKLYSGQINDLGSFAQGCGNIQKTNLSVIGTGTAKFDYICHGASRKDIVVRRCYNNNYESCKLLKEEPSLIFSDNHETIEVANIRHLLGELQFKLMLGDLRYKSFAENPELEIEARCVGCPSCFSSYSCNFRISSSIDTVCAIDGPCTIFHNRLIISSTKQDYGIKMSCKEKPNPVEKFNICKRVYSVLFTTIDKNDKIEINTGDQTSFIQEKDDRCKTWLCRVRDEGISVIFEPIKAFFGSYFSIAFYVVIGIIALFIIIYIFLPMGFKLKDILKKNELLYLQEMKYK

SEQ ID NO: 1795 - protein, 1434 aa, Artificial Sequence
  derived and/or modified protein sequence (wt) from BATV(804992)__FJ436801.1__GP
MLLLLVLLIPCCVSASPVITRCFHGGQLIAERKSQAAISEFCLKDDVSTIKSEIIYEKNDTGLFAHNKVLRNWIIKDWKNCNPVPTAGGSINVIEVNTDLSLTTKTYVCSRDCTITVDKEDAQIIFQTEKLNHFEVSGTTLSSGWFKTKASVTLDRTCEHIKVTCGKKTLQFHACFKHHMSCIRFFHGTILPGTMATSICQNIELIIIISLTLIIFILMVILTKTYICYLLMPLFMPIAYFYGWSYNKSCKKCPCCGLAYHPFTNCGSHCVCGLKFEASDRMRIHRESGLCQGYKSLRVARLLCKSKGSSLIISILLSMLILSFVTPIEGTLTNYPESRKYDLEEIADVLEGFVVEKGIKEYVVFYTSIFGALFLLMALIVIIALNRVTEYLTNINVLYCHECSMYHSKKNIKYIGDFTNKCGFCTCGELEDQEGLKIHKVSRKCIYKYQLTWSKVIMMILVCLLIAQNTILIVAASDDCWTKKSLEMECIGPLQQVDTCDDKTSRSYSGEAKKLVRASKISDLDAAQVGLLGSTIESAIASIRRQRTYSTMHLLESVFLGKHCDYYKVFEHNSGYSQAKWRLTAKTHHFDICSRHSTHHFCRCISDGTKCQNGDWDFAGEMNSIYQSKKDFFKHDFKLFCTLVENAFPGTTESLFYEMLSKKNTTGITKLLDKLTKKFGNNNMFVGIWKFGQYLMSLPYVNETSLSPIQLAKVLEVTDQHHRSVSGRQESLASATPGSKSSECDHAKKVSCISPRFGAPMEGLMACGNSPNYKIYKTPAKLYKSNNKGEVWCSGDVHCFQELTPASQESVDRIKQMTCFLTEPEVNDDVFSIAIAMCKVQDKGVCTINEDRWNIIKCDSGLIYYTDQREGQDTGNDFGEYCLSHSCRIERFPINPAIISDCLWEYHSRKSKYITSLDLESLEEFKRAISEKLSHTLVVYNFKPTANLPHIKPVYKYITVQGVENSDGVDSAYITASMPALSGTSIGYNIMSRDNFPLFDIIIFIKSAIIKATYNHIYDTGPTIGINVMHDEHCTGQCPTDIPHKENWITFAQERTSRWGCEEFGCLAVNTGCVFGSCQDIIRPETKVYRKAVEESVLLTVCITYPGKTFCTEINAIEPKITDELELQFKTVDTKTLPNILAVQNHKLYSGQINDLGSFSQGCGNIQKTNSSIIGTGTAKFDYVCHGASRKDIIVRRCYNNNYESCKLLKEEQSLMFADNHETIDVANVRHLLGDLQFKLMLGDLRYKSFAENPDLEIEAKCVGCPSCFTSYSCSFKIVSNIDTVCSIEGPCTTFHNRLMITSTKQDYGIKMSCKTKPGLTEEFQICKKTYTVLFATVEKNDKIEISTGDQTSFIQERDDRCKTWLCRVRDEGISVIFEPIRAFFGSYFSIAFYIVIGIIVLFLVIYIFLPMMFKLRDVLKRNEYLYLQEIKHK

SEQ ID NO: 1796 - protein, 1434 aa, Artificial Sequence
  derived and/or modified protein sequence (wt) from BATV(8627-11)__FJ436799.1__GP
MLLLLVLLIPCCVSASPVITRCFHGGQLIAERKSQAAISEFCLKDDVSTIKSEIIYEKNDTGLFAHNKVLRNWIIKDWKNCNPVPTAGGSINVIEVNTDLSLTTKTYVCSRDCTITVDKEDAQIIFQTEKLNHFEVSGTTLSSGWFKTKASVTLDRTCEHIKVTCGKKTLQFHACFKHHMSCIRFFHGTILPGTMATSICQNIELIIIISLTLIIFILMVILTKTYICYLLMPLFMPIAYFYGWSYNKSCKKCPCCGLAYHPFTNCGSHCVCGLKFEASDRMRIHRESGLCQGYKSLRVARLLCKSKGSSLIISILLSMLILSFVTPIEGTLTNYPESRKYDLEEIADVLEGFVVEKGIKEYVVFYTSIFGALFLLMALIVIIALNRVTEYLTNINVLYCHECSMYHSKKNIKYIGDFTNKCGFCTCGELEDQEGLKIHKVSRKCIYKYQLTWSKVIMMILVCLLIAQNTILIVAASDDCWTKRSLEMECIGPLQQVDTCDDKTSRSYSGEAKKLVRASKISDLDAAQVGLLGSTIESAIASIRRQRTYSTMHLLESVFLGKHCDYYKVFEHNSGYSQAKWRLTAKTHHFDICSRHSTHHFCRCISDGTKCQNGDWDFAGEMNSTYQSKKDFFEHDFKLFCTLVENAFPGTTESLFYEMLSKKNTTGITKLLDKLTKKFGNNNMFVGIWKFGQYLMSLPYVNETSLSPTQLAKVLEVTDQHHRSVSGRQESLASATPGSKSSECDHAKKVSCISPRFGVPMEGLMACGNSPNYKIYKTPAKLYKSNNKGEVWCSGNVHCFQELNPASQESVDRIKQMTCFLTEPEVNDDVFSIAIAMCKVQDKGVCTINKDRWNIIKCDSGLIYYTDQREGQDTGNDFGEYCLSHSCRIERFPINPAIISDCLWEYHSRKSKYITSLDLESLEEFKRAISEKLSHTLVVYNFKPTANLPHIKPVYEYITVQGVENSDGVDSAYITASMPALSGTSIGYNIMSRDNFPLFDIIIFIKSAIIKATYNHIYDTGPTIGINVMHDEHCTGQCPTDIPHKENWITFAQERTSRWGCEEFGCLAVNTGCVFGSCQDIIRPETKVYRKAVEESVLLTVCITYPGKTFCTEINAIEPKITDELELQFKTVDTKTLPNILAVQNHKLYSGQINDLGSFSQGCGNIQKTNSSIIGTGTAKFDYVCHGASRKDIIVRRCYNNNYESCKLLKEEQSLMFADNHETIDVANVRHLLGDLQFKLMLGDLRYKSFAENPDLEIEAKCVGCPSCFTSYSCSFKIVSNIDTVCSIEGPCTTFHNRLMITSTRQDYGIKMSCKTKPGLTEEFQICKKTYTVLFATVEKNDKIEISTGDQTSFIQERDDRCKTWLCRVRDEGISVIFEPIRAFFGSYFSIAFYIVIGIIVLFLVIYIFLPMMFKLRDVLKRNEYLYLQEIKHK

SEQ ID NO: 1797 - protein, 1434 aa, Artificial Sequence
  derived and/or modified protein sequence (wt) from BATV(Chittoor/IG-20217)__JX846599.1__GP
MLLLLVLLIPCCVSASPVITRCFHGGQLIAERKSQAAISEFCLKDDVSTIKSEIIYEKNDTGLFAHNKVLRNWIIKDWKNCNPVPTAGGSINVIEVNTDLSLTTKTYVCSRDCTITVDKEDAQIIFQTEKLNHFEVSGTTLSSGWFKTKASVTLDRTCEHIKVTCGKKTLQFHACFKHHMSCIRFFHGTILPGTMATSICQNIELIIIISLTLIIFILMIILTKTYICYLLMPLFMPIAYFYGWSYNKSCKKCPCCGLAYHPFTNCGSHCVCGLKFEASDRMRIHRESGLCQGYKSLRVARLLCKSKGSSLIISILLSMLILSFVTPIEGTLTNYPESRKYDLEEIADVLEGFVVEKGIKEYVVFYTSIFGALFLLMALIVIIALNRVTEYLTNINVLYCHECSMYHSKKNIKYIGDFTNKCGFCTCGELEDQEGLKIHKVSRKCIYKYQLTWSKVIMMILVCLLIAQNTILIVAASDDCWTKKSLEMECIGPLQQVDTCDDKTSRSYSGEAKKLVRASKISDLDAAQVGLLGSTIESAIASIRRQRTYSTMHLLESVFLGKHCDYYKVFEHNSGYSQAKWRLTAKTHHFDICSRHSTHHFCRCISDGTKCQNGDWDFAGEMNSTYQSKRDFFEHDFKLFCTLIENAFPGTTESLFYEMLSKKNTTGITKLLDKLTKKFGNNNMFVGIWKFGQYLISLPYVNETSLSPTQLAKVLEVTDQHHRSISGRQESLASATPGSKSSECDHAKKASCISPRFGVPMEGLMACGNSPNYKIYKTPAKLYKSNNKGEVWCSGNFHCFQELIPASQESVDRIKQMTCFLTEPEVNDDVFSIAIAMCKVQDKGVCTINKDRWNVIKCDSGLIYYTDQREGQDTGNDFGEYCLSHSCRIERFPINPAIISDCLWEYHSRKSKYITSLDLESLEEFKRAISEKLSHTLIVYNFKPTANLPHIKPVYKYITVQGVENSDGVDSAYITASMPALSGTSIGYNIMSRDNFPLFDIIIFIKSAIIKATYNHIYDTGPTIGINVMHDEHCTGQCPTDIPHKENWITFAQERTSRWGCEEFGCLAVNTGCVFGSCQDIIRPETKVYRKAVEESVLLTVCITYPGKTFCTEINAIEPKITDELELQFKTVDIKTLPNILAVQNHKLYSGQINDLGSFSQGCGNIQKTNSSIIGTGTAKFDYVCHGASRKDIIVRRCYNNNYESCKLLKEEQSLMFADNHETIDVANVRHLLGDLQFKLMLGDLRYKSFAENPDLEIEAKCVGCPSCFTSYSCSFKIVSNIDTVCSIEGPCTTFHNRLMITSTKQDYGIKMSCKTKPGLTEEFQICKKTYTVLFATVEKNDKIEISTGDQTSFIQERDDRCKTWLCRVRDEGISVIFEPIRAFFGSYFSIAFYIVIGIIVLFLVIYIFLPMMFKLRDVLKRNEYLYLQEIKHK

SEQ ID NO: 1798 - protein, 1434 aa, Artificial Sequence
  derived and/or modified protein sequence (wt) from BATV(41.3)__KM507322.1__GP
MLLFLILLIPCYASASPVVTRCFHGGQLIAESRSPTAVSEFCLKDDVSTIKSEIIYVKNDTGLFAHNKVLRNWIIKDWKNCNPVPTAGGSINVIEVNTDLSLSTKTYVCSRDCTITVDKEDAQIIFQTEKLNHFEVSGTTLSSGWFKTKASVTLDRTCEHIKVTCGKKTLQFHACFKHHMSCIRFFHSTILPGTMATSICQNIELIIIISLTLLIFILMAILTKTYICYLLMPLFMPIAYLYGWSYNRSCKKCSCCGLAYHPFTNCGSHCVCGLKFEASDRMRIHRESGLCQGYKSLRVARLLCKSKGSSLIISILLSMLILSFVTPIEGTLTNYPESRKYDLEEIADVLEGFITEKGIKEYVVFYTSIFGGLFLLLALIIIIALNRVTEYLTNINVFYCHECSMYHSKKNIKYIGDFTNKCGFCTCGELEDQEGLKIHKVSRKCIYKYQLTWSKIIMIILVCLLIAQNTILIVAASNDCWAKKSLEMECIGPLQQVESCDDKASRSYSGEAKKLVRASKISDLDAAQVGLLGSTIESAIASIRKQRTYPTMHLLESVFLAKHCDYYKSFEHNSGYSQAKWRLTAKTHHFDICSRHSTHHFCRCISDGTKCQNGDWDFAGEMNSTYQSKKDFFEHDFKLFCTLLENAFPGTTESFYYQMLQKKNTTGVVKLLDELTKKFGNNNMFVGIWKFGQYLMSLPYINETSLTPLQLSKILEASNQHHRSISGRQESLANAASGGKSKECDHAKKVSCISPRFGVPMEGLIACGSSPNYKIYKMPTKLYKSNNKGEVWCSGDVHCFQELNPASQESVDRIKQMTCFLTEPETNEDVFSIAISMCKVQDKGVCTINEERWNVIKCDSGLIYYTDQRDGQDTGNDFGEYCLSHNCRIERFPINPTIINDCLWEYHSRKSKYITSLDLESLEEFKRAISEKLSHTLIVYNFKPTANLPHIKPVYKYITVQGVENSDGVDSAYITASMPALSGTSIGYNIMSKDNFPLFDIIIFIKSAVIKATYNHIYDTGPTIGINVMHDEHCTGQCPTDIPHKENWITFSQERTSRWGCEEFGCLAVNTGCVFGSCQDIIRPETKVYRKAIEESVLLTVCITYPGKTFCTEINAIEPKITDELELQFKTVDTKTLPNILAVQNHKLYSGQINDLGSFSQGCGNIQKTNSSIIGTGTAKFDYVCHGASRKDIIVRRCYNNNYESCRLLKEEQSLMFADNHETIDVANVRHLLGDLQFKLMLGDLRYKSFAEDPDLEIEAKCVGCPSCFTSYSCNFRIVSNIDTVCSIEGPCTTFHNRLMITSTKQDYGIKMSCKGKPGSTEEFQICKKTYTVLFTTVEKNDKIEINTGDQTSFIQERDDRCKTWLCRVRDEGISVIFEPIRAFFGSYFSIAFYIVVGIIVLFLMIYIFLPMAFKLRDVLKRNEYLYLQEIKHK

SEQ ID NO: 1799 - protein, 1434 aa, Artificial Sequence
  derived and/or modified protein sequence (wt) from BATV(EIV-1217Astr)__KT313699.1__GP
MLLFLILLIPCYASASPVVTRCFHGGQLIAESRSPTAVSEFCLKDDVSTIKSEIIYVKNDTGLFAHNKVLRNWIIKDWKNCNPVPTAGGSINVIEVNTDLSLSTKTYVCSRDCTITVDKEDAQIIFQTEKLNHFEVSGTTLSSGWFKTKASVTLDRTCEHIKVTCGKKTLQFHACFKHHMSCIRFFHGTILPGTMATSICQNIELIIIISLTLLIFILMAILTKTYICYLLMPLFMPIAYLYGWSYNRSCKKCSCCGLAYHPFTNCGSHCVCGLKFEASDRMRIHRESGLCQGYKSLRVARLLCKSKGSSLIISILLSMLILSFVTPIEGTLTNYPESRKYDLEEIADVLEGFVTEKGIKEYVVFYTSIFGGLFLLLALIIIIALNRVTEYLTNINVFYCHECSMYHSKKNIKYIGDFTNKCGFCTCGELEDQEGLKIHKVSRKCIYKYQLTWSKIIMIILVCLLIAQNTILIVAASNDCWAKKSLEMECIGPLQQMESCDDKASRSYSGEAKKLVRASKISDLDAAQVGLLGSTIESAIASIRKQRTYPTMHLLESVFLAKHCDYYKSFEHNSGYSQAKWRLTAKTHHFDICSRHSTHHFCRCISDGTKCQNGDWDFAGEMNSTYQSKKDFFKHDFKLFCTLLENAFPGTTESFYYQMLQKKNTTGVVKLLDELTKKFGNNNMFVGIWKFGQYLMSLPYINETSLTPLQLSKILEASDQHHRSISGRQESLANAASGGKSKECDHAKKVSCISPRFGVPMEGLIACGGSPNYKIYKMPTKLYKSNNKGEVWCSGDVHCFQELNPALQESVDRIKQMTCFLTEPETNEDVFSIAISMCKVQDKGVCTINEERWNVIKCDSGLIYYTDQRDGQDTGNDFGEYCLSHNCRIERFPINPTIINDCLWEYHSRKSKYITSLDLESLEEFKRAISEKLSHTLIVYNFKPTANLPHIKPVYKYITVQGVENSDGVDSAYITASMPALSGTSIGYNIMSKDNFPLFDIIIFIKSAVIKATYNHIYDTGPTIGINVMHDEHCTGQCPTDIPHKENWITFSQERTSRWGCEEFGCLAVNTGCVFGSCQDIIRPETKVYRKAIEESVLLTVCITYPGKTFCTEINAIEPKITDELELQFKTVDTKTLPNILAVQNHKLYSGQINDLGSFSQGCGNIQKTNSSIIGTGTAKFDYVCHGASRKDIIVRRCYNNNYESCRLLKEEQSLMFADNHETIDVANVRHLLGDLQFKLMLGDLRYKSFAEDPDLEIEAKCVGCPSCFTSYSCNFRIVSNIDTVCSIEGPCTTFHNRLMITSTKQDYGIKMSCKGKPGSTEEFQICKKTYTVLFTTVEKNDKIEINTGDQTSFIQERDDRCKTWLCRVRDEGISVVFEPIRAFFGSYFSIAFYIVVGIIVLFLVIYIFLPMAFKLRDVLKRNEYLYLQEIKHK

SEQ ID NO: 1800 - protein, 1434 aa, Artificial Sequence
  derived and/or modified protein sequence (wt) from BATV(EIV-12497Bl)__KT313692.1__GP
MLLFLILLIPCYASASPVVTRCFHGGQLIAESRSPTAVSEFCLKDDVSTIKSEIIYVKNDTGLFAHNKVLRNWIIKDWKNCNPVPTAGGSINVIEVNTDLSLSTKTYVCSRDCTITVDKEDAQIIFQTEKLNHFEVSGTTLSSGWFKTKASVTLDRTCEHIKVTCGKKTLQFHACFKHHMSCIRFFHGTILPGTMATSICQNIELIIITSLTLLIFILMAILTKTYICYLLMPLFMPIAYLYGWSYNRSCKKCSCCGLAYHPFTNCGSHCVCGLKFEASDRMRIHRESGLCQGYKSLRVARLLCKSKGSSLIISILLSMLILSFVTPIEGTLTNYPESRKYDLEEIADVLEGFITEKGIKEYVVFYTSIFGGLFLLLALIIIIALNRVTEYLTNINVFYCHECSMYHSKKNIKYIGDFTNKCGFCTCGELEDQEGLKIHKVSRKCIYKYQLTWSKIIMIILVCLLIAQNTILIVAASNDCWAKKSLEMECIGPLQQVESCDDKASRSYSGEAKKLVRASKISDLDAAQAGLLGSTIESAIASIRKQRTYPTMHLLESVFLAKHCDYYKSFEHNSGYSQAKWRLTAKTHHFDICSRHSTHHFCRCISDGTKCQNGDWDFAGEMNSTYQSKKDFFEHDFKLFCTLLENAFPGTTESFYYQLLQKKNTTGVVKLLDELTKKFGNNNMFVGIWKFGQYLMSLPYINETSLTPLQLSKILEASDQHHRSISGRQESLASAASGGKSKECDHAKKVSCISPRFSVPMEGLIACGSSPNYKIYRMPTKLYKSNNKGEVWCSGDVHCFQELNPASQESVDRIKQMICFLTEPEVNEDVFSIAISMCKVQDKGVCTINEERWNVIKCDSGLIYYTDQRDGQDTGNDFGEYCLSHNCRIERFPINPTIINDCLWEYHSRKSKYITSLDLESLEEFKRAISEKLSHTLIVYNFKPTANLPHIKPVYKYITVQGVENSDGVDSAYITASMPALSGTSIGYNIMSRDNFPLFDIIIFIKSAVIKATYNHIYDTGPTIGINVMHDEHCTGQCPTDIPHKENWITFSQERTSRWGCEEFGCLAVNTGCVFGSCQDIIRPETKVYRKAVEESVLLTVCITYPGKTFCTEINAIEPKITDELELQFKTVDTKTLPNILAVQNHKLYSGQINDLGSFSQGCGNIQKTNSSIIGTGTAKFDYVCHGASRKDIIVRRCYNNNYESCRLLKEEQSLMFADNHETIDVANVRHLLGDLQFKLMLGDLRYKSFAEDPGLEIEAKCVGCPSCFTSYSCNFRIVSNIDTVCSIEGPCTTFHNRLMITSTKQDYGIKMSCKGKPGSTEEFQICKKTYTVLFTTIEKNDKIEINTGDQTSFVQERDDRCKTWLCRVRDEGISVIFEPIRAFFGSYFSIAFYIVVGIIVLFLVIYIFLPMAFKLRDVLKRNEYLYLQEIKHK

SEQ ID NO: 1801 - protein, 1434 aa, Artificial Sequence
  derived and/or modified protein sequence (wt) from BATV(EIV-12845Ms)__KT313690.1__GP
MLLFLILLIPCYASASPVVTRCFHGGQLIAENRSPTAVSEFCLKDDVSTIKSEIIYVKNDTGLFAHNKVLRNWIIKDWKNCNPVPTAGGSINVIEVNTDLSLSTKTYVCSRDCTITVDKEDAQIIFQTEKLNHFEVSGTTLSSGWFKTKASVTLDRTCEHIKVTCGKKTLQFHACFKHHMSCIRFFHSTILPGTMATSICQNIELIIIISLTLLIFILMAILTKTYICYLLMPLFMPIAYLYGWSYNRSCKKCSCCGLAYHPFTNCGSHCVCGLKFEASDRMRIHRESGLCQGYKSLRVARLLCKSKGSSLIISILLSMLILSFVTPIEGTLTNYPESRKYDLEEIADVLEGFITEKGIKEYVVFYTSIFGGLFLLLALIIIIALNRVTEYLTNINVFYCHECSMYHSKKNIKYIGDFTNKCGFCTCGELEDQEGLKIHKVSRKCIYKYQLTWSKIIMIILVCLLIAQNTILIVAASNDCWAKKSLEMECIGPLQQVESCDDKASRSYSGEAKKLVRASKISDLDAAQVGLLGSTIESAIASIRKQRTYPTMHLLESVFLAKHCDYYKSFEHNSGYSQAKWRLTAKTHHFDICSRHSTHHFCRCISDGTKCQNGDWDFAGEMNSTYQSKKDFFEHDFKLFCTLLENAFPGTTESFYYQMLQKKNTTGVVKLLDELTKKFGNNNMFVGIWKFGQYLMSLPYINETSLTPLQLSKILEASDQHHRSISGRQESLANAASGSKSKECDHAKKVSCISPRFGVPMEGLIACGSSPNYKIYKMPTKLYKSNNKGEVWCSGDVHCFQELNPASQESVDRIKQMTCFLTEPETNEDVFSIAISMCKVQDKGVCTINEERWNVIKCDSGLIYYTDQRDGQDTGNDFGEYCLSHNCRIERFPINPTIINDCLWEYHSRKSKYITSLDLESLEEFKRAISEKLSHTLIVYNFKPTANLPHIKPVYKYITVQGVENSDGVDSAYITASMPALSGTSIGYNIMSKDNFPLFDIIIFIKSAVIKATYNHIYDTGPTIGINVMHDEHCTGQCPTDIPHKENWITFSQERTSRWGCEEFGCLAVNTGCVFGSCQDIIRPETKVYRKAIEESVLLTVCITYPGKTFCTEINAIEPKITDELELQFKTVDTKTLPNILAVQNYKLYSGQINDLGSFSQGCGNIQKTNSSIIGTGTAKFDYVCHGASRKDIIVRRCYNNNYESCRLLKEEQSLMFADNHETIDVANVRHLLGDLQFKLMLGDLRYKSFAEDPDLEIEAKCVGCPSCFTSYSCNFRIVSNIDTVCSIEGPCTTFHNRLMITSTKQDYGIKMSCKGKPGSTEEFQICKKTYTVLFTTVEKNDKIEINTGDQTSFIQERDDRCKTWLCRVRDEGISVIFEPIRAFFGSYFSIAFYIVVGIIVLFLVIYIFLPMAFKLRDVLKRNEYLYLQEIKHK

SEQ ID NO: 1802 - protein, 1434 aa, Artificial Sequence
  derived and/or modified protein sequence (wt) from BATV(EIV-2077Astr)__KT313702.1__GP
MLLFLILLIPCYASASPVVTRCFHGGQLIAESRSPTAVSEFCLKDDVSTIKSEIIYVKNDTGLFAHNKVLRNWIIKDWKNCNPVPTAGGSINVIEVNTDLSLSTKTYVCSRDCTITVDKEDAQIIFQTEKLNHFEVSGTTLSSGWFKTKASVTLDRTCEHIKVTCGKKTLQFHACFKHHMSCIRFFHGTILPGTMATSICQNIELIIIISLTLLIFILMAILTKTYICYLLMPLFMPIAYLYGWSYNRSCKKCSCCGLAYHPFTNCGSHCVCGLKFEASDRMRIHRESGLCQGYKSLRVARLLCKSKGSSLIISILLSMLILSFVTPIEGTLTNYPESRKYDLEEIADVLEGFVTEKGIKEYVVFYTSIFGGLFLLLALIIIIALNRVTEYLTNINVFYCHECSMYHSKKNIKYIGDFTNKCGFCTCGELEDQEGLKIHKVSRKCIYKYQLTWSKIIMIILVCLLIAQNTILIVAASNDCWAKKSLEMECIGPLQQMESCDDKASRSYSGEAKKLVRASKISDLDAAQVGLLGSTIESAIASIRKQRTYPTMHLLESVFLAKHCDYYKSFEHNSGYSQAKWRLTAKTHHFDICSRHSTHHFCRCISDGTKCQNGDWDFAGEMNSTYQSKKDFFEHDFKLFCTLLENAFPGTTESFYYQMLQKKNTTGVVKLLDELTKKFGNNNMFVGIWKFGQYLMSLPYINETSLTPLQLSKILEASDQHHRSISGRQESLANAASGGKSKECDHAKKVSCISPRFGVPMEGLIACGGSPNYKIYKMPTKLYKSNNKGEVWCSGDVHCFQELNPALQESVDRIKQMTCFLTEPETNEDVFSIAISMCKVQDKGVCTINEERWNVIKCDSGLIYYTDQRDGQDTGNDFGEYCLSHNCRIERFPINPTIINDCLWEYHSRKSKYITSLDLESLEEFKRAISEKLSHTLIVYNFKPTANLPHIKPVYKYITVQGVENSDGVDSAYITASMPALSGTSIGYNIMSKDNFPLFDIIIFIKSAVIKATYNHIYDTGPTIGINVMHDEHCTGQCPTDIPHKENWITFSQERTSRWGCEEFGCLAVNTGCVFGSCQDIIRPETKVYRKAIEESVLLTVCITYPGKTFCTEINAIEPKITDELELQFKTVDTKTLPNILAVQNHKLYSGQINDLGSFSQGCGNIQKTNSSIIGTGTAKFDYVCHGASRKDIIVRRCYNNNYESCRLLKEEQSLMFADNHETIDVANVRHLLGDLQFKLMLGDLRYKSFAEDPDLEIEAKCVGCPSCFTSYSCNFRIVSNIDTVCSIEGPCTTFHNRLMITSTKQDYGIKMSCKGKPGSTEEFQICKKTYTVLFTTVEKNDKIEINTGDQTSFIQERDDRCKTWLCRVRDEGISVVFEPIRAFFGSYFSIAFYIVVGIIVLFLVIYIFLPMAFKLRDVLKRNEYLYLQEIKHK

SEQ ID NO: 1803 - protein, 1434 aa, Artificial Sequence
  derived and/or modified protein sequence (wt) from BATV(Italy-2009)__KC168047.1__GP
MLLFLILLIPCYASASPVVTRCFHGGQLIAESRSPTAVSEFCLKDDVSTIKSEIIYVKNDTGLFAHNKVLRNWIIKDWKNCNPVPTAGGSINVIEVNTDLSLSTKTYVCSRDCTITVDKEDAQIIFQTEKLNHFEVSGTTLSSGWFKTKASVTLDRTCEHIKVTCGKKTLQFHACFKHHMSCIRFFHSTILPGTMATSICQNIELIIIISLTLLIFILMAILTKTYICYLLMPLFMPIAYLYGWSYNRSCKKCSCCGLAYHPFTNCGSHCVCGLKFEASDRMRIHRESGLCQGYKSLRVARLLCKSKGSSLIISILLSMLILSFVTPIEGTLTNYPESRKYDLEEIADVLEGFITEKGIKEYVVFYTSIFGGLFLLLALIIIIALNRVTEYLTNINVFYCHECSMYHSKKNIKYIGDFTNKCGFCTCGELEDQEGLKIHKVSRKCIYKYQLTWSKIIMIILVCLLIAQNTILIVAASNDCWAKKSLEMECIGPLQRVESCDDKASRSYSGEAKKLVRASKISDLDAAQVGLLGSTIESAIASIRKQRTYPTMHLLESVFLAKHCDYYKSFEHNSGYSQAKWRLTAKTHHFDICSRHSTHHFCRCISDGTKCQNGDWDFAGEMNSTYQSKKDFFEHDFKLFCTLLENAFPGTTESFYYQMLQKKNTTGVVKLLDELTKKFGNNNMFVGIWKFGQYLMSLPYINETSLTPLQLSKILEASNQHHRSISGRQESLANAASGGKSKECDNAKKVSCISPRFGVPMEGLIACGSSPNYKIYKMPTKLYKSNNKGEVWCSGDVHCFQELNPASQESVDRIKQMTCFLTEPETNEDVFSIAISMCKVRDKGVCTINEERWNVIKCDSGLIYYTDQRDGQDTGNDFGEYCLSHNCRIERFPINPAIINDCLWEYHSRRSKYITSLDLESLEEFKRAISEKLSHTLIVYNFKPTANLPHIKPVYKYITVQGVENSDGVDSAYITASMPALSGTSIGYNIMSKDNFPLFDIIIFIKSAVIKATYNHIYDTGPTIGINVMHDEHCTGQCPTDIPHKENWITFSQERTSRWGCEEFGCLAVNTGCVFGSCQDIIRPETKVYRKAIEENVLLTVCITYPGKTFCTEINAIEPKITDELELQFKTVDTKTLPNILAVQNHKLYSGQINDLGSFSQGCGNIQKTNSSIIGTGTAKFDYVCHGASRKDIIVRRCYNNNYESCRLLKEEQSLMFADNHETIDVANVRHLLGDLQFKLMLGDLRYKSFAEDPDLEIEAKCVGCPSCFTSYSCNFRIVSNIDTVCSIEGPCTTFHNRLMITSTKQDYGIKMSCKGKPGSTEEFQICKKTYTVLFTTVEKNDKIEINTGDQTSFIQERDDRCKTWLCRVRDEGISVIFEPIRAFFGSYFSIAFYIVVGIIVLFLMIYIFLPMAFKLRDVLKRNEYLYLQEIKHK

SEQ ID NO: 1804 - protein, 1434 aa, Artificial Sequence
  derived and/or modified protein sequence (wt) from BATV(MM2222)__AB257763.1__GP
MLLLLVLLISCCVSASPVITRCFHGGQLIAERKSQTAISEFCLKDDVSTIKSEIIYEKNDTGLFAHNKVLRNWIIKDWKNCNPVPTAGGSINVIEVNTDLSLTTKTYVCSRDCTITVDKEDAQIVFQTEKLNHFEVSGTTLSSGWFKTKASVTLDRTCEHIKVTCGKKTLQFHACFKHHMSCIRFFHGTILPGTMATSICQNIELIIIISLTLIIFILMVILTKTYICYLLMPLFMPIAYFYGWSYNKSCKKCPCCGLAYHPFTNCGSHCVCGLKFEASDRMRIHRESGLCQGYKSLRVARLLCKSKGSSLIISILLSMLILSFVTPIEGTLTNYPESRKYNLEEIADVLEGFVVEKGIKEYVVFYTSIFGALFLLMALIVIIALNRVTEYLTNINVLYCHECSMYHSKKNIKYIGDFTNKCGFCTCGELEDQEGLKIHKVSRKCIYKYQLTWSKIIMMILVCLLIAQNTILIVAASDDCWTKKSLEMECIGPLQQVDTCEDKTSRSYSGEAKKLVRASKISDLDAAQVGLLGSTIESAIASIRRQRTYSTMHLLESVFLGKHCDYYKVFEHNSGYSQAKWRLTAKTHHFDICSRHSTHHFCRCISDGTKCQNGDWDFAGEMNSIYQSKRDFFKHDFKLFCTLIEDAFPGTTESLFYEMLSKKNTTGITKLLDKLTKKFGNNNMFVGIWKFGQYLMSLPYVNETSLSPTQLAKVLEVTDHHHRSISGRQESLASATSGSKSSECDHAKKVSCISPRFGVPMEGLIACGNSPNYKIYKTPAKLYKSNNKGEVWCSGDVHCFQELIPASQESVDRIKQMTCFLTEPEVNDDVFSIAISMCKVQDKGVCTINEDRWNVIKCDSGLIYYTDQREGQDTGNDFGEYCLSHSCRIERFPINPTIISDCLWEYHSRKSKYITSLDLESLEEFKRAISEKLSHTLIVYNFKPTANLPHIKPVYKYITVQGVENSDGVDSAYITASMPALSGTSIGYNIMSRDNFPLFDIIIFIKSAIIKATYNHIYDTGPTIGINVMHDEHCTGQCPTDIPHKENWITFAQERTSRWGCEEFGCLAVNTGCVFGSCQDIIRPETKVYRKAVEESVLLTVCITYPGKTFCTEINAIEPKITDELELQFKTVDTKTLPNILAVQNHKLYSGQINDLGSFSQGCGNIQKTNSSIIGTGTAKFDYVCHGASRKDIIVRRCYNNNYESCKLLKEEQSLMFADNHETIDVANVRHLLGDLQFKLMLGDLRYKSFAENPDLEIEAKCVGCPSCFTSYSCSFKIVSNIDTVCSIEGPCTTFHNRLMITSTKQDYGIKMSCKTKPGPIEEFQICKKTYTILFTTVEKNDKIEISTGDQTSFIQEKDDRCKTWLCRVRDEGISVIFEPIRAFFGSYFSIAFYIVIGIIVLFLVIYIFLPMMFKLRDVLKRNEYLYLQEIKHK

SEQ ID NO: 1805 - protein, 1434 aa, Artificial Sequence
  derived and/or modified protein sequence (wt) from BATV(MM2222)__AY772534.1__GP
MLLLLVLLISCCVSASPVITRCFHGGQLIAERKSQTAISEFCLKDDVSTIKSEIIYEKNDTGLFAHNKVLRNWIIKDWKNCNPVPTAGGSINVIEVNTDLSLTTKTYVCSRDCTITVDKEDAQIVFQTEKLNHFEVSGTTLSSGWFKTKASVTLDRTCEHIKVTCGKKTLQFHACFKHHMSCIRFFHGTILPGTMATSICQNIELIIIISLTLIIFILMVILTKTYICYLLMPLFMPIAYFYGWSYNKSCKKCPCCGLAYHPFTNCGSHCVCGLKFEASDRMRIHRESGLCQGYKSLRVARLLCKSKGSSLIISILLSMLILSFVTPIEGTLTNYPESRKYNLEEIADVLEGFVVEKGIKEYVVFYTSIFGALFLLMALIVIIALNRVTEYLTNINVLYCHECSMYHSKKNIKYIGDFTNKCGFCTCGELEDQEGLKIHKVSRKCIYKYQLTWSKIIMMILVCLLIAQNTILIVAASDDCWTKKSLEMECIGPLQQVDTCEDKTSRSYSGEAKKLVRASKISDLDAAQVGLLGSTIESAIASIRRQRTYSTMHLLESVFLGKHCDYYKVFEHNSGYSQAKWRLTAKTHHFDICSRHSTHHFCRCISDGTKCQNGDWDFAGEMNSIYQSKRDFFKHDFKLFCTLIEDAFPGTTESLFYEMLSKKNTTGITKLLDKLTKKFGNNNMFVGIWKFGQYLMSLPYVNETSLSPTQLAKVLEVTDHHHRSISGRQESLASATSGSKSSECDHAKKVSCISPRFGVPMEGLIACGNSPNYKIYKTPAKLYKSNNKGEVWCSGDVHCFQELIPASQESVDRIKQMTCFLTEPEVNDDVFSIAISMCKVQDKGVCTISEDRWNVIKCDSGLIYYTDQREGQDTGNDFGEYCLSHSCRIERFPINPTIISDCLWEYHSRKSKYITSLDLESLEEFKRAISEKLSHTLIVYNFKPTANLPHIKPVYKYITVQGVENSDGVDSAYITASMPALSGTSIGYNIMSRDNFPLFDIIIFIKSAIIKATYNHIYDTGPTIGINVMHDEHCTGQCPTDIPHKENWITFAQERTSRWGCEEFGCLAVNTGCVFGSCQDIIRPETKVYRKAVEESVLLTVCITYPGKTFCTEINAIEPKITDELELQFKTVDTKTLPNILAVQNHKLYSGQINDLGSFSQGCGNIQKTNSSIIGTGTAKFDYVCHGASRKDIIVRRCYNNNYESCKLLKEEQSLMFADNHETIDVANVRHLLGDLQFKLMLGDLRYKSFAENPDLEIEAKCVGCPSCFTSYSCSFKIVSNIDTVCSIEGPCTTFHNRLMITSTKQDYGIKMSCKTKPGPIEEFQICKKTYTILFTTVEKNDKIEISTGDQTSFIQEKDDRCKTWLCRVRDEGISVIFEPIRAFFGSYFSIAFYIVIGIIVLFLVIYIFLPMMFKLRDVLKRNEYLYLQEIKHK

SEQ ID NO: 1806 - protein, 1434 aa, Artificial Sequence
  derived and/or modified protein sequence (wt) from BATV(MM2222)__JX846596.1__GP
MLLLLVLLISCCVSASPVITRCFHGGQLIAERKSQTAISEFCLKDDVSTIKSEIIYEKNDTGLFAHNKVLRNWIIKDWKNCNPVPTAGGSINVIEVNTDLSLTTKTYVCSRDCTITVDKEDAQIVFQTEKLNHFEVSGTTLSSGWFKTKASVTLDRTCEHIKVTCGKKTLQFHACFKHHMSCIRFFHGTILPGTMATSICQNIELIIIISLTLIIFILMVILTKTYICYLLMPLFMPIAYFYGWSYNKSCKKCPCCGLAYHPFTNCGSHCVCGLKFEASDRMRIHRESGLCQGYKSLRVARLLCKSKGSSLIISILLSMLILSFVTPIEGTLTNYPESRKYNLEEIADVLEGFVVEKGIKEYVVFYTSIFGALFLLMALIVIIALNRVTEYLTNINVLYCHECSMYHSKKNIKYIGDFTNKCGFCTCGELEDQEGLKIHKVSRKCIYKYQLTWSKIIMMILVCLLIAQNTILIVAASDDCWTKKSLEMECIGPLQQVDTCEDKTSRSYSGEAKKLVRASKISDLDAAQVGLLGSTIESAIASIRRQRTYSTMHLLESVFLGKHCDYYKVFEHNSGYSQAKWRLTAKTHHFDICSRHSTHHFCRCISDGTKCQNGDWDFAGEMNSIYQSKRDFFKHDFKLFCTLIEDAFPGTTESLFYEMLSKKNTTGITELLDKLTKKFGNNNMFVGIWKFGQYLMSLPYVNETSLSPTQLAKVLEVTDHHHRSISGRQESLASATSGSKSSECDHAKKVSCISPRFGVPMEGLIACGNSPNYKIYKTPAKLYKSNNKGEVWCSGDVHCFQELIPASQESVDRIKQMTCFLTEPEVNDDVFSIAISMCKVQDKGVCTINEDRWNVIKCDSGLIYYTDQREGQDTGNDFGEYCLSHSCRIERFPINPTIISDCLWEYHSRKSKYITSLDLESLEEFKRAISEKLSHTLIVYNFKPTANLPHIKPVYKYITVQGVENSDGVDSAYITASMPALSGTSIGYNIMSRDNFPLFDIIIFIKSAIIKATYNHIYDTGPTIGINVMHDEHCTGQCPTDIPHKENWITFAQERTSRWGCEEFGCLAVNTGCVFGSCQDIIRPETKVYRKAVEESVLLTVCITYPGKTFCTEINAIEPKITDELELQFKTVDTKTLPNILAVQNHKLYSGQINDLGSFSQGCGNIQKTNSSIIGTGTAKFDYVCHGASRKDIIVRRCYNNNYESCKLLKEEQSLMFADNHETIDVANVRHLLGDLQFKLMLGDLRYKSFAENPDLEIEAKCVGCPSCFTSYSCSFKIVSNIDTVCSIEGPCTTFHNRLMITSTKQDYGIKMSCKTKPGPIEEFQICKKTYTILFTTVEKNDKIEISTGDQTSFIQEKDDRCKTWLCRVRDEGISVIFEPIRAFFGSYFSIAFYIVIGIIVLFLVIYIFLPMMFKLRDVLKRNEYLYLQEIKHK

SEQ ID NO: 1807 - protein, 1434 aa, Artificial Sequence
  derived and/or modified protein sequence (wt) from BATV(MS50)__JX846605.1__GP
MKMLTLIIIVSCWVATLQNPLISRCFHGGQLIAEKKSLTSISEFCIKDDVSMLKSEVIYQKNDTGIYGHSKVFRHWTIADWKYCNPVPTAGGSINVIELDKNLNLIAKNYVCTRDCTITVDKENAQIVFQTDKLNHFEVTGTTISTGWFKTKASVALDRTCEHIKVSCGKKTLQFHACFKQHMSCVRFLHRSMLPGSMANSICQNIELIIIITLTLVIFILMLIATRFYICYLLIPVFMPIAYAYGWAYNRSCKKCSCCGLAYHPFTNCGSYCVCGARFETSDRMRLHRESGLCQGFKSLRMARRLCKSKGSSLVISILLATLILSFVTPIEGTMTNYPTNEKYSLDEIADVLKWKEQESEYKYYAILYASIIGACFTVLFAGTALALNIVLELLTKINVIYCEECSMYHSKSNIKYIGDFTNKCGFCTCGLLEDPDGVVVHKVKRSCTYQYKLTWVKTIMIVLSILFLLQNIIVIVAADSDCWTNEELKPECVGPLIAPADCTEKDKKTYLTEAAALVKTKKISQVDADNVEILGKTIESAIKAIEKQKTYHRMHLLEAVFLNKHCDYYKLFEHNSGYSQVKWRMLAKTQHFDICAFAKESKFCKCMAGGACAEDSWDFDTTMNSTYTSKGDNFKHDMSLFLKIFEAAFPGTSYVYMLNKIKEKKPYQSVTMIDKIKTKYPNNKMLVAYLEFGKCLMGVGHASTFELQQSQLERLYQPAELSRSVGQLTSLSNAQVGTITKECSKYKDISCLSPRFGIPMENMVACGDSPNYKIYKKPIKVYKAHDRVETWCIKDQHCLVDYTPAEADVVKKLKTMKCWLNDPGTETDAYTTAIKSCRIMDKGVCTVNGQKWSIIKCDSDLLYYTDHIEGEDTGNDIGHYCISVGCKTDRYPINPDIVTDCTWEFKSRKSSYIGKISMQSLEDYKKALTDKLTHTLETYSFAPTADLPHIKPIYKYITAQGVENSDGIEGAYITATIPALGGTSIGYSVQSKDGFPLLDLIIYIKAAVIRSTYIHLYDTGPTISINTKHDEKCTGQCPAEIEHEANWLTFSQERTSRWGCEEFGCLAINTGCVFGSCQDVIRPETKVYRKSVEEEVVLTVCINYPGNTFCTEINAIEPKITEEVELQFKTVDTKTLPTLLAVTNHKLFSGQINDLGTFGQMCGNVQKTNSSILGSGTPKFDYTCHGASRKDIIVRKCYNNNYDSCKLLKEEKQLVFNDDHETITVVNNRHLVGELAIKLILGDIQYKLFTEKLDLQIDAKCVGCPDCFESYACNFQIVSNIDTVCAINGPCDIFHNRISIRSTQQNYGVKMSCKRTPDQNEKFVICGREYSVFFHTVQKNDKIEINTGDQTSYIKEMDTRCKTWLCRVRDEGLSVIFEPIKAFFGSYFSIAFYIVLFIIIAFLVIYIFMPMFMKLRDILKQNEKLYLQEIKQK

SEQ ID NO: 1808 - protein, 1434 aa, Artificial Sequence
  derived and/or modified protein sequence (wt) from BATV(NM/12)__KJ187039.1__GP
MLLLLVLLIPCCVSASPAITRCFHGGQLIAERKSQTAISEFCLKDDVSTIKSEIIYEKNDTGLFAHNKVLRNWIIKDWKNCNPVPTAGGSINVIEVNTDLSLTTKTYVCSRDCTITVDKEDAQIIFRTEKLNHFEVSGTTLSSGWFKTKASVTLDRTCEHIKVTCGKKTLQFHACFKHHMSCIRFFHGTILPGTMATSICQNIELIIIISLTLIIFILMVILTRTYICYLLMPLFMPIAYFYGWSYNKSCKKCQCCGLAYHPFTNCGSHCVCGLKFEASDRMRIHRESGLCQGYKSLRVARLLCKSKGSSLIISILLSMLILSFVTPIEGTLTNYPESRKYDLEEIADVLEGFVVEKGIKEYVVFYTSIFGALFLLMALIIIIALNRVTEYLTNINVFYCHECSMYHSKKNIKYIGDFTNKCGFCTCGELEDQEGLKIHKVSRKCIYKYQLTWSKIIMMILVCLLIAQNTILIVAASDDCWTKRSLEMGCIGPLQQVDTCDDKTSRSYSGEAKKLVRASKISDLDAAQVGLLGSTIESAIASIRKQRTYSTMHLLESVFLGKHCDYYKVFEHNSGYSQAKWRLTAKTHHFDICSRHSTHHFCRCISDGTKCQNGDWDFASEMNSTYQSKRDFFEHDFKQFCTLIENAFPGTTESLFYEMLSKKNTTGITKLLDKLTKKFGNNNMFVGIWKFGQYLMSLPYVNETSLSPTQLAKVLEVTDHHHRSISGRQESLASAAPGSKSSECDHARRVSCISPRFGVPIEGLTACGSSPNYKIYKTPAKLYKSNNKGEVWCSGDVHCLQELIPAPQESVDRIKQMTCFLTEPGVNDDIFSIAISMCKVQDKGVCTINEDRWNVVKCDRGLIYYTDQREGQDTGNDFGKYCLSHSCRIERFPINPAIINDCLWEYHSRKSKYITSLDLESLEEFKRAISEKLSHTLIVHNFKPTANLPHIKPVYKYITVQGVENSDGVDSAYITASMPALSGTSIGYNIMSRDNFPLFDIIIFIKSAIIKATYNHIYDTGPTIGINVIHDEHCTGQCPTDIPHKENWITFAQERTSRWGCEEFGCLAINTGCVFGSCQDIIRPETKVYRKAVEESVLLTVCITYPGKTFCTEINAIEPKITDELELQFKTVDTKTLPNILAVQNHKLYSGQINDLGSFSQGCGNIQKTNSSIIGTGTAKFDYVCHGASRKDIIVRRCYNNNYESCKLLKEEQSLMFADNHETIDVANVRHLLGDLQFKLMLGDLRYKSFAENPDLEIEAKCVGCPSCFTSYSCSFKIVSNIDTVCSIEGPCTIFHSRLMITSTKQDYGIKMSCKTKPGPTEEFQICKKTYTILFTTIEKNDKIEISTGDQTSFIQERDDRCRTWLCRVRDEGIGVIFEPIRAFFGSYFSIAFYIVIGIIILFLVIYIFLPMVFKLRDVLKRNEYLYLQEIKHK

SEQ ID NO: 1809 - protein, 1434 aa, Artificial Sequence
  derived and/or modified protein sequence (wt) from BATV(ON-1/E/94)__AB257764.1__GP
MLLFLVLLISCYVSASPVITRCFHGGQLIAERKSQTAISEFCLKDDVSTIKSEIIYEKNDTGLFAHSKVLRNWIIKDWKNCNPVPTAGGSINVIEVNADLSLATKTYVCSRDCTITVDKEDAQIVFQTEKLNHFEVSGTTLSSGWFKTKASVTLDRTCEHIKVTCGKKTLQFHACFKHHMSCIRFFHGTILPGTMATSICQNIELIIIISLTLIIFILMVILTKTYICYLLMPLFMPIAYFYGWSYNKSCKKCSCCGLAYHPFTNCGSHCVCGLKFEASDRMRIHRESGLCQGYKSLRVARLLCKSKGSSLIISILLSMLILSFVTPIEGTLTNYPESRKYDLEEIADVLEGFVVEKGIKEYVVFYTSIFGALFLLMALIVIIALNRVTEYLTNINVLYCHECSMYHSKKNIKYIGDFTNKCGFCTCGELEDQEGLKIHKVSRKCIYKYQLTWSKIIMIILVCLLIAQNTILIVAASDDCWTKKSLEMECVGPLQQVDTCEDKTSRSYSGEAKKLVRASKISDLDAAQVGLLGSTIESAIASIRKQRTYSTMHLLESVFLGKHCDYYKVFEHNSGYSQAKWRLTAKTHHFDICSRHSTHHFCRCISDGTKCQNGDWDFAGEMNSTYQSKRDFFEHDFKLFCTLIENAFPGTTESLFYEMLSKKNTTGITKLLDKLTKKFGNNNMFVGIWKFGQYLMSLPYVNETSLSPTQLAKVLEVTDHLHRSISGRQELLTSATPGSKSSECDHAKKVSCISPRFGVPMEGLIACGNSPSYKIYKTPTKLYKSNNKGEVWCSGDVHCFQELIPASQESVDRIKQMTCFLTEPEVSDDVFSIAISMCKVQDKGVCTINEDRWNVIKCDSGLIYYTDQREGQDTGNDLGEYCLSHSCRIERFPINPIIISDCLWEYHSRKSKYITSLDLESLEEFKRAISEKLSHTLIVYNFKPTANLPHIKPVYKYITVQGVENSDGVDSAYITASMPALSGTSIGYNIMSRDNFPLFDIIIFIKSAIIKATYNHIYDTGPTIGINVMHDEHCTGQCPTDIPHKENWITFAQERTSRWGCEEFGCLAVNTGCVFGSCQDIIRPETKVYRKAVEESVLLTVCITYPGKTFCTEINAIEPKITDELELQFKTVDTKTLPNILAVQNHKLYSGQINDLGSFSQGCGNIQKTNSSIIGTGTAKFDYVCHGASRKDIVVRRCYNNNYESCKLLKEEQSLMFADNHETIDVANVRHLLGDLQFKLMLGDLRYKSFAENPDLEIEAKCVGCPSCFTSYSCSFKIVSNIDTVCSIEGPCTTFHNRLMITSTKQDYGIKMSCKTKPGPTEEFQICKKTYTILFTTVEKNDKIEISTGDQTSFIQEKDDRCKTWLCRVRDEGISVIFEPIRAFFGSYFSIAFYIVIGIIVLFLVIYIFLPMIFKLRDVLKRNEYLYLQEIKHK

SEQ ID NO: 1810 - protein, 1434 aa, Artificial Sequence
  derived and/or modified protein sequence (wt) from BATV(ON-7/B/01)__AB257765.1__GP
MLLLLVLLIPCCVSASPVITRCFHGGQLIAERKSQAAISEFCLKDDVSTIKSEIIYEKNDTGLFAHNKVLRNWIIKDWKNCNPVPTAGGSINVIEVNTDLSLTTKTYVCSRDCTITVDKEDAQIIFQTEKLNHFEVSGTTLSSGWFKTKASVTLDRTCEHIKVTCGKKTLQFHACFKHHMSCIRFFHGTILPGTMATSICQNIELIIIISLTLIIFILMVILTKTYICYLLMPLFMPIAYFYGWSYNKSCKKCPCCGLAYHPFTNCGSHCVCGLKFEASDRMRIHRESGLCQGYKSLRVARLLCKSKGSSLIISILLSMLILSFVTPIEGTLTNYPESRKYDLEEIADVLEGFIVEKGIKEYVVFYTSIFGALFLLIALIVIIALNRVTEYLTNINVLYCHECSMYHSKKNIKYIGDFTNKCGFCTCGELEDQEGLKIHKVSRKCIYKYQLTWSKVIMMILVCLLIAQNTILIVAASDDCWTKKSLEMGCIGPLQQVDTCDDKASRSYSGEAKKLVRASKISDLDAAQVGQLGSTIESAIASIRRQRTYSTMHLLESVFLGKHCDYYKVFEHNSGYSQAKWRLTAKTHHFDICSRHSTHHFCRCISDGTKCQNGDWDFAGEMNSTYQSKRDFFEHDFNLFCTLIENAFPGTTESLFYEMLSKKNTTGITKLLDKLTKKFGNNNMFVGIWKFGQYLISLPYVNETSLSPTQLAKVLVVTDQHHRSISGRQESLASATPGSKSSECGHAKKVSCISPRFGVPMEGLMACGSSPNYKIYKTPAKLYKSNNKGEVWCSGDVHCFQDLIPASQESVDRIKQMTCFLTEPEVNDDVFSIAIAMCKVQDKGVCTINEDRWNLIKCDSGLIYYTDQREGQDTGNDFGEYCLSHNCKMERFPINPAIISDCLWEYHSRKSKYITSLDLESLEEFKRAISEKLSHTLVVYNFKPTANLPHIKPVYKYITVQGVENSDGVDSAYITASMPALSGTSIGYNIMSRDNFPLFDIIIFIKSAIIKATYNHIYDTGPTIGINVMHDEHCTGQCPTDIPHKENWITFAQERTSRWGCEEFGCLAVNTGCVFGSCQDIIRPETKVYRKAVEESVLLTVCITYPGKTFCTEINAIEPKITDELELQFKTVDTKTLPNILAVQNHKLYSGQINDLGSFSQGCGNIQKTNLSIIGTGTAKFDYVCHGASRKDIIVRRCYNNNYESCKLLKEEQSLMFADNHETIDVANVRHLLGDLQFKLMLGDLRYKSFAENPDLEIEAKCVGCPSCFTSYSCNFKIVSNIDTVCSIEGPCTTFHNRLMITSAKQDYGIKMSCKTKPGLTEEFQICKKTYTVLFATVEKNDEIEISTGDQTSFIQERDDRCKTWLCRVRDEGISVIFEPIRAFFGSYFSIAFYIVIGIIVLFLVIYIFLPMVFKLRDVLKRNEYLYLQEIKHK

SEQ ID NO: 1811 - protein, 1434 aa, Artificial Sequence
  derived and/or modified protein sequence (wt) from BATV(UgMP-6830)__DQ436460.1__GP
MLLLLVLLIPCYVSASPVVTRCFHGGQLIAEKKSQTAVSEFCLKDDVSTIKSEITYEKNNTGLFAHNKVLRNWIIKDWKNCNPVPTAGGSINVIEVNTDLSLTTKTYVCSRDCTITVDKEDAQIIFQTEKLNHFEVSGTTLSSGWFKTKASVTLDRTCEHIKVTCGKKTLQFHACFKHHMSCIRFFHGTILPGTMATSICQNIELIIIISLTLIIFILMVILTKTYICYLLMPLFMPIAYFYGWSYNKSCKKCSCCGLAYHPFTNCGSHCVCGLKFEASDRMRIHRESGLCQGYKSLRVARLLCKSKGSSLIISILLSMLILSFVTPIEGTLTNYPESRKYDLEEIADVLEGFIVEKGIKEYVVFYTSIFGALFLLMALVIIIALNKVTEYLTNINVLYCHECSMYHSKKNIKYIGDFTNKCGFCTCGELEDQEGLKIHKVSRKCIYKYQLTWSKIIMMILVCLLIAQNTILIVAASDDCWTKKSLEMECIGPLQQVDTCDDKSSRSYSGEAKKLVRASKISDLNAAQVGLLGSTIESAIASIRKQRTYSTMHLLESVFLGKHCDYYKAFEHNSGYSQAKWRLTAKTHHFDICSRHSTHHFCRCISDGTKCQNGDWDFAGEMNSTYQSKKDFFEHDLKLFCTLVENAFPGTTESLFYEMLSKKNTTGVKKLLDKLTKKFGNNNMFVGIWKFGQYLMSLPYVNETSLTPAQLAKILEVTDQHHRSISGRQESLASATPGSKSKECGHAKKVSCISPRFGVPMEGLLACGDSPNYKIYKTPAKLYKSNNKGEVWCSGDVHCSQELSPASQESVDRIKQITCFLTEPEVSDDVFSIAISTCKVQDKGVCTVNEDRWNVIKCDSGLIYYTDQRDGQDTGNDFGEYCLSHSCRIERFPINPAIISDCLWEYHSRKSKYITSLDLESLEEFKRAISEKLSHTLIVYNFKPTANLPHIKPIYKYITVQGVENSDGVDSAYITASMPALSGTSIGYNIMSRDNFPLFDIIIFIKSAIIKATYNHIYDTGPTIGINVMHDEHCTGQCPTDIPHKENWITFAQERTSRWGCEEFGCLAVNTGCVFGSCQDIIRPETKVYRKAVEESVLLTVCITYPGKTFCTEINAIEPKITDELELQFKTVDTKTLPNILAVQNHKLYSGQINDLGSFSQGCGNIQKTNSSIIGTGTAKFDYVCHGASRKDIIVRRCYNNNYESCKLLKEEQSLMFADNHETIDVANVRHLLGDLQFKLMLGDLRYKSFAENPDLEIEAKCVGCPSCFTSYSCSFKIVSNIDTVCSIEGPCTTFHNRLMITSTKQDYGIKMSCKTKPEETEEFQICKKTYTVLFTTVEKNDKIEISTGDQTSFIQERDDRCKTWLCRVRDEGISVIFEPIRAFFGSYFSIAFYVVVSIIVLFLAIYIFLPMVFKLRDVLKKNEYLYLQEIKHK

SEQ ID NO: 1812 - protein, 1434 aa, Artificial Sequence
  derived and/or modified protein sequence (wt) from BATV(ZJ2014)__KU746870.1__GP
MLVLLVLLIPCCVSASPAITRCFHGGQLIAERKSQTAISEFCLKDDVSTIKSEIIYEKNDTGLFAHNKVLRNWIIKDWKNCNPVPTAGGSINVIEVNTDLSLTTKTYVCSRDCTITVDKEDAQIIFQTEKLNHFEVSGTTLSSGWFKTKASVTLDRTCEHIKVTCGKKTLQFHACFKHHMSCIRFFHGTILPGTMATSICQNIELIIIISLTLIIFILMVILTRTYICYLLMPLFMPIAYFYGWSYNKSCKKCQCCGLAYHPFTNCGSHCVCGLKFEASDRMRIHRESGLCQGYKSLRVARLLCKSKGSSLIISILLSMLILSFVTPIEGTLTNYPESRKYDLEEIADVLEGFVVEKGIKEYVVFYTSIFGALFLLMALIVIIALNRVTEYLTNINVFYCHECSMYHSKKNIKYIGDFTNKCGFCTCGELEDQEGLKIHKVSRKCIYKYQLTWSKIIMMILVCLLIAQNTILIVAASDDCWTKKSLEMGCIGPLQQVDTCDDKTSRSYSGEAKKLVRASKISDLDAAQVGLLGSTIESAIASIRKQRTYSTMHLLESVFLGKYCDYYKVFEHNSGYSQAKWRLTAKTHHFDICSRHSTHHFCRCISDGTKCQNGDWDFASEMNSTYQSKRDFFEHDFKVFCTLIENAFPGTTESLFYEMLSKKNTTGITKLLDKLTKKFGNNNMFVGIWKFGQYLMSLPYVNETSLSPTQLAKVLEVTDHHHRSISGRQESLASAAPGSKSSECDHAKKVSCISPRFGVPIEGLTACGSSPNYKIYKTPAKLYKSNSKGEVWCSGDVHCLQELIPASQESVDRIKQMTCFLTEPGVNDDIFSIAISMCKVQDKGVCTINEDRWNVVKCDSGLIYYTDQREGQDTGNDFGEYCLSHSCRIKRFPINPAIINDCLWEYHSRKSKYITSLDLESLEEFKRAISEKLSHTLIVYNFKPTANLPHIKPVYKYITVQGVENSDGVDSAYITASMPALSGTSIGYNIMSRDNFPLFDIIIFIKSAIIKATYNHIYDTGPTIGINVIHDEHCTGQCPTDIPHKENWITFAQERTSRWGCEEFGCLAINTGCVFGSCQDIIRPETKVYRKAVEESVLLTVCITYPGKTFCTEINAIEPKITDELELQFKTVDTKTLPNILAVQNHKLYSGQINDLGSFSQGCGNIQKTNSSIIGTGTAKFDYVCHGASRKDIIVRRCYNNNYESCKLLKEEQSLMFADNHETIDVANVRHLLGDLQFKLMLGDLRYKSFAENPDLEIEAKCVGCPSCFTSYSCSFKIVSNIDTVCSIDGPCTIFHNRLMITSTKQDYGIKMSCKTKPGPTEEFQICKKTYTILFTTIEKNDKIEISTGDQTSFIQERDDRCRTWLCRVRDEGISVIFEPIRAFFGSYFSIAFYIVIGIIILFLVIYIFLPMVFKLRDVLKRNEYLYLQEIKHK

SEQ ID NO: 1813 - protein, 1434 aa, Artificial Sequence
  derived and/or modified protein sequence (wt) from CVV__AF082576.1__GP
MLFLLILAFLGFSTSNPIATRCFHGGQLIAESKSATSISEFCLKDDVSMLKSEVVYIKNDTGLFGHNKVFRSWTIKDWKLCNPIPTAGGTINVIEVNKDLSLMTKTYICSRDCTITIDKEEAQIIFQTDKLNHFEVSGTTLSSGWFKSKASVTLDRTCEHVKVTCGKKSLQFHACFKHHMSCVRFFHNTILPGNMITSMCQNIELIIILGLTLAIFILMVMLTKTYICYLLMPIFMPIAYLYGWAYNKSCKKCNCCGLAYHPFTNCGSHCVCGLKFEASDRMRIHRESGLCQGYKSLRIARLLCKSKGSSLVISGLLSMLILSFVTPIEGTITSYPESRKYTLEEITDVVEGLVSEQNIKEYIVFYTSLFGSLILLLAFIMSITLSKITSILAKRNVIYCEECSMYHSKRGIKYNGDFTNKCGFCTCNEQEDTEGLVIHKVSKRCTYKYQLKWAKVLMITLVLLLIAQNTILIVAAETDCWTKKSLDIDCIGPMLDIGSCTNKNTRSYDAEAQKLVSQSKISQLDADQASLLGNSIDSAIKAIRAQKTYPTMHLLETIFLMKNCDYYTSFNHNSGYSQAKWRLIAKTGHFDICSRHSTHHFCQCINDGTKCQNGDWDFAGEMNETYNSKNDFYSHDLNLFYTIFENAFPGTTESLFYQLIQKKNTTGASKVLGKLITKYGNNNMFVGIWKFGQYLLTLPYINNTELSQNRRLTILATQELLSRSHSGRQESMSNAIQGSITKECHNAKGVGCISPQFGIPIGNLTACGDSPNYKIYKTPEKLYKSNNKGEVWCSNDVHCLNDFEPADEEVVNKIKKLTCFLTDVSVEVDIFSVAASTCKMADKGVCTVNGAKWNIIKCDSGLYYFTDHREGQDTGNDFGEYCISHSCNTERFPINPDTLKDCTWEFHSRKSKYISTISLESLEEFRRAMAEKLSHTLTIYNFKPTANLPHIRPTYKFITANGVENSDGIESAYILSSIPALGGISVGYNVQTKDNFPLLDIIVFIKSAVIRTTYNHIYDTGPTIGINTQHDEHCTGPCPAVVPHKENWMTFSQERTSRWGCEEFGCLAINTGCVFGSCQDIIHPETKVYRKAVEEEVVLTVCINFPGNNYCTEINAIEPKITDEIELQFKTVDTKTLPNLLAVQNHKLYSGQINDLGSFSQGCGNVQKTNHSILGMGTVKFDYVCHGASRKDVIVRRCYNNNFDSCKLLKEETSLIFADNHETLEVAHTKHLIGELQFKIMLGDIRYKSFAESPELEIDAKCVGCPSCFESYSCNFQIVSNIDTVCSVEGPCTLFHNRIIISANKQSYGLKMSCQTKPNQNEEFIICNRKYSVLFTTIDKNDKIEVNTGDQTSYIYEKDSRCKTWLCRVRDEGISVLFEPLKAFFGSYFSIIFYVVVGIIVLFLIIYIFLPMFFKLKDVLKRNEYLYLQELKHK

SEQ ID NO: 1814 - protein, 1434 aa, Artificial Sequence
  derived and/or modified protein sequence (wt) from CVV(Montgomery County/VA/2015 4b)__KX583998.1__GP
MLFLLILAFLGFSTSNPIATRCFHGGQLIAESKSATSISEFCLKDDVSMLKSEVVYTKNDTGLFGHNKVFRSWTIKDWKLCNPIPTAGGTINVIEVNKDLSLMTKTYICSRDCTITIDKEEAQIIFQTDKLNHFEVSGTTLNSGWFKSKASVTLDRTCEHVKVTCGKKSLQFHACFKHHMSCVRFFHNTILPGNMINSMCQNIELIIILGLTLAIFILMVMLTKTYICYLLMPIFMPIAYLYGWAYNKSCKKCNCCGLAYHPFTNCGSHCVCGLKFEASDRMRIHRESGLCQGYKSLRIARLLCKSKGSSLVISGLLSMLILSFVTPIEGTITSYPESRKYTLEEITDVVEGLVSEQNIKEYIVFYTSLFGSLILLLAFIMSITLSKITSILARRNVIYCEECSMYHSKRGIKYNGDFTNKCGFCTCNEQEDAEGLVIHKVSKRCTYKYQLKWAKVLMVTLVLLLIAQNTILIVAAGTDCWAKKSLDMDCIGPMLDIGSCTNKNTRNYDTEAQKLVSQSKVSQLDADQASLLGNSIDSAIKAIRAQKTYPTMHLLETIFLMKNCDYYTSFNHNSGYSQAKWRLIAKTGHFDICSRHSTHHFCRCINDGTKCQNGDWDFAGEMNETYNSKNDFYSHDLNLFYTIFENAFPGTTESLFYQLIQKKNTTGASKILGKLITKYGNNNMFVGVWKFGQYLLTLPYINNTELSQNRRQTILATQESLSRSHSGRQESMSSAIQGSVTKECHNAKDVGCISPRFGIPIGNLTACGDSPNYKIYKTPEKLYKSNNKGEVWCSNDVHCLNDFEPADEEVVNKVKKLTCFLTDVSVKTDIFSVAVSTCKMADKGTCTVKDAKWNIIKCDSGLYYFTDHREGQDTGNDFGEYCISHSCNTERFPINPDILKDCTWEFHSRKSKYISTISLESLEEFRRAMTEKLSHTLTIYNFKPTANLPHIRPTYKFITANGVENSDGIESAYILSSIPALGGISVGYNVQTKDNFPLLDIIVFIKSAVIRTTYNHIYDTGPTIGINTQHDEHCTGPCPAVVPHKENWITFSQERTSRWGCEEFGCLAINTGCVFGSCQDIIHPETKVYRKAVEEEVVLTVCINFPGNNYCTEINAVEPKITDEIELQFKTVDTKTLPNLLAVQNRKLYSGQINDLGSFSQGCGNVQKTNHSILGMGTAKFDYVCHGASRKDVIVRRCYNNNFDSCRLLKEETSLIFADNHETLEVAHTKHLIGELQFKIMLGDIRYKSFAESPELEIDAKCVGCPSCFESYSCNFQIVTNIDTVCSVEGPCTLFHNRIIISANKQSYGLKMSCQTKPNQNEEFIICNRKYSVLFTTIDKNDKIEVNTGDQTSYIYEKDSRCKTWLCRVRDEGISVLFEPLKAFFGSYFSIIFYVVVGIIVLFLIIYIFLPMFFKLKDVLKRNEYLYLQELKHK

SEQ ID NO: 1815 - protein, 1434 aa, Artificial Sequence
  derived and/or modified protein sequence (wt) from CVV(Montgomery County/VA/2015 K)__KX583999.1__GP
MLFLLILAFLGFSTSNPIATRCFHGGQLIAESKSATSISEFCLKDDVSMLKSEVVYTKNDTGLFGHNKVFRSWTIKDWKLCNPIPTAGGTINVIEVNKDLSLMTKTYICSRDCTITIDKEEAQIIFQTDKLNHFEVSGTTLNSGWFKSKASVTLDRTCEHVKVTCGKKSLQFHACFKHHMSCVRFFHNTILPGNMINSMCQNIELIIILGLTLAIFILMVMLTKTYICYLLMPIFMPIAYLYGWAYNKSCKKCNCCGLAYHPFTNCGSHCVCGLKFEASDRMRIHRESGLCQGYKSLRIARLLCKSKGSSLVISGLLSMLILSFVTPIEGTITSYPESRKYTLEEITDVVEGLVSEQNIKEYIVFYTSLFGSLILLLAFIMSITLSKITSILARRNVIYCEECSMYHSKRGIKYNGDFTNKCGFCTCNEQEDAEGLVIHKVSKRCTYKYQLKWAKVLMVTLVLLLIAQNTILIVAAGTDCWAKKSLDMDCIGPMLDIGSCTNKNTRNYDTEAQKLVSQSKVSQLDADQASLLGNSIDSAIKAIRAQKTYPTMHLLETIFLMKNCDYYTSFNHNSGYSQAKWRLIAKTGHFDICSRHSTHHFCRCINDGTKCQNGDWDFAGEMNETYNSKNDFYSHDLNLFYTIFENAFPGTTESLFYQLIQKKNTTGASKILGKLITKYGNNNMFVGVWKFGQYLLTLPYINNTELSQNRRQTILATQESLSRSHSGRQESMSSAIQGSVTKECHNAKDVGCISPRFGIPIGNLTACGDSPNYKIYKTPEKLYKSNNKGEVWCSNDVHCLNDFEPADEEVVNKVKKLTCFLTDVSVKTDIFSVAASTCKMADKGTCTVNDAKWNIIKCDSGLYYFTDHREGQDTGNDFGEYCISHSCNTERFPINPDILKDCTWEFHSRKSKYISTISLESLEEFRRAMTEKLSHTLTIYNFKPTANLPHIRPTYKFITANGVENSDGIESAYILSSIPALGGISVGYNVQTKDNFPLLDIIVFIKSAVIRTTYNHIYDTGPTIGINTQHDEHCTGPCPAVVPHKENWITFSQERTSRWGCEEFGCLAINTGCVFGSCQDIIHPETKVYRKAVEEEVVLTVCINFPGNNYCTEINAVEPKITDEIELQFKTVDTKTLPNLLAVQNHKLYSGQINDLGSFSQGCGNVQKTNHSILGMGTAKFDYVCHGASRKDVIVRRCYNNNFDSCRLLKEETSLIFADNHETLEVAHTKHLIGELQFKIMLGDIRYKSFAESPELEIDAKCVGCPSCFESYSCNFQIVTNIDTVCSVEGPCTLFHNRIIISANKQSYGLKMSCQTKPNQNEEFIICNRKYSVLFTTIDKNDKIEVNTGDQTSYIYEKDSRCKTWLCRVRDEGISVLFEPLKAFFGSYFSIIFYVVVGIIVLFLIIYIFLPMFFKLKDVLKRNEYLYLQELKHK

SEQ ID NO: 1816 - protein, 1434 aa, Artificial Sequence
  derived and/or modified protein sequence (wt) from CVV(1156)__EU583730.1__GP
MLFLLILAFLGFSTSNPIATRCFHGGQLIAESKSATSISEFCLKDDVSMLKSEVVYIKNDTGLFGHNKVFRSWTIKDWKLCNPIPTAGGTINVIEVNKDLSLMTKTYICSRDCTITIDKEEAQIIFQTDKLNHFEVSGTTLSSGWFKSKASVTLDRTCEHVKVTCGKKSLQFHACFKHHMSCVRFFHNTILPGNMITSMCQNIELIIILGLTLAIFILMVILTKTYICYLLMPIFMPIAYLYGWAYNKSCKKCNCCGLAYHPFTNCGSHCVCGLKFEASDRMRIHRESGLCQGYKSLRIARLLCKSKGSSLVISGLLSMLILSFVTPIEGTITSYPESRKYTLEEITDVVEGLVSEQNIKEYIVFYTSLFGSLILLLAFIMSITLSKITSILAKRNVIYCEECSMYHSKRGIKYNGDFTNKCGFCTCNEQEDTEGLVIHKISKRCTYKYQLKWAKVLMITLVLLLIAQNTILIVAAETDCWTKKSLDIDCIGPMLDIGSCTNKNTRSYDAEAQKLVSQSKISQLDADQVSLLGNSIDSAIKAIRAQKTYPTMHLLETIFLMKNCDYYTSFNHNSGYSQAKWRLIAKTGHFDICSRHSTHHFCRCINDGTKCQNGDWDFAGEMNETYNSKNDFYSHDLNLFYTIFENAFPGTTESLFYQLIQKKNTTGASKVLGKLITKYGNNNMFVGVWKFGQYLLTLPYINNTELSQNRRLTILTTQELLSRSHSGRQESMSNAIQGSITKECHNAKGVGCISPRFGIPIGNLTACGDSPNYKIYKTPEKLYKSNNKGEVWCSNDVHCLNDFEPADEEVVNKIKKLTCFLTDVSVEVDIFSVAASTCKMADKGVCTVNGAKWNIIKCDSGLYYFTDHREGQDTGNDFGEYCISHSCNTERFPINPDILKDCTWEFHSRKSKYISTISLESLEEFRRAMAEKLSHTLTIYNFKPTANLPHIRPTYKFITANGVENSDGIESAYILSSIPALGGISVGYNVQTKDNFPLLDIIVFIKSAVIRTTYNHIYDTGPTIGINTQHDEHCTGPCPAVVPHKENWMTFSQERTSRWGCEEFGCLAINTGCVFGSCQDIIHPETKVYRKAVEEEVVLTVCINFPGNNYCTEINAIEPKITDEIELQFKTVDTKTLPNLLAVQNHKLYSGQINDLGSFSQGCGNVQKTNHSILGMGTVKFDYVCHGASRKDVIVRRCYNNNFDSCKLLKEETSLIFADNHETLEVAHTKHLIGELQFKIMLGDIRYKSFAESPELEIDAKCVGCPSCFESYSCNFQIVTNIDTVCSVEGPCTLFHNRIIISANKQSYGLKMSCQTKPNQNEEFIICNRKYSVLFTTIDKNDKIEVNTGDQTSYIYEKDSRCKTWLCRVRDEGISVLFEPLKAFFGSYFSIIFYVVIGIIVLFLIIYIFLPMFFKLKDVLKRNEYLYLQELKHK

SEQ ID NO: 1817 - protein, 1434 aa, Artificial Sequence
  derived and/or modified protein sequence (wt) from CVV(6V633)__KX100134.1__GP
MLFLLILAFLGFSTSNPIATRCFHGGQLIAESKSATSISEFCLKDDVSMLKSEVVYIKNDTGLFGHNKVFRSWTIKDWKLCNPIPTAGGTINVIEVNKDLSLMTKTYICSRDCTITIDKEEAQIIFQTDKLNHFEVSGTTLSSGWFKSKASVTLDRTCEHVKVTCGKKSLQFHACFKHHMSCVRFFHNTILPGNMITSMCQNIELIIILGLTLAIFILMVMLTKTYICYLLMPIFMPIAYLYGWAYNKSCKKCNCCGLAYHPFTNCGSHCVCGLKFEASDRMRIHRESGLCQGYKSLRIARLLCKSKGSSLVISGLLSMLILSFVTPIEGTITSYPESRKYTLEEITDVVEGLVSEQNIKEYIVFYTSLFGSLILLLAFIMSITLSKITSILAKRNVIYCEECSMYHSKRGIKYNGDFTNKCGFCTCNEQEDTEGLVIHKVSKRCTYKYQLKWAKVLMITLVLLLIAQNTILIVAAETDCWTKKSLDIDCIGPMLDIGSCTNKNTRSYDAEAQKLVSQSKISQLDADQASLLGNSIDSAIKAIRAQKTYPTMHLLETIFLMKNCDYYTSFNHNSGYSQAKWRLIAKTGHFDICSRHSTHHFCRCINDGTKCQNGDWDFAGEMNETYNSKNDFYSHDLNLFYTIFENAFPGTTESLFYQLIQKKNTTGASKVLGKLITKYGNNNMFVGIWKFGQYLLTLPYINNTELSQNRRLTILATQELLSRSHSGRQESMSNAIQGSITKECHNAKGVGCISPRFGIPIGNLTACGDSPNYKIYKTPEKLYKSNNKGEVWCSNDVHCLNDFEPADEEVVNKIKKLTCFLTDVSVEVDIFSVAASTCKMADKGVCTVNGAKWNIIKCDSGLYYFTDHREGQDTGNDFGEYCISHSCNTERFPINPDTLKDCTWEFHSRKSKYISTISLESLEEFRRAMAEKLSHTLTIYNFKPTANLPHIRPTYKFITANGVENSDGIESAYILSSIPALGGISVGYNVQTKDNFPLLDIIVFIKSAVIRTTYNHIYDTGPTIGINTQHDEHCTGPCPAVVPHKENWMTFSQERTSRWGCEEFGCLAINTGCVFGSCQDIIHPETKVYRKAVEEEVVLTVCINFPGNNYCTEINAIEPKITDEIELQFKTVDTKTLPNLLAVQNHKLYSGQINDLGSFSQGCGNVQKTNHSILGMGTVKFDYVCHGASRKDVIVRRCYNNNFDSCKLLKEETSLIFADNHETLEVAHTKHLIGELQFKIMLGDIRYKSFAESPELEIDAKCVGCPSCFESYSCNFQIVTNIDTVCSVEGPCTLFHNRIIISANKQSYGLKMSCQTKPNQNEEFIICNRKYSVLFTTIDKNDKIEVNTGDQTSYIYEKDSRCKTWLCRVRDEGISVLFEPLKAFFGSYFSIIFYVVVGIIVLFLIIYIFLPMFFKLKDVLKRNEYLYLQELKHK

SEQ ID NO: 1818 - protein, 1434 aa, Artificial Sequence
  derived and/or modified protein sequence (wt) from CVV(807270)__AF186243.1__GP
MLFLLILAFLGFSTSNPIATRCFHGGQLIAESKSATSISEFCLKDDVSMLKSEVVYIKNDTGLFGHNKVFRSWTIKDWKLCNPIPTAGGTINVIEVNKDLSLMTKTYICSRDCTITIDKEEAQIIFQTDKLNHFEVSGTTLSSGWFKSKASVTLDRTCEHVKVTCGKKSLQFHACFKHHMSCVRFFHNTILPGNMITSMCQNIELIIILGLTLAIFILMVILTKTYICYLLMPIFMPIAYLYGWAYNKSCKKCNCCGLAYHPFTNCGSHCVCGLKFEASDRMRIHRESGLCQGYKSLRIARLLCKSKGSSLVISGLLSMLILSFVTPIEGTITSYPESRKYTLEEITDVVEGLVSEQNIKEYIVFYTSLFGSLILLLAFIMSITLSKITSILAKRNVIYCEECSMYHSKRGIKYNGDFTNKCGFCTCNEQEDTEGLVIHKVSKRCTYKYQLKWAKVLMITLVLLLIAQNTILIVAAETDCWTKKSLDIDCIGPMLDIGSCTNKNTRSYDAEAQKLVSQSKISQLDADQVSLLGNSIDSAIKAIRAQKTYPTMHLLETIFLMKNCDYYTSFNHNSGYSQAKWRLIAKTGHFDICSRHSTHHFCQCINDGTKCQNGDWDFAGEMNETYNSKNDFYSHDLNLFYTIFENAFPGTTESLFYQLIQKKNTTGASKVLGKLITKYGNNNMFVGVWKFGQYLLTLPYINNTELSQNRRLTILATQELLSRSHSGRQESMSNAIQGSITKECHNAKGVGCISPRFGIPIGNLTACGDSPNYKIYKTPEKLYKSNNKGEVWCSNDVHCLNDFEPADEEVVNKIKKLTCFLTDVSVEVDIFSVAASTCKMADKGVCTVNGAKWNIIKCDSGLYYFTDHREGQDTGNDFGEYCISHSCNTERFPINPDILKDCTWEFHSRKSKYISTISLESLEEFRRAMAEKLSHTLTIYNFKPTANLPHIRPTYKFITANGVENSDGIESAYILSSIPALGGISVGYNVQTKDNFPLLDIIVFIKSAVIRTTYNHIYDTGPTIGINTQHDEHCTGPCPAVVPHKENWMTFSQERTSRWGCEEFGCLAINTGCVFGSCQDIIHPETKVYRKAVEEEVVLTVCINFPGNNYCTEINAIEPKITDEIELQFKTVDTKTLPNLLAVQNHKLYSGQINDLGSFSQGCGNVQKTNHSILGMGTVKFDYVCHGASRKDVIVRRCYNNNFDSCKLLKEETSLIFADNHETLEVAHTKHLIGELQFKIMLGDIRYKSFAESPELEIDAKCVGCPSCFESYSCNFQIVTNIDTVCSVEGPCTLFHNRIIISANKQSYGLKMSCQTKPNQNEEFIICNRKYSVLFTTIDKNDKIEVNTGDQTSYIYEKDSRCKTWLCRVRDEGISVLFEPLKAFFGSYFSIIFYVVVGIIVLFLIIYIFLPMFFKLKDVLKRNEYLYLQELKHK

SEQ ID NO: 1819 - protein, 1434 aa, Artificial Sequence
  derived and/or modified protein sequence (wt) from CVV(856 clone 1)__EU583732.1__GP
MLFLLILAFLGFSTSNPIATRCFHGGQLIAESKSATSISEFCLKDDVSMLKSEVVYIKNDTGLFGHNKVFRSWTIKDWKLCNPIPTAGGTINVIEVNKDLSLMTKTYICSRDCTITIDKEEAQIIFQTDKLNHFEVSGTTLSSGWFKSKASVTLDRTCEHVKVTCGKKSLQFHACFKHHMSCVRFFHNTILPGNMIASMCQNIELIIILGLTLAIFILMVILTKTYICYLLMPIFMPIAYLYGWAYNKSCKKCNCCGLAYHPFTNCGSHCVCGLKFEASDRMRIHRESGLCQGYKSLRIARLLCKSKGSSLVISGLLSMLILSFVTPIEGTITSYPESRKYTLEEITDVVEGLVSEQNIKEYIVFYTSLFGSLILLLAFIMSITLSKITSILAKRNVIYCEECSMYHSKRGIKYNGDFTNKCGFCTCNEQEDTEGLVIHKVSKRCTYKYQLKWAKVLMITLVLLLIAQNTILIVAAETDCWIKKSLDIDCIGPMLDIGSCTNKNTRSYDAEAQKLVSQSKISQLDADQVSLLGNSIDSAIKAIRAQKTYPTMHLLETIFLMKNCDYYTSFNHNSGYSQAKWRLIAKTGHFDICSRHSTHHFCRCINDGTKCQNGDWDFAGEMNETYNSKNDFYSHDLNLFYTIFENAFPGTTESLFYQLIQRKNTTGASKVLGKLITKYGNNNMFVGVWKFGQYLLTLPYINNTELSQNRRLTILTTQELLSRSHSGRQESMSNAIQGSITKECHNAKGVGCISPRFGIPIGNLTACGDSPNYKIYKTPEKLYKSNNKGEVWCSNDVHCLNDFEPADEEVVNKIKKLTCFLTDVSVEVDIFSVAASTCKMADKGVCTVNGAKWNIIKCDSGLYYFTDHREGQDTGNDFGEYCISHSCNTERFPINPDILKDCTWEFHSRKSKYISTISLESLEEFRRAMAEKLSHTLTIYNFKPTANLPHIRPTYKFITANGVENSDGIESAYILSSIPALGGISVGYNVQTKDNFPLLDIIVFIKSAVIRTTYNHIYDTGPTIGINTQHDEHCTGPCPAVVPHKENWMTFSQERTSRWGCEEFGCLAINTGCVFGSCQDIIHPETKVYRKAVEEEVVLTVCINFPGNNYCTEINAIEPKITDEIELQFKTVDTKTLPNLLAVQNHKLYSGQINDLGSFSQGCGNVQKTNHSILGMGTVKFDYVCHGASRKDVIVRRCYNNNFDSCKLLKEETSLIFADNHETLEVAHTKHLIGELQFKIMLGDIRYKSFAESPELEIDAKCVGCPSCFESYSCNFQIVTNIDTVCSVEGPCTLFHNRIIISANKQSYGLKMSCQTKPNQNEEFIICNRKYSVLFTTIDKNDKIEVNTGDQTSYIYEKDSRCKTWLCRVRDEGISVLFEPLKAFFGSYFSIIFYVVIGIIVLFLIIYIFLPMFFKLKDVLKRNEYLYLQELKHK

SEQ ID NO: 1820 - protein, 1434 aa, Artificial Sequence
  derived and/or modified protein sequence (wt) from CVV(856 clone 3)__EU583731.1__GP
MLFLLILAFLGFSTSNPIATRCFHGGQLIAESKSATSISEFCLKDDVSMLKSEVVYIKNDTGLFGHNKVFRSWTIKDWKLCNPIPTAGGTINVIEVNKDLSLMTKTYICSRDCTITIDKEEAQIIFQTDKLNHFEVSGTTLSSGWFKSKASVTLDRTCEHVKVTCGKKSLQFHACFKHHMSCVRFFHNTILPGNMIASMCQNIELIIILGLTLAIFILMVILTKTYICYLLMPIFMPIAYLYGWAYNKSCKKCNCCGLAYHPFTNCGSHCVCGLKFEASDRMRIHRESGLCQGYKSLRIARLLCKSKGSSLVISGLLSMLILSFVTPIEGTITSYPESRKYTLEEITDVVEGLVSEQNIKEYIVFYTSLFGSLILLLAFIMSITLSKITSILAKRNVIYCEECSMYHSKRGIKYNGDFTNKCGFCTCNEQEDTEGLVIHKVSKRCTYKYQLKWAKVLMITLVLLLIAQNTILIVAAETDCWIKKSLDIDCIGPMLDIGSCTNKNTRSYDAEAQKLVSQSKISQLDADQVSLLGNSIDSAIKAIRAQKTYPTMHLLETIFLMKNCDYYTSFNHNSGYSQAKWRLIAKTGHFDICSRHSTHHFCRCINDGTKCQNGDWDFAGEMNETYNSKNDFYSHDLNLFYTIFENAFPGTTESLFYQLIQRKNTTGASKVLGKLITKYGNNNMFVGVWKFGQYLLTLPYINNTELSQNRRLTILTTHELLSRSHSGRQESMSNAIQGSITKECHNAKGVGCISPRFGIPIGNLTACGDSPNYKIYKTPEKLYKSNNKGEVWCSNDVHCLNDFEPADEEVVNKIKKLTCFLTDVSVEVDIFSVAASTCKMADKGVCTVNGAKWNIIKCDSGLYYFTDHREGQDTGNDFGEYCISHSCNTERFPINPDILKDCTWEFHSRKSKYISTISLESLEEFRRAMAEKLSHTLTIYNFKPTANLPHIRPTYKFITANGVENSDGIESAYILSSIPALGGISVGYNVQTKDNFPLLDIIVFIKSAVIRTTYNHIYDTGPTIGINTQHDEHCTGPCPAVVPHKENWMTFSQERTSRWGCEEFGCLAINTGCVFGSCQDIIHPETKVYRKAVEEEVVLTVCINFPGNNYCTEINAIEPKITDEIELQFKTVDTKTLPNLLAVQNHKLYSGQINDLGSFSQGCGNVQKTNHSILGMGTVKFDYVCHGASRKDVIVRRCYNNNFDSCKLLKEETSLIFADNHETLEVAHTKHLIGELQFKIMLGDIRYKSFAESPELEIDAKCVGCPSCFESYSCNFQIVTNIDTVCSVEGPCTLFHNRIIISANKQSYGLKMSCQTKPNQNEEFIICNRKYSVLFTTIDKNDKIEVNTGDQTSYIYEKDSRCKTWLCRVRDEGISVLFEPLKAFFGSYFSIIFYVVIGIIVLFLIIYIFLPMFFKLKDVLKRNEYLYLQELKHK

SEQ ID NO: 1821 - protein, 1434 aa, Artificial Sequence
  derived and/or modified protein sequence (wt) from CVV(CK102)__AF186242.1__GP
MLFLLILAFLGFSTSNPIATRCFHGGQLIAESKSATSISEFCLKDDVSMLKSEVVYIKNDTGLFGHNKVFRSWTIKDWKLCNPIPTAGGTINVIEVNKDLSLMTKTYICSRDCTITIDKEEAQIIFQTDKLNHFEVSGTTLSSGWFKSKASVTLDRTCEHVKVTCGKKSLQFHACFKHHMSCVRFFHNTILPGNMITSMCQNIELIIILGLTLAIFILMVILTKTYICYLLMPIFMPIAYLYGWAYNKSCKKCNCCGLAYHPFTNCGSHCVCGLKFEASDRMRIHRESGLCQGYKSLRIARLLCKSKGSSLVVSGLLSMLILSFVTPIEGTITSYPESRKYTLEEITDVVEGLVSEQNIKEYIVFYTSLFGSLILLLAFIMSITLSKITSILAKRNVIYCEECSMYHSKRGIKYNGDFTNKCGFCTCNEQEDTEGLVIHKVSKRCTYKYQLKWAKVLMITLVLLLIAQNTILIVAAETDCWTKKSLDIDCIGPMLDIGSCTNKNTRSYDTEAQKLVSQSKISQLDADQVSLLGNSIDSAIKAIRAQKTYPTMHLLETIFLMKNCDYYTSFNHNSGYSQAKWRLIAKTGHFDICSRHSTHHFCRCINDGTKCQNGDWDFAGEMNETYNSKNDFYSHDLNLFYTIFENAFPGTTESLFYQLIQKKNTTGASKVLGKLITKYGNNNMFVGVWKFGQYLLTLPYINNTELSQNRRLTILATQELLSRSHSGRQESMSNAIQGSITKECHNAKGVGCISPRFGIPIGNLTACGDSPNYKIYKTPEKLYKSNNKGEVWCSNDVHCLNDFEPADEEVVNKIKKLTCFLTDVSVEVDIFSVAASTCKMADKGVCTVNGAKWNIIKCDSGLYYFTDHREGQDTGNDFGEYCISHSCNTERFPINPDILKDCTWEFHSRKSKYISTISLESLEEFRRAMAEKLSHTLTIYNFKPTANLPHIRPTYKFITANGVENSDGIESAYILSSIPALGGISVGYNVQTKDNLPLLDIIVFIKSAVIRTTYNHIYDTGPTIGINTQHDEHCTGPCPAVVPHKENWMTFSQERTSRWGCEEFGCLAINTGCVFGSCQDIIHPETKVYRKAVEEEVVLTVCINFPGNNYCTEINAIEPKITDEIELQFKTVDTKTLPNLLAVQNHKLYSGQINDLGSFSQGCGNVQKTNHSILGMGTVKFDYVCHGASRKDVIVRRCYNNNFDSCKLLKEETSLIFADNHETLEVAHTKHLIGELQFKIMLGDIRYKSFAESPELEIDAKCVGCPSCFESYSCNFQIVTNIDTVCSVEGPCTLFHNRIIISANKQSYGLKMSCQTKPNQNEEFIICNRKYSVLFTTIDKNDKIEVNTGDQTSYIYEKDSRCKTWLCRVRDEGISVLFEPLKAFSGSYFSIIFYVVVGIIVLFLIIYIFLPMFFKLKDVLKRNEYLYLQELKHK

SEQ ID NO: 1822 - protein, 1434 aa, Artificial Sequence
  derived and/or modified protein sequence (wt) from CVV(CK-102)__KX100146.1__GP
MLFLLILAFLGFSTSNPIATRCFHGGQLIAESKSATSISEFCLKDDVSMLKSEVVYIKNDTGLFGHNKVFRSWTIKDWKLCNPIPTAGGTINVIEVNKDLSLMTKTYICSRDCTITIDKEEAQIIFQTDKLNHFEVSGTTLSSGWFKSKASVTLDRTCEHVKVTCGKKSLQFHACFKHHMSCVRFFHNTILPGNMITSMCQNIELIIILGLTLAIFILMVILTKTYICYLLMPIFMPIAYLYGWAYNKSCKKCNCCGLAYHPFTNCGSHCVCGLKFEASDRMRIHRESGLCQGYKSLRIARLLCKSKGSSLVVSGLLSMLILSFVTPIEGTITSYPESRKYTLEEITDVVEGLVSEQNIKEYIVFYTSLFGSLILLLAFIMSITLSKITSILAKRNVIYCEECSMYHSKRGIKYNGDFTNKCGFCTCNEQEDTEGLVIHKVSKRCTYKYQLKWAKVLMITLVLLLIAQNTILIVAAETDCWTKKSLDIDCIGPMLDIGSCTNKNTRSYDTEAQKLVSQSKISQLDADQVSLLGNSIDSAIKAIRAQKTYPTMHLLETIFLMKNCDYYTSFNHNSGYSQAKWRLIAKTGHFDICSRHSTHHFCRCINDGTKCQNGDWDFAGEMNETYNSKNDFYSHDLNLFYTIFENAFPGTTESLFYQLIQKKNTTGASKVLGKLITKYGNNNMFVGVWKFGQYLLTLPYINNTELSQNRRLTILATQELLSRSHSGRQESMSNAIQGSITKECHNAKGVECISPRFGIPIGNLTACGDSPNYKIYKTPEKLYKSNNKGEVWCSNDVHCLNDFEPADEEVVNKIKKLTCFLTDVSVEVDIFSVAASTCKMADKGVCTVNGAKWNIIKCDSGLYYFTDHREGQDTGNDFGEYCISHSCNTERFPINPDILKDCTWEFHSRKSKYISTISLESLEEFRRAMAEKLSHTLTIYNFKPTANLPHIRPTYKFITANGVENSDGIESAYILSSIPALGGISVGYNVQTKDNLPLLDIIVFIKSAVIRTTYNHIYDTGPTIGINTQHDEHCTGPCPAVVPHKENWMTFSQERTSRWGCEEFGCLAINTGCVFGSCQDIIHPETKVYRKAVEEEVVLTVCINFPGNNYCTEINAIEPKITDEIELQFKTVDTKTLPNLLAVQNHKLYSGQINDLGSFSQGCGNVQKTNHSILGMGTVKFDYVCHGASRKDVIVRRCYNNNFDSCKLLKEETSLIFADNHETLEVAHTKHLIGELQFKIMLGDIRYKSFAESPELEIDAKCVGCPSCFESYSCNFQIVTNIDTVCSVEGPCTLFHNRIIISANKQSYGLKMSCQTKPNQNEEFIICNRKYSVLFTTIDKNDKIEVNTGDQTSYIYEKDSRCKTWLCRVRDEGISVLFEPLKAFFGSYFSIIFYVVVGIIVLFLIIYIFLPMFFKLKDVLKRNEYLYLQELKHK

SEQ ID NO: 1823 - protein, 1434 aa, Artificial Sequence
  derived and/or modified protein sequence (wt) from CVV(MI80-1-450)__AF186241.1__GP
MLFLLILAFLGFSTSNPIATRCFHGGHLIAESKSATSISEFCLKDDVSMLKSEVVYIKNDTGLFGHNKVFRSWTIKDWKLCNPIPTAGGTINVIEVNKDLSLMTKTYICSRDCTITIDKEEAQIIFQTDKLNHFEVSGTTLSSGWFKSKASVTLDRTCEHVKVTCGKKSLQFHACFKHHMSCVRFFHNTILPGNMITSMCQNIELIIILGLTLAIFILMVILTKTYICYLLMPIFMPIAYLYGWAYNKSCKKCNCCGLAYHPFTNCGSHCVCGLKFEASDRMRIHRESGLCQGYKSLRIARLLCKSKGSSLVISGLLSMLILSFVTPIEGTITSYPESRKYTLEEITDVVEGLVSEQNIKEYIVFYTSLFGSLILLLAFIMSITLSKITSILAKRNVIYCEECSMYHSKRGIKYNGDFTNKCGFCTCNEQEDTEGLVIHKVSKRCTYKYQLKWAKVLMITLVLLLIAQNTILIVAAETDCWTKKSLDIDCIGPMLDIGSCTNKNTRSYDAEAQKLVSQSKISQLDADQVSLLGNSIDSAIKAIRAQKTYPTMHLLETIFLMKNCDYYTSFNHNSGYSQAKWRLIAKTGHFDICSRHSTHHFCRCINDGTKCQNGNWDFAGEMNETYNSKNDFYSHDLNLFYTIFENAFPGTTESLFYQLIQKKNTTGASQVLGKLITKYGNNNMFVGVWKFGQYLLTLPYINNTELSQNRRLTILATQELLSRSHSGRQESMSNAIQGSITKECHNAKGVGCISPRFGIPIGNLTACGDSPNYKIYKTPEKLYKSNNKGEVWCSNDVHCLNDFEPADEEVVNKIKKLTCFLTDVSVEVDIFSVAASTCKMADKGVCTVNGAKWNIIKCDSGLYYFTDHREGQDTGNDFGEYCISHSCNTERFPINPDILKDCTWEFHSRKSKYISTISLESLEEFRRAMAEKLSHTLTIYNFKPTANLPHIRPTYKFITANGVENSDGIESAYILSSIPALGGISVGYNVQTKDNFPLLDIIVFIKSAVIRTTYNHIYDTGPTIGINTQHDEHCTGPCPAVVPHKENWMTFSQERTSRWGCEEFGCLAINTGCVFGSCQDIIHPETKVYRKAVEEEVVLTVCINFPGNNYCTEINAIEPKITDEIELQFKTVDTKTLPNLLAVQNHKLYSGQINDLGSFSQGCGNVQKTNHSILGMGTVKFDYVCHGASRKDVIVRRCYNNNFDSCKLLKEETSLIFADNHETLEVAHTKHLIGELQFKIMLGDIRYKSFAESPELEIDAKCVGCPSCFESYSCNFQIVTNIDTVCSVEGPCTLFHNRIIISANKQSYGLKMSCQTKPNQNEEFIICNRKYSVLFTTIDKNDKIEVNTGDQTSYIYEKDSRCKTWLCRVRDEGISVLFEPLKAFFGSYFSIIFYVVVGIIVLFLIIYIFLPMFFKLKDVLKRNEYLYLQELKHK

SEQ ID NO: 1824 - protein, 1434 aa, Artificial Sequence
  derived and/or modified protein sequence (wt) from CVV(MI80-1-450)__KX100149.1__GP
MLFLLILAFLGFSTSNPIATRCFHGGQLIAESKSATSISEFCLKDDVSMLKSEVVYIKNDTGLFGHNKVFRSWTIKDWKLCNPIPTAGGTINVIEVNKDLSLMTKTYICSRDCTITIDKEEAQIIFQTDKLNHFEVSGTTLSSGWFKSKASVTLDRTCEHVKVTCGKKSLQFHACFKHHMSCVRFFHNTILPGNMITSMCQNIELIIILGLTLAIFILMVILTKTYICYLLMPIFMPIAYLYGWAYNKSCKKCNCCGLAYHPFTNCGSHCVCGLKFEASDRMRIHRESGLCQGYKSLRIARLLCKSKGSSLVISGLLSMLILSFVTPIEGTITSYPESRKYTLEEITDVVEGLVSEQNIKEYIVFYTSLFGSLILLLAFIMSITLSKITSILAKRNVIYCEECSMYHSKRGIKYNGDFTNKCGFCTCNEQEDTEGLVIHKVSKRCTYKYQLKWAKVLMITLVLLLIAQNTILIVAAETDCWTKKSLDIDCIGPMLDIGSCTNKNTRSYDAEAQKLVSQSKISQLDADQVSLLGNSIDSAIKAIRAQKTYPTMHLLETIFLMKNCDYYTSFNHNSGYSQAKWRLIAKTGHFDICSRHSTHHFCRCINDGTKCQNGNWDFAGEMNETYNSKNDFYSHDLNLFYTIFENAFPGTTESLFYQLIQKKNTTGASQVLGKLITKYGNNNMFVGVWKFGQYLLTLPYINNTELSQNRRLTILATQELLSRSHSGRQESMSNAIQGSITKECHNAKGVGCISPRFGIPIGNLTACGDSPNYKIYKTPEKLYKSNNKGEVWCSNDVHCLNDFEPADEEVVNKIKKLTCFLTDVSVEVDIFSVAASTCKMADKGVCTVNGAKWNIIKCDSGLYYFTDHREGQDTGNDFGEYCISHSCNTERFPINPDILKDCTWEFHSRKSKYISTISLESLEEFRRAMAEKLSHTLTIYNFKPTANLPHIRPTYKFITANGVENSDGIESAYILSSIPALGGISVGYNVQTKDNFPLLDIIVFIKSAVIRTTYNHIYDTGPTIGINTQHDEHCTGPCPAVVPHKENWMTFSQERTSRWGCEEFGCLAINTGCVFGSCQDIIHPETKVYRKAVEEEVVLTVCINFPGNNYCTEINAIEPKITDEIELQFKTVDTKTLPNLLAVQNHKLYSGQINDLGSFSQGCGNVQKTNHSILGMGTVKFDYVCHGASRKDVIVRRCYNNNFDSCKLLKEETSLIFADNHETLEVAHTKHLIGELQFKIMLGDIRYKSFAESPELEIDAKCVGCPSCFESYSCNFQIVTNIDTVCSVEGPCTLFHNRIIISANKQSYGLKMSCQTKPNQNEEFIICNRKYSVLFTTIDKNDKIEVNTGDQTSYIYEKDSRCKTWLCRVRDEGISVLFEPLKAFFGSYFSIIFYVVVGIIVLFLIIYIFLPMFFKLKDVLKRNEYLYLQELKHK

SEQ ID NO: 1825 - protein, 1434 aa, Artificial Sequence
  derived and/or modified protein sequence (wt) from CVV(MNZ-92011)__KC436107.1__GP
MLFLLILAFLGFSTSNPIATRCFHGGQLIAESKSATSISEFCLKDDVSMLKSEVVYTKNDTGLFGHNKVFRSWTIKDWKLCNPIPTAGGTINVIEVNKDLSLMTKTYICSRDCTITIDKEEAQIIFQTDKLNHFEVSGTTLNSGWFKSKASVTLDRTCEHVKVTCGKKSLQFHACFKHHMSCVRFFHNTILPGNMINSMCQNIELIIILGLTLAIFILMVMLTKTYICYLLMPIFMPIAYLYGWAYNKSCKKCNCCGLAYHPFTNCGSHCVCGLKFEASDRMRIHRESGLCQGYKSLRIARLLCKSKGSSLVISGLLSMLILSFVTPIEGTITSYPESRKYTLEEITDVVEGLVSEQNIKEYIVFYTSLFGSLILLLAFIMSITLSKITSILARRNVIYCEECSMYHSKRGIKYNGDFTNKCGFCTCNEQEDAEGLVIHKVSKRCTYKYQLKWAKVLMVTLVLLLIAQNTILIVAAGTDCWAKKSLDMDCIGPMLDIGSCTNKNTRNYDTEAQKLVSQSKVSQLDADQASLLGNSIDSAIKAIRAQKTYPTMHLLETIFLMKNCDYYTSFNHNSGYSQAKWRLIAKTGHFDICSRHSTHHFCRCINDGTKCQNGDWDFAGEMNETYNSKNDFYSHDLNLFYTIFENAFPGTTESLFYQLIQKKNTAGASKILGKLITKYGNNNMFVGVWKFGQYLLTLPYINNTELSQNRRQTILATQESLSRSHSGRQESMSSAIQGSVTKECHNAKDVGCISPRFGIPIGNLTACGDSPNYKIYKTPEKLYKSNNKGEVWCSNDVHCLNDFEPADEEVVNKVKKLTCFLTDVSVKTDIFSVAASTCKMADKGICTVNDAKWNIIKCDSGLYYFTDHREGQDTGNDFGEYCISHSCNTERFPINPDILKDCTWEFHSRKSKYISTISLESLEEFRRAMTEKLSHTLTIYNFKPTANLPHIRPTYKFITANGVENSDGIESAYILSSIPALGGISVGYNVQTKDNFPLLDIIVFIKSAVIRTTYNHIYDTGPTIGINTQHDEHCTGPCPAVVPHKENWITFSQERTSRWGCEEFGCLAINTGCVFGSCQDIIHPETKVYRKAVEEEVVLTVCINFPGNNYCTEINAVEPKITDEIELQFKTVDTKTLPNLLAVQNHKLYSGQINDLGSFSQGCGNVQKTNHSILGMGTAKFDYVCHGASRKDVIVRRCYNNNFDSCRLLKEETSLIFADNHETLEVAHTKHLIGELQFKIMLGDIRYKSFAESPELEIDAKCVGCPSCFESYSCNFQIVTNIDTVCSVEGPCTLFHNRIIISANKQSYGLKMSCQTKPNQNEEFIICNRKYSVLFTTIDKNDKIEVNTGDQTSYIYEKDSRCKTWLCRVRDEGISVLFEPLKAFFGSYFSIIFYVVVGIIVLFLIIYIFLPMFFKLKDVLKRNEYLYLQELKHK

SEQ ID NO: 1826 - protein, 1434 aa, Artificial Sequence
  derived and/or modified protein sequence (wt) from CVV(MPB1-1551)__KX100143.1__GP
MLFLLILAFLGFSTSNPIATRCFHGGQLIAESKSATSISEFCLKDDVSMLKSEVVYIKNDTGLFGHNKVFRSWTIKDWKLCNPIPTAGGTINVIEVNKDLSLMTKTYICSRDCTITIDKEEAQIIFQTDKLNHFEVSGTTLSSGWFKSKASVTLDRTCEHVKVTCGKKSLQFHACFKHHMSCVRFFHNTILPGNMITSMCQNIELIIILGLTLAIFILMVMLTKTYICYLLMPIFMPIAYLYGWAYNKSCKKCNCCGLAYHPFTNCGSHCVCGLKFEASDRMRIHRESGLCQGYKSLRIARLLCKSKGSSLVISGLLSMLILSFVTPIEGTITSYPESRKYTLEEITDVVEGLVSEQNIKEYIVFYTSLFGSLILLLAFIMSITLSKITSILAKRNVIYCEECSMYHSKRGIKYNGDFTNKCGFCTCNEQEDTEGLVIHKVSKRCTYKYQLKWAKVLMITLVLLLIAQNTILIVAAETDCWTKKSLDIDCIGPMLDIGSCTNKNTRSYDAEAQKLVSQSKISQLDADQASLLGNSIDSAIKAIRAQKTYPTMHLLETIFLMKNCDYYTSFNHNSGYSQAKWRLIAKTGHFDICSRHSTHHFCRCINDGTKCQNGDWDFAGEMNETYNSKNDFYSHDLNLFYTIFENAFPGTTESLFYQLIQKKNTTGASKVLGKLITKYGNNNMFVGVWKFGQYLLTLPYINNTELSQNRRLTILATQEILSRSHSGRQESMSNAIQGSITKECHNAKGVGCISPRFGIPIGNLTACGDSPNYKIYKTPEKLYKSNNKGEVWCSNDVHCLNDFEPADEEVINKIKKLTCFLTDVSVEVDIFSVAASTCKMADKGVCTVNGAKWNIIKCDSGLYYFTDHREGQDTGNDFGEYCISHSCNTERFPINPDTLKDCTWEFHSRKSKYISTISLESLEEFRRAMAEKLSHTLTIYNFKPTANLPHIRPTYKFITANGVENSDGIESAYILSSIPALGGISVGYNVQTKDNFPLLDIIVFIKSAVIRTTYNHIYDTGPTIGINTQHDEHCTGPCPAVVPHKENWMTFSQERTSRWGCEEFGCLAINTGCVFGSCQDIIHPETKVYRKAVEEEVVLTVCINFPGNSYCTEINAIEPKITDEIELQFKTVDTKTLPNLLAVQNHKLYSGQINDLGSFSQGCGNVQKTNHSILGMGTVKFDYVCHGASRKDVIVRRCYNNNFDSCKLLKEETSLIFADNHETLEVAHTKHLIGELQFKIMLGDIRYKSFAESPELEIDAKCVGCPSCFESYSCNFQIVTNIDTVCSVEGPCTLFHNRIIISANKQSYGLKMSCQTKPNQNEEFIICNRKYSVLFTTIDKNDKIEVNTGDQTSYIYEKDSRCKTWLCRVRDEGISVLFEPLKAFFGSYFSIIFYVVVGIIVLFLIIYIFLPMFFKLKDVLKRNEYLYLQELKHK

SEQ ID NO: 1827 - protein, 1434 aa, Artificial Sequence
  derived and/or modified protein sequence (wt) from CVV(W308-67)__KX100140.1__GP
MLFLLILAFLGFSTSNPIATRCFHGGQLIAESKSATSISEFCLKDDVSMLKSEVVYIKNDTGLFGHNKVFRSWTIKDWKLCNPIPTAGGTINVIEVNKDLSLMTKTYICSRDCTITIDKEEAQIIFQTDKLNHFEVSGTTLSSGWFKSKASVTLDRTCEHVKVTCGKKSLQFHACFKHHMSCVRFFHNTILPGNMITSMCQNIELIIILGLTLAIFILMVTLTKTYICYLLMPIFMPIAYLYGWAYNKSCKKCNCCGLAYHPFTNCGSHCVCGLKFEASDRMRIHRESGLCQGYKSLRIARLLCKSKGSSLVISGLLSMLILSFVTPIEGTITSYPESRKYTLEEITDVVEGLVSEQNIKEYIVFYTSLFGSLILLLAFIMSITLSKITSILAKRNVIYCEECSMYHSKRGIKYNGDFTNKCGFCTCNEQEDTEGLVIHKVSKRCTYKYQLKWAKVLMITLVLLLIAQNTILIVAAETDCWTKKSLDIDCIGPMLDIGSCTNKNTRSYDAEAQKLVSQSKISQLDADQASLLGNSIDSAIKAIRAQKTYPTMHLLETIFLMKNCDYYTSFNHNSGYSQAKWRLIAKTGHFDICSRHSTHHFCRCINDETKCQNGDWDFAGEMNETYKSKNDFYSHDLNLFYTIFENAFPGTTESLFYQLIQKKNTTGASKVLGKLITKYGNNNMFVGVWKFGQYLLTLPYINNTELSQNRRLTILATQEILSRSYSGRQESMSNAIQGSITKECHNAKGVGCISPRFGIPIGNLTACGDSPNYKIYKTPEKLYKSNNKGEVWCSNDVHCLNDFEPADEEVINKIKKLTCFLTDVSVEVDIFSVAASTCKMADKGVCTVNGAKWNIIKCDSGLYYFTDHREGQDTGNDFGEYCISHSCNTERFPINPDTLKDCTWEFHSRKSKYISTISLESLEEFRRAMAEKLSHTLTIYNFKPTANLPHIRPTYKFITANGVENSDGIESAYILSSIPALGGISVGYNVQTKDNFPLLDIIVFIKSAVIRTTYNHIYDTGPTIGINTQHDEHCTGPCPAVVPHKENWMTFSQERTSRWGCEEFGCLAINTGCVFGSCQDIIHPETKVYRKAVEEEVVLTVCINFPGNNYCTEINAIEPKITDEIELQFKTVDTKTLPNLLAVQNHKLYSGQINDLGSFSQGCGNVQKTNHSILGMGTVKFDYVCHGASRKDVIVRRCYNNNFDSCKLLKEETSLIFADNHETLEVAHTKHLIGELQFKIMLGDIRYKSFAESPELEIDAKCVGCPSCFESYSCYFQIVTNIDTVCSVEGPCTLFHNRIIISANKQSYGLKMSCQTKPNQNEEFIICNRKYSVLFTTIDKNDKIEVNTGDQTSYIYEKDSRCKTWLCRVRDEGISVLFEPLKAFFGSYFSIIFYVVVGIIVLFLIIYIFLPMFFKLKDVLKRNEYLYLQELKHK

SEQ ID NO: 1828 - protein, 1434 aa, Artificial Sequence
  derived and/or modified protein sequence (wt) from CVV(W728-67)__KX100137.1__GP
MLFLLILAFLGFSTSNPIATRCFHGGQLIAESKSATSISEFCLKDDVSMLKSEVVYIKNDTGLFGHNKVFRSWTIKDWKLCNPIPTAGGTINVIEVNKDLSLMTKTYICSRDCTITIDKEEAQIIFQTDKLNHFEVSGTTLSSGWFKSKASVTLDRTCEHVKVTCGKKSLQFHACFKHHMSCVRFFHNTILPGNMITSMCQNIELIIILGLTLAIFILMVMLTKTYICYLLMPIFMPIAYLYGWAYNKSCKKCNCCGLAYHPFTNCGSHCVCGLKFEASDRMRIHRESGLCQGYKSLRIARLLCKSKGSSLVISGLLSMLILSFVTPIEGTITSYPESRKYTLEEITDVVEGLVSEQNIKEYIVFYTSLFGSLILLLAFIMSITLSKITSILAKRNVIYCEECSMYHSKRGIKYNGDFTNKCGFCTCNEQEDTEGLVIHKVSKRCTYKYQLKWAKVLMITLVLLLIAQNTILIVAAETDCWTKKSLDIDCIGPMLDIGSCTNKNTRSYDAEAQKLVSQSKISQLDADQASLLGNSIDSAIKAIRAQKTYPTMHLLETIFLMKNCDYYTSFNHNSGYSQAKWRLIAKTGHFDICSRHSTHHFCRCINDGTKCQNGDWDFAGEMNETYNSKNDFYSHDLNLFYTIFENAFPGTTESLFYQLIQKKNTTGASKILGKLITKYGNNNMVVGVWKFGQYLLTLPYINNTELSQNRRLTILATQELLSRSHSGRQESMSNAIQGSITKECHNAKGVGCISPRFGIPIGNLTACGDSPNYKIYKTPEKLYKSNNKGEVWCSNDVHCLNDFEPADEEVVNKIKKLTCFLTDVSVEVDIFSVAASTCKMADKGVCTVNGAKWNIIKCDSGLYYFTDHREGQDTGNDFGEYCISHSCNTERFPINPDTLKDCTWEFHSRKSKYISTISLESLEEFRRAMAEKLSHTLTIYNFKPTANLPHIRPTYKFITANGVENSDGIESAYILSSIPALGGISVGYNVQTKDNFPLLDIIVFIKSAVIRTTYNHIYDTGPTIGINTQHDEHCTGPCPAVVPHKENWMTFSQERTSRWGCEEFGCLAINTGCVFGSCQDIIHPETKVYRKAVEEEVVLTVCINFPGNNYCTEINAIEPKITDEIELQFKTVDTKTLPNLLAVQNHKLYSGQINDLGSFSQGCGNVQKTNHSILGMGTVKFDYVCHGASRKDVIVRRCYNNNFDSCKLLKEETSLIFADNHETLEVAHTKHLIGELQFKIMLGDIRYKSFAESPELEIDAKCVGCPSCFESYSCNFQIVTNIDTVCSVEGPCTLFHNRIIISANKQSYGLKMSCQTKPNQNEEFIICNRKYSVLFTTIDKNDKIEVNTGDQTSYIYEKDSRCKTWLCRVRDEGISVLFEPLKAFFGSYFSIIFYVVVGIIVLFLIIYIFLPMFFKLKDVLKRNEYLYLQELKHK

SEQ ID NO: 1829 - protein, 1434 aa, Artificial Sequence
  derived and/or modified protein sequence (wt) from CVV(WI-03BS7669)__KX100152.1__GP
MLFLLILAFLGFSTSNPIATRCFHGGQLIAESKSATSISEFCLKDDVSMLKSEVVYIKNDTGLFGHNKVFRSWTIKDWKLCNPIPTAGGTINVIEVNKDLSLMTKTYICSRDCTITIDKEEAQIIFQTDKLNHFEVSGTTLSSGWFKSKASVTLDRTCEHVKVTCGKKSLQFHACFKHHMSCVRFFHNTILPGNMITSMCQNIELIIILGLTLAIFILMVILTKTYICYLLMPIFMPIAYLYGWAYNKSCKKCNCCGLAYHPFTNCGSHCVCGLKFEASDRMRIHRESGLCQGYKSLRIARLLCKSKGSSLVISGLLSMLILSFVTPIEGTITSYPESRKYTLEEITDVVEGLVSEQNIKEYIVFYTSLFGSLILLLAFIMSITLSKITSILAKRNVIYCEECSMYHSKRGIKYNGDFTNKCGFCTCNEQEDTEGLVIHKVSKRCTYKYQLKWAKVLMITLVLLLIAQNTILIVAAETDCWIKKSLDIDCIGPMLDIGSCTNKNTRSYDTEAQKLVSQSKISQLDADQVSLLGNSIDSAIKAIRAQKTYSTMHLLETIFLMKNCDYYTSFNHNSGYSQAKWRLIAKTGHFDICSRHSTHHFCRCINDGTKCQNGDWDFAGEMNETYNSKNDFYSHDLNLFYTIFENAFPGTTESLFYQLIQKKNTTGASKVLGKLITKYGNNNMFVGVWKFGQYLLTLPYINNTELSQNRRLTILTTQELLSRSHSGRQESMSNAIQGSITKECHNAKGVGCISPRFGIPIGNLTACGDSPNYKIYKTPEKLYKSNNKGEVWCSNDVHCLNDFEPADEEVVNKIKKLTCFLTDVSVEVDIFSVAASTCKMADKGVCTVNGAKWNIIKCDSGLYYFTDHREGQDTGNDFGEYCISHSCNTERFPINPDILKDCTWEFHSRKSKYISTISLESLEEFRRAMAEKLSHTLTIYNFKPTANLPHIRPTYKFITANGVENSDGIESAYILSSIPALGGISVGYNVQTKDNFPLLDIIVFIKSAVIRTTYNHIYDTGPTIGINTQHDEHCTGPCPAVVPHKENWMTFSQERTSRWGCEEFGCLAINTGCVFGSCQDIIHPETKVYRKAVEEEVVLTVCINFPGNNYCTEINAIEPKITDEIELQFKTVDTKTLPNLLAVQNHKLYSGQINDLGSFSQGCGNVQKTNHSILGMGTVKFDYVCHGASRKDVIVRRCYNNNFDSCKLLKEETSLIFADNHETLEVAHTKHLIGELQFKIMLGDIRYKSFAESPELEIDAKCVGCPSCFESYSCNFQIVTNIDTVCSVEGPCTLFHNRIIISANKQSYGLKMSCQTKPNQNEEFIICNRKYSVLFTTIDKNDKIEVNTGDQTSYIYEKDSRCKTWLCRVRDEGISVLFEPLKAFFGSYFSIIFYVVVGIIVLFLIIYIFLPMFFKLKDVLKRNEYLYLQELKHK

SEQ ID NO: 1830 - protein, 1438 aa, Artificial Sequence
  derived and/or modified protein sequence (wt) from CHLV(CHLV-Mex07)__JN808310.1__GP
MEPSIKLFLILAIAAAAVHSLPASRCFSEGIVIKEKQDSKAVSEFCLKDDVSMIKSHVVYSKNESGIFANSQILRKWIIKDWKLCSPLPTAGGQINVIEINHDLTLSTKTYVCTTDCTIGIDKENAQITFQTNKLNYFEVSGTTISSGWFKSKTSVSLDQTCEHLKVSCGKKSMQFHACFKQHMSCIRYLHRTALPGYMAASICSNIELIIMTTLTLAIFILLCIITKTYICYLLMPLFMPIAYIYGWLYNKSCKKCNCCGLSYHPFTNCGSYCVCGAKFETSDRMRIHRESGLCQGYKSLRVARKLCKSKGSSLVISITLSVFIFSFITPIGGAIINDKLSEEKYSINQMMDAIVDLENFSHNVSGTQQVISVIFLLISCLFLLLTYHLNKIIQHLARFGLLFCEECSMYHSKKDIKYNGDFTNKCGFCTCGQPEDPEGLNLHILSQNCTYKQQFKWVKIIISILLSLIIIENSMILAAAETDCFSEKQISEFCLGPLLSISSCEDKNSRTFKGEAQKLVALKKITSDEAMLIESMGANVEGALEMIQAQKSPDSMYTMEYVFLNTYCDYYSLFEHNSGYSQVKWRYILKTHQFDACARHSNSHFCRCMSDGMHCPSSDWDIADELDNTYITKPNFFKHDYNLLLDVITAAFPGTGAVFVIDACKKANATAIKTFSNNIIARFPYNNLLKGVMKFLQYISKHPSFKKYQPDTRHYDLIPVAPTARGRSLGRSNSYNNAQIGSPTKDCQMLKEVGCLSPKFGLPLESIISCGSSPNYKLYKKPQKYYKSNNKENTWCSKDVHCLHDFEPITEDVLEKVKVMTCWEIEPGTIEDIFTIASETCKINDRGVCEVNAAKWKIVKCETGLYYYTDHREGDDTGSDLGHYCLTHKCAGGRYPINPEILQNCVWEFHSQKSQYINQVDLEQIEEYKKALTEKLTHTLNHYNFLPTKNLPHISPNYKYVTLNGQETSDGIENSYIVSEIPAIAGTSIGLKVQTKTNDDIFDLIIYVKRADIIASYNHIYDTGPTIGHNVEHEELCTGQCPQHIPAKANWLTFSQERTSRWGCEEFGCLAINTGCVYGSCQDIIKPVAKVYRKSTEEKVELELCIVLPDKNFCTTLNALEPKITEEIELQFKTIDQMSLPNIVLLRDHKLFKGQINDLGTFGQNCGNVQKTNQSILGAGTVRFDYLCHSASRKDIIIRRCYNNNYDSCNHLQLAESLIFLDNHETLEVRKPNHILGTLSMKLMLGDFQYKTFAKDIELDFTGRCVGCIGCFEGFVCEMHITTTVEATCNLEASCQFFHNQLHIKPDVLKYYTKMTCQTDEYIPSKIKICNKEYKITVGKVQKNDKIEIDNSDQTSYIKEKDERCKTWLCRVRDEGISVIFEPLLNIFGNYGRIAVAVISAILALIILVYILMPICMRIRDILKTNEREFLIESKYK

SEQ ID NO: 1831 - protein, 1434 aa, Artificial Sequence
  derived and/or modified protein sequence (wt) from FSV(86MSP18)__KX100131.1__GP
MLSLLILALLGLSTSNPIATRCFHGGQLIAESKSATSISEFCLKDDVSMLKSEVIYTKNDTGLFGHNKVFRSWTIKDWKLCNPIPTAGGTINVIEVNKDLSLMTKTYICSRDCTITIDKEEAQIIFQTDKLNHFEVSGTTLSSGWFKSKASVTLDRTCEHVKVTCGKKSLQFHACFKHHMSCVRFFHNTILPGNMITSMCQNIELIIILGLTLAIFILMVMITKTYICYLLMPIFMPIAYLYGWAYNKSCKKCNCCGLAYHPFTNCGSHCVCGLKFEASDRMRIHRESGLCQGYKSLRIARLLCKSKGSSLVISGLLSMLILSFVTPIEGTITNYPDSRKYTLEEITDVVEGLISEQNIKEYIVFYTSLFGSLILLLAFIMSITLSKITSILARRNVIYCEECSMYHSKRGIKYNGDFTNKCGFCTCNEQEDAEGVVIHKVSKRCTYKYQLKWAKVLMITLVLLLIAQNTILIVAAETDCWAKKSLDINCIGPMLNIGSCTNKNTRSYDTEAQKLVSQSKVSQLDADQASLLGSSIDSAIKAIRAQKTYPAMHLLETIFLMKNCDYYTSFNHNSGYSQAKWRLIAKTGHFDICSRHSTHHFCRCINDGTKCQNGDWDFAGEMNETYNSKNDFYLHDLNLFYTIFENAFPGTTESLFYQLIQKRNTIGASKVLGKLITKYGDNNMFVGVWKFGQYLLTLPYINNTELSQNRRQTILAAQELSSRSHPGRQESMSSAIQGSVTKECHNAKDVGCISPRFGIPIGNLTACGDSPNYKIYKTPEKLYKSNNKGEVWCSNDVHCLNDFEPADEEVVNKVKKLTCFLTDVSVKTDIFSVAASTCKMADKGVCTVNDAKWNIIKCDSGLYYFTDHREGQDTGNDFGEYCISHSCNTERFPINPDILKDCTWEFHSRKSKYISTISLESLEEFRRAMTEKLSHTLTIYNFKPTANLPHIRPTYKFITANGVENSDGIESAYILSSIPALGGISVGYNVQTKDNFPLLDIIVFVKSAVIRTTYNHIYDTGPTIGINTQHDEHCTGPCPAVVPHKENWITFSQERTSRWGCEEFGCLAINTGCVFGSCQDIIHPETKVYRKAVEEEVVLTVCINFPGNNYCTEINAIEPKITDEIELQFKTVDTKTLPNLLAVQNHKLYSGQINDLGSFSQGCGNVQKTNHSILGMGTAKFDYVCHGASRKDVIVRRCYNNNFDSCKLLKEETSLVFADNHETLEVAHTKHLIGELQFKIMLGDIRYKSFAESPELEIDAKCVGCPSCFESYSCNFQIVTNIDTVCSVEGPCTLFHNRIIISASKQSYGLKMSCQTKPSQNEEFIICNRKYSVLFTTIDKNDKIEVNTGDQTSYIYEKDSRCKTWLCKVRDEGISVLFEPLKAFFGSYFSIIFYVVVGIIVLFLVIYIFLPMFFKLKDVLKKNEYLYLQELKHR

SEQ ID NO: 1832 - protein, 1437 aa, Artificial Sequence
  derived and/or modified protein sequence (wt) from GERV__M21951.1__GP
MAISTSLLIVALLIKLCLVNTAPPISKCFQDGILIAELKSSSGISEFCIKDDISILKSEITYSKNDTGIFMHSKVFRHWTVADWKQCNHTSAGGSTNVLEVDKNLNLVAKNYMCTRPCVITIDKENAQLLFQTEQLNQFEVTGTTISTGWFKSKTSVSLDNTCEHIKVTCGKKSLQFHACFKQHMSCVRFLHRSVLPGYMASSICQNIELIIIIILTLAIFIFMCIITRTYICYLMLPLFAPIAYLYGWLYNRSCKKCICCGLAYHPFTNCGSYCVCGSRFETSDRMRLHRESGLCQGFKSLRVARSLCKSKGSSLVISILTAMLILSFITPLEAMTTNYPDDKKFTLKEVNDIVLGRDMEQELKSSILILMSICGIGIILIFFGLTVLLEIVLELIAKRSTIFCKECNLIHDKKSMTYRGDFTNKCGFCPCGELEDPEGLVIHTTRKSCTYYIKIRNLKLIMLIFSIVILMQNATMLVVAGENCWTNTEIKADCVGPLIGPSACTNKGSKTYKTVAQELVTASKITQLDADKYVLLGDTIESALDAITSQKHYSAMHLLETMFLMKHCDYYKVYEHNSGYSQTKWRLIAIANSFDICTNTPTPNFCKCLSDSSCSTTTLNFATSMNATYTSKVEFFNHDFTLFLDIFEAAFPGSATAFLFKKIKEKNPYQAFEMMGKIANKYPNNKLLVVILKYGQYMVGLSHASTYQLKQEWVAKSLSLTRAQRTGLKMSMANAEPGPATKECSDAKTIACLTPKFQVEVNNLMSCGASPNFKIYVKTGELYKAHDRNSVWCLNDMHCLTPYTPANAEIITTMKKMDCWQDNPKQPTDEYAIPKRSCQMKDRGLCNSGADKWKIIKCDNHKLFYTDALERRDPASIVGSNHCFSEKCQIERYPINPTSLTNCEWLYRAVRPEYIKKLSLQTIEEYKKAIADKLTHTLQLYHFAPLLENLPHIKPTYKYITAQGTYTADGIEGASITTSIPALSGTSVGFKINAKDGTDLLDIVVYIKASVVKSIYNHIYDTGPTININSKHDELCTGQCPKKIPADPNWLTFSQERTSRWGCEEFGCLAINTGCVYGSCQDVIRTETKVYRKANEETVMLTVCITYPGHTFCTDVNAHEPKITDELELQFKTIDIKSLPNLVAVTNHKLYTGQINDLGTFGQMCGNVQKTNTSHTGAGTPKFDYTCYSASRKDIIIRRCYNNNYDSCRLLNQESDLLFDDNHETLVVYNNKRLNGELALKLLLGDIQYKLYTENMELELEAKCVGCVGCFESYQCNLQITSSLDETALYLVPVSHFHDRIQIKTTKKDYAMKISCTRDPGDKASFRVCGKSYDFNFHTVPKNDKIEVNVGDETSYIKEKDNRCGRWLCRVRDEGLSVIFEPLNNFFGNYLNMFLYILGGIILLFLALYILMPMCARLRDELKRNERLHQMEMKKR

SEQ ID NO: 1833 - protein, 1419 aa, Artificial Sequence
  derived and/or modified protein sequence (wt) from IACOV(BeAn314206)__JN572066.1__GP
MRVIALFHLVMVITANPVFHRCFQGGQLILEKKSHVSMSEFCLKDDVSMVKSVVEYEKTNNSIVGTNKVYRQWVVSDWKLCHPIKAEGGGINIIEVEKDLTIKSNTYICTTDCTITVDKENAQIIFQTSKLNHFEVTGTTLSTGWFKTKAAVTLDQTCEHIRVSCGKKSIQFHACFRQHMTCVRFLHRSLLPGSMANSICQNVELIIIIVLTLLIFIVLNIIAKTYICYLMLPIFMPIAYIYGWIYNRSCKKCVNCGLAYHPFSNCGSHCVCGAIFQTSDRMRMHRESGLCSGFKSLRVARVLCKSKSSSLVIAILSSLLILSFVTPIEGLDLEEKKYSLSDLPDIYTKELNTLSEKIAINFYISITNMLITIILLIVAFCSHCITNKIVKYKAFLCTECDMYHTYKNIRYNGDFCNKCGSCTCGTMEDPNYTTMHKVSDLCLAEPKRIIQKKLMIILIIFVIIENGACLASAEEKCFKEHDYNIECIGPLITMRPCTKKTIQEVARTLVTDKQIAQEDTEKIELLPDSIVQAWNMIDNQLNYDQMFLMEYAFLKRECSFFEEFEHNSGVNQIMWRTIAKTGHFDICAIRSSQRFCKCMSESVYCKDANWDIANEMNDTYSFKPLFYRHDVKLYSKIFKAAFQGTTLKTYEKFLNAKNKTELINMLKKLGKRFPYNNLLMGFLKFGELLFDLTLFDALPKDKTSRTSSTTAKREYENLQDAKVGEPTSECKDMKLLQCISPRYQVSVGSVIKCGDTEKKIYDFHTPVYKLATDETKWCRFDKHCLHEWVPIDNARLEMLKKLNCWYTDPTEMVDIYTTSRKSCRMINKGTCNIKNAPMTVMQCDDDLIFYTDHRSSADTQGDIGEYCLSQNCDVSRYPINVMDGMTCTWEYNTVKPKYLSKTELKTLEEYKRTLQDKLSHNLEVYHFHMTANFPHIKPVYKYITAGGVETSDGIEGAFILVDLPALSGTSVGLTVLSKDDVPLMDVIIYIKSAVIKATYNHIYDTGPTIGINVKHEELCTGPCPQNIPHQEQWLTFSQERTSRWGCEEFGCLAVGEGCVYGSCQDIIKKETRVYKKVSEEINEITFCIIFQTNTYCQTMNAIEPQITPSLEVQLEGLDTKILPNILALQNHKLYSGQINDLGSFGLACGNVQQVNKTIYGAGQPKFDYLCHGAKRKDIIVRKCYNNNFGSCKLLTIEDNLIVEDNYNTINVINTKHLIGTVKSKLNLGDIRYKLFNKKPEFELEAHCVGCVGCFANYNCEIKIESTIDMTCPISGPCEFFHNNIFIQAEHTKYAMKMICKKQPDQTTEFTICDKKYHFIIDTVEKHDQIEIDVGDQTSYILEKDNRCGTWMCKVLDEGLSVIFEPLKLLLGNYFHMAIVIIIGLIALAVIIYILLPMFMKLRDTLKANEIAYQKEMKIK

SEQ ID NO: 1834 - protein, 1434 aa, Artificial Sequence
  derived and/or modified protein sequence (wt) from ILEV(KO/2)__AY859372.1__GP
MLFPIILLMIQLVSSTPLSTRCFHEGTLVKEKISTTSISEFCLKDDVSMIKSEITYQKNDTGVYGHSKIYRNWIVKEWKACNPVPSAGGSINVIEVNEDMSLATKNYICTRDCVITVDKEDAQIVFQTDNLNHFEVSGTTLSSGWFKTKASVTLDRTCEHIKVSCGKKTVQFHACFRNHMSCVRFFHNTILPGYMATSICQNIELIIIIVLTIAIFIMLVILTKTYICYLLMPLFMPIAYCYGWAYNKSCKKCNCCGLAYHPFTNCGSFCVCGLKFEASDRMRIHRESGLCQGYKSLRVARRLCKSKGSSFVISILLSLFILSFVTPIEGTMTNYPEERKYTLEEIADVIEGFYQEAKIKEYIVFYSSIFGSFILISSMLILYKLQNITYFLSKFNVMYCSECSMYHSKKNIKYLGDFTNKCGFCTCGELEDAEGLSIHKVTKRCTYAYQMTWTKIILATLLILLIGQNTLLVVSAQADCWEKTEITIDCIGPIFAPNTCIKQEEKTYAKEAQTLVDQNKISQADAKQVDMLGATIDDAIKAIRSQKTYTTMHMLEAIFLSKYCDYYSLFEHNSGYSQGKWRLIAKTESFDICSRHTTHHFCRCMSDETKCKNGDWDFAGEMNSTYHSKSNFLLHDLRLFYKIYSAAFPGLSEAMLYKFLSEKDTTNAIKLLEKLFTKYSYNNLLVGILRFGKFLFSMSIFNTTELGGAQKAMILRPTDELRTTYSGKQESLSNSVVGEQTSDCVNMKKISCISPRFNIPLSSMIACGNQPNYQIYKEPSKYYKSNNKPNTWCNKDIHCLNDFESIDQSALDRLKTMTCFLIDPITTEDVYSIAIHSCKVKDKGQCTIRDKKWNIIKCDSELLYYTDHREGEDTGNEIGHYCLSHKCGTDRYPINPEIIKDCIWEFRSRKSEYINRVDLESLEEFKRALSDKLTHTLTIYNFKPTANLPHIKPIYKYITALGVENSDGLEAAYILTSIPALGGTSIGYNIMTKDNFPVMDVIIYVKSAVIQTTYNHIYDTGPTIGINSKHDEKCTGSCPQNITHDQNWLTFSQERASRWGCEEFGCLAINTGCVFGSCQDMIRSDTKVYKKALEETVVLTVCINYPGNTFCTEVNSVETKMTDDVELQFKTVDTKTLPNLLAVTNHKLYSGQINDLGSFSQMCGNVQKTNSTVMGAGTVKFDYICHGASRKDIIIRRCYMNNYASCSLLKEEKDLIFADNHETITVSNSKHLVGELQIKLMLGDIRYKLFAERPELEVDAKCVGCPSCFESYSCNFQIVTNIDTVCTLEGPCTIFHNRIIISSTKQSYGIKMSCPTKPNHIEKFKICNHEYDILFDTVAKNDKIEIDTGDQTLFVREKDTRCKTWLCRVKDEGISVIFEPLRAFFGSYFSIIFYIILAAILIFVGVYIFLPMFMRLRDVLKRNEHLYLQEIKHK

SEQ ID NO: 1835 - protein, 1434 aa, Artificial Sequence
  derived and/or modified protein sequence (wt) from ILEV(R5964)__KF234074.1__GP
MLFPIILLMIQLVSSTPLSTRCFHEGTLVKEKISTTSISEFCLKDDVSMIKSEITYQKNDTGVYGHSKIYRNWIVKEWKACNPVPSAGGSINVIEVNEDMSLATKNYICTRDCVITVDKEDAQIIFQTDNLNHFEVSGTTLSSGWFKTKASVTLDRTCEHIKVSCGKKTVQFHACFRNHMSCVRFFHNTILPGYMATSICQNIELIIIIVLTIAIFIMLVILTKTYICYLLMPLFMPIAYCYGWAYNKSCKKCNCCGLAYHPFTNCGSFCVCGLKFEASDRMRIHRESGLCQGYKSLRVARRLCKSKGSSFVISILLSLFILSFVTPIEGTMTNYPEERKYTLEEIADVIEGFYQEAKIKEYIVFYSSIFGSFILISSMLILYKLQNITYFLSKFNVMYCSECSMYHSKKNIKYLGDFTNKCGFCTCGELEDAEGLSIHKVTKRCTYAYQMTWTKIILATLLILLIGQNTLLVVSAQADCWEKTEITIDCIGPIFAPNTCIKQEEKTYAKEAQTLVDQNKISQADAEQVDMLGATIDDAIKAIRSQKTYTTMHMLEAIFLSKYCDYYSLFEHNSGYSQGKWRLIAKTESFDICSRHTTHHFCRCMSDETKCKNGDWDFAGEMNSTYHSKSNFLLHDLRLFYKIYSAAFPGLSEAMLYKFLSEKDTTNAIKLLEKLFTKYSYNNLLVGILRFGKFLFSMSIFNTTELGGAQKAMILRPTDELRTTYSGKQESLSNSVVGEQTSDCVNMKKISCISPRFNIPLSSMIACGNQPNYQIYKEPSKYYKSNNKPNTWCNKDIHCLNDFESIDQSALDRLKTMTCFLIDPITTEDVYSIAIHSCKVKDKGQCTIRDKKWNIIKCDSELLYYTDHREGEDTGNEIGHYCLSHKCGTDRYPINPEIIKDCIWEFRSRKSEYINRVDLESLEEFKRALSDKLTHTLTIYNFKPTANLPHIKPIYKYITALGVENSDGLEAAYILTSIPALGGTSIGYNIMTKDNFPVMDVIIYVKSAVIQTTYNHIYDTGPTIGINSKHDEKCTGSCPQNITHDQNWLTFSQERTSRWGCEEFGCLAINTGCVFGSCQDMIRSDTKVYKKALEETVVLTVCINYPGNTFCTEVNSVETKMTDDVELQFKTVDTKTLPNLLAVTNHKLYSGQINDLGSFSQMCGNVQKTNSTVMGAGTVKFDYICHGASRKDIIIRRCYMNNYASCSLLKEEKDLIFADNHETITVSNSKHLVGELQIKLMLGDIRYKLFAERPELEVDAKCVGCPSCFESYSCNFQIVTNIDTVCTLEGPCTIFHNRIIISSTKQSYGIKMSCPTKPNHIEKFKICNHEYDILFDTVAKNDKIEIDTGDQTLFVREKDTRCKTWLCRVKDEGISVIFEPLRAFFGSYFSIIFYIILAAILIFVGVYIFLPMFMRLRDVLKRNEHLYLQEIKHK

SEQ ID NO: 1836 - protein, 1434 aa, Artificial Sequence
  derived and/or modified protein sequence (wt) from MAGV__AY286443.1__GP
MELLIIILLLGSAASSPISTRCFHGGQLIAESKSATSISEFCLKDDVSMIKSEVTYIKNDTGIYGHNKVFRSWTIKDWKLCNPIPTAGGSINVIEVNSDLSLATRAYVCSRDCTITIDKEDAQIIFQTDKLNHFEVSGTTLSSGWFKTKASVTLDRTCEHIKVTCGKKSLQFHACFKHHMSCIRFFHHTILPGTMVSSMCQNIELIIIIGLTLVIFILMVILTKTYICYLLMPVFMPVAYIYGWAYNKSCKKCNCCGLAYHPFTNCGSHCVCGLKFEASDRMRLHRESGLCQGYKSLRIARMLCKSKGSSLVISGLLSMLLLSFITPIEGTLTNYPNEKQYTLEEIADVVEGIITEQHLKEYVVFYTSLFGGLILLLTLILSITINKVTDLLASTNVIYCEECSMYHSKKGIKYNGDFTNKCGFCTCSEQEDVEGVIIHKVSRKCTYKYQLKWVRVIMIILALLLTIQNTVLIVAAEVDCWTKKSIEIDCIGPLLNIGSCTDKSSRTYETEVNKLVRQSKVTHADAEQISILGSTLDNAIKAVRSQKTYETMHFLETVFLMKNCDYYNSFEHNSGYSQTKWRLIAKTSHFDICSRHSTHHFCRCVNEGTKCQNGDWDFAGEMNDTYNSKNDFYLHDLDLFYTLLENAFPGTTESLFYQLLQKKNTTGASKLLGKLITKYGNNNMFVEIWKFGQYLLKLPYINDTELSTDRKSTIIKSQQVLSRSQTGRQESLSSATPGTATKECSNAKDIGCISPRFGIPIGNLTACGDSPNYKVYKTPEKIYKSNNRGEVWCSDDVHCLTDFEPAEEEVVNRIKQMTCFLTDVTTKTDVFSVAISTCKMVDKGVCTVNDAKWNILKCNSGLYYFTDHRGGQDTGNDFGEYCISHSCNTERFPINPDVLKDCIWEYHSRKSKYISTVSLESLDEFRRAMSDKLSHTLMIYNFKPTANLPHIKPTYKFITANGIENSDGIDSAYILSSIPALGGMSVGYNIQTKDNFPLLDIIVFIKSAIIKTTYNHIYDTGPTIGINTQHDEHCTGPCPTLIPHKENWLTFSQERTSRWGCEEFGCLAINTGCVFGSCQDIIHPEAKVYRKAIEEEVVLTVCITFPGNTYCTEINAIEPKITDEIELQFKTVDTKTLPNLLMVQNHKLYSGQINDLGSFSQGCGNVQKTNQSVIGAGTAKFDYVCHGASRKDVIVRRCYNNNYESCKLLKEETSLIFADNHETLEVANTKHLIGELQFKIMLGDIRYKSFAESPELEVDAKCVGCPSCFESYSCNFQIVTNIDTVCSVDGPCTLFHNRLIISATKQSYGFKMSCPRKPEPTEEFQICNRKYNVLFTTIDKNDKIEINTGDQTSYIYEKDNRCKTWLCRVRDEGISVIFEPLKAFFGSYFSIIFYVVVGIIVLFLTIYIFLPMFFKLRDILKRNEYLYLQELKHK

SEQ ID NO: 1837 - protein, 1434 aa, Artificial Sequence
  derived and/or modified protein sequence (wt) from MAGV(ts8)__AY286444.1__GP
MELLIIILLLGSAASSPISTRCFHGGQLIAESKSATSISEFCLKDDVSMIKSEVTYIKNDTGIYGHNKVFRSWTIKDWKLCNPIPTAGGSINVIEVNSDLSLATRAYVCSRDCTITIDKEDAQIIFQTDKLNHFEVSGTTLSSGWFKTKASVTLDRTCEHIKVTCGKKSLQFHACFKHHMSCIRFFHHTILPGTMVSSMCQNIELIIIIGLTLVIFILMVILTKTYICYLLMPVFMPVAYIYGWAYNKSCKKCNCCGLAYHPFTNCGSHCVCGLKFEASDRMRLHRESGLCQGYKSLRIARMLCKSKGSSLVISGLLSMLLLSFITPIEGTLTNYPNEKQYTLEEIADVVEGIITEQHLKEYVVFYTSLFGGLILLLTLILSITINKVTDLLASTNVIYCEECSMYHSKKGIKYNGDFTNKCGFCTCSEQEDVEGVIIHKVSRKCTYKYQLKWVRVIMIILALLLTIQNTVLIVAAEVDCWTKKSIEIDCIGPLLNIGSCTDKSSRTYETEVNKLVRQSKVTHADAEQISILGSTLDNAIKAVRSQKTYETMHFLETVFLMKNCDYYNSFEHNSGYSQTKWRLIAKTSHFDICSRHSTHHFCRCVNEGTKCQNGDWDFAGEMNDTYNSKNDFYLHDLDLFYTLLENAFPGTTESLFYQLLQKKNTTGASKLLGKLITKYGNNNMFVEIWKFGQYLLKLPYINDTELSTDRKSTIIKSQQVLSRSQTGRQESLSSATPGTATKECSNAKDIGCISPRFGIPIGNLTACGDSPNYKVYKTPEKIYKSNNRGEVWCSDDVHCLTDFEPAEEEVVNRIKQMTCFLTDVTTKTDVFSVAISTCKMVDKGVCTVNDAKWNILKCNSGLYYFTDHRDGQDTGNDFGEYCISHSCNTERFPINPDVLKDCIWEYHSRKSKYISTVSLESLDEFRRAMSDKLSHTLMIYNFKPTANLPHIKPTYKFITANGIENSDGIDSAYILSSIPALGGMSVGYNIQTKDNFPLLDIIVFIKSAIIKTTYNHIYDTGPTIGINTQHDEHCTGPCPTLILHKENWLTFSQERTSRWGCEEFGCLAINTGCVFGSCQDIIHPEAKVYRKAIEEEVVLTVCITFPGNTYCTEINAIEPKITDEIELQFKTVDTKTLPNLLMVQNHKLYSGQIDDLGSFSQGCGNVQKTNQSVIGAGTAKFDYVCHGASRKDVIVRRCYNNNYESCKLLKEETSLIFADNHETLEVANTKHLIGELQFKIMLGDIRYKSFAESPELEVDAKCVGCPSCFESYSCNFQIVTNIDTVCSVDGPCTLFHNRLIISATKQSYGFKMSCPRKPEPTEEFQICNRKYNVLFTTIDKNDKIEINTGDQTSYIYEKDNRCKTWLCRVRDEGISVIFEPLKAFFGSYFSIIFYVVVGIIVLFLTIYIFLPMFFKLRDILKRNEYLYLQELKHK

SEQ ID NO: 1838 - protein, 1436 aa, Artificial Sequence
  derived and/or modified protein sequence (wt) from MAGV(AG83-1746)__KX100113.1__GP
MKMILLIIILCVNLAAANPVATRCFHGGQLIAETRSATSISEFCLKDDVSMIKSEITYTKNDTGIFGHSKIYKSWLIKDWKLCNPVPTAGGSINVIEVNSDLSLTTKAYVCSRDCTITIDKEEAQIIFQTDKLNHFEVSGTTLSSGWFKTKASVTLDRTCEHIKVTCGKKTLQFHACFRHHMSCVRFFHNTILPGTMVNSMCQNIELIIILGLTLIIFTLMVILTKTYICYILMPLFMPIAYAYGWAYNKSCKKCNCCGLAYHPFTNCGSHCVCGLKFEASDRMRIHRESGLCQGYKSLRIARLLCKSKGSSLIISTLLSMLLLSFITPIEGTMTNYPETRQYSLEEIADVVEGLLSEQNIKEYVVFYTSLFGSLILLLAFILSITLTKVTNALAKTNVIYCEECSMYHAKKGIKYNGDFTNKCGFCTCDEQEDEEGIIIHKVSKKCTYRYQLQWAKIIMIILVMLLMMQNTILIVAAETDCWTKNSLELDCIGPLLTISDCSNKESKNYEEEAAKLVSQSKITQADAEQVTILGNTIDTALKAIRSQKTYQTMHLLESVFLMKNCDYYSSFEHNSGYSQAKWRLIAKTSHFDICSRHSMHHFCRCVADGTKCQNGNWDFAGEMNNTYSTKNDFYLHDLNLFFTLHETAFPGTTESLFYQLIAKKNTTGASKLLGKLITKYGNNKLFVGIWKFGQYLLTLPYVNTTELSKTRKETILKPHQILTRSQGGRPESMSSAEVGQTAKECANAKNVGCISPRFGVPIGNLTACGNSPNYKIYKTPNKIYKSNNRGEVWCSEDVHCLADFEPADTEVVNKVKKMTCFLSDVNTRADIFSIAISACRMVDKGVCTVNGAKWNILKCESGLYYFTDHREGQDTGNDFGEYCISHSCNTERYPINPDILKECIWEYHSRKSKYISTINLESLEEFKRAMSDKLSHTLMVYNFKPTANLPHIKPSYKFITANGIENSDGLESAYILSSIPAIGGMSIGYNIQTKDNFPLLDLIVFVKSAVIKTTYNHIYDTGPTIGINTNHDEHCTGPCPTIIPHKENWLTFSQERTSRWGCEEFGCLAINTGCVFGSCQDVIHPETKIYRKAVEEEVVLTVCINFPGNTFCTEINAIEPKITDEIELQFKTVDTKTLPNLLAVQNHKLYSGQINDLGSFSQGCGNVQKTNQSILGAGTVKFDYVCHGASRKDIIVRRCYTNNYDSCKLLKEERSLIFADNHETLEVANTRHLIGELQFKIMLGDIRYKAFAEKPELEIDAKCVGCPSCFESYSCSFQIVTSIDTVCSVEGPCTLFHNRIIITAAKQSYGVKMSCKTKPGPVEEFRICNRNYRVSFATIDKNDKIEINTGDQTSYIVEKDSRCKTWLCRVRDEGISVIFEPLKAFFGSYFSVAFYIIIGIAALFLIIYIFLPMFFKLRDVLKKNEYLYLQELKHK

SEQ ID NO: 1839 - protein, 1434 aa, Artificial Sequence
  derived and/or modified protein sequence (wt) from MAGV(BeAr 7272)__KX100104.1__GP
MELLIIILLLGSAASSPISTRCFHGGQLIAESKSATSISEFCLKDDVSMIKSEVTYIKNDTGIYGHNKVFRSWTIKDWKLCNPIPTAGGSINVIEVNSDLSLATRAYVCSRDCTITIDKEDAQIIFQTDKLNHFEVSGTTLSSGWFKTKASVTLDRTCEHIKVTCGKKSLQFHACFKHHMSCIRFFHHTILPGTMVSSMCQNIELIIIIGLTLVIFILMVILTKTYICYLLMPVFMPVAYIYGWAYNKSCKKCNCCGLAYHPFTNCGSHCVCGLKFEASDRMRLHRESGLCQGYKSLRIARMLCKSKGSSLVISGLLSMLLLSFITPIEGTLTNYPNEKQYTLEEIADVVEGIITEQHLKEYVVFYTSLFGGLILLLTLILSITINKVTDLLASTNVIYCEECSMYHSKKGIKYNGDFTNKCGFCTCSEQEDVEGVIIHKVSRKCTYKYQLKWVRVIMIILALLLTIQNTVLIVAAEVDCWTKKSIEIDCIGPLLNIGSCTDKSSRTYETEVNKLVRQSKVTHADAEQISILGSTLDNAIKAVRSQKTYETMHFLETVFLMKNCDYYNSFEHNSGYSQTKWRLIAKTSHFDICSRHSTHHFCRCVNEGTKCQNGDWDFAGEMNDTYNSKNDFYLHDLDLFYTLLENAFPGTTESLFYQLLQKKNTTGASKLLGKLITKYGNNNMFVEIWKFGQYLLKLPYINDTELSTDRKSTIIKSQQVLSRSQTGRQESLSSATPGTATKECSNAKDIGCISPRFGIPIGNLTACGDSPNYKVYKTPEKIYKSNNRGEVWCSDDVHCLTDFEPAEEEVVNRIKQMTCFLTDVTTKTDVFSVAISTCKMVDKGVCTVNDAKWNILKCNSGLYYFTDHRDGQDTGNDFGEYCISHSCNTERFPINPDVLKDCIWEYHSRKSKYISTVSLESLDEFRRAMSDKLSHTLMIYNFKPTANLPHIKPTYKFITANGIENSDGIDSAYILSSIPALGGMSVGYNIQTKDNFPLLDIIVFIKSAIIKTTYNHIYDTGPTIGINTQHDEHCTGPCPTLIPHKENWLTFSQERTSRWGCEEFGCLAINTGCVFGSCQDIIHPEAKVYRKAIEEEVVLTVCITFPGNTYCTEINAIEPKITDEIELQFKTVDTKTLPNLLMVQNHKLYSGQINDLGSFSQGCGNVQKTNQSVIGAGTAKFDYVCHGASRKDVIVRRCYNNNYESCKLLKEETSLIFADNHETLEVANTKHLIGELQFKIMLGDIRYKSFAESPELEVDAKCVGCPSCFESYSCNFQIVTNIDTVCSVDGPCTLFHNRLIISATKQSYGFKMSCPRKPEPTEEFQICNRKYNVLFTTIDKNDKIEINTGDQTSYIYEKDNRCKTWLCRVRDEGISVIFEPLKAFFGSYFSIIFYVVVGIIVLFLTIYIFLPMFFKLRDILKRNEYLYLQELKHK

SEQ ID NO: 1840 - protein, 1436 aa, Artificial Sequence
  derived and/or modified protein sequence (wt) from MAGV(CbaAr 426)__KX100110.1__GP
MKMILLIIILCVNLAAANPVATRCFHGGQLIAETRSATSISEFCLKDDVSMIKSEITYTKNDTGIFGHSKIYKSWLIKDWKLCNPVPTAGGSINVIEVNSDLSLTTKAYVCSRDCTITIDKEEAQIIFQTDKLNHFEVSGTTLSSGWFKTKASVTLDRTCEHIKVTCGKKTLQFHACFRHHMSCVRFFHNTILPGTMVNSMCQNIELIIILGLTLIIFTLMVILTKTYICYILMPLFMPIAYAYGWAYNKSCKKCNCCGLAYHPFTNCGSHCVCGLKFEASDRMRIHRESGLCQGYKSLRIARLLCKSKGSSLIISTLLSMLLLSFITPIEGTMTNYPETRQYSLEEIADVVEGLLSEQNIKEYVVFYTSLFGSLILLLAFILSITLTKVTNALARTNVIYCEECSMYHAKKGIKYNGDFTNKCGFCTCDEQEDEEGIIIHKVSKKCTYRYQLQWAKIIMIILVMLLMMQNTILIVAAETDCWTKNSLELDCIGPLLTISDCSNKESKNYEEEAAKLVSQSKITQADAEQVTILGNTIDTALKAIRSQKTYQTMHLLESVFLMKNCDYYSSFEHNSGYSQAKWRLIAKTSHFDICSRHSMHHFCRCVADGTKCQNGDWDFAGEMNNTYSTKNDFYLHDLNLFFTLHETAFPGTTESLFYQLIAKKNTTGASKLLGKLITKYGNSKLFVGIWKFGQYLLTLPYVNTTELSKTRRETILKTHQILTRSQGGRSESMSSAEVGQIAKECANAKNVGCISPRFGIPIGNLTACGNSPNYKIYKTPNKIYKSNNRGEVWCSEDVHCLADFEPADTEVVNKVKKMTCFLSDVNTRADIFSIAISACRMVDKGVCTVNGAKWNILKCESGLYYFTDHREGQDTGNDFGEYCISHSCNTERYPINPDILKECIWEYHSRKSKYISTINLESLEEFKRAMSDKLSHTLMVYNFKPTANLPHIKPSYKFITANGIENSDGLESAYILSSIPAIGGMSIGYNIQTKDNFPLLDLIVFVKSAVIKTTYNHIYDTGPTIGINTNHDEHCTGPCPTIIPHKENWLTFSQERTSRWGCEEFGCLAINTGCVFGSCQDVIHPETKIYRKAVEEEVVLTVCINFPGNTFCTEINAIEPKITDEIELQFKTVDTKTLPNLLAVQNHKLYSGQINDLGSFSQGCGNVQKTNQSILGAGTVKFDYVCHGASRKDIIVRRCYTNNYDSCKLLKEERSLIFADNHETLEVANTRHLIGELQFKIMLGDIRYKAFAEKPELEIDAKCVGCPSCFESYSCNFQIVTSIDTVCSVEGPCTLFHNRIIITAAKQSYGVKMSCKTKPGPVEEFTICNRNYRVSFATIDKNDKIEINTGDQTSYIVEKDSRCKTWLCRVRDEGISVIFEPLKAFFGSYFSIAFYIIIGIAALFLIIYIFLPMFFKLRDVLKKNEYLYLQELKHK

SEQ ID NO: 1841 - protein, 1434 aa, Artificial Sequence
  derived and/or modified protein sequence (wt) from MAGV(CoAr 3363)__KX100107.1__GP
MLSLLILAFLGLSTSNPIATRCFHGGQLIAESKSATSISEFCLKDDVSMLKSEVVYTKNDTGLFGHNKVFRSWTIKDWKLCNPIPTAGGTINVIEVNKDLSLMTKTYICSRDCTITIDKEEAQIIFQTDKLNHFEVSGTTLSSGWFKSKASVTLDRTCEHVKVTCGKKSLQFHACFKHHMSCVRFFHNTILPGNMITSMCQNIELIIILGLTLAIFILMVMLTKTYICYLLMPIFMPIAYLYGWAYNKSCKKCNCCGLAYHPFTNCGSHCVCGLKFEASDRMRIHRESGLCQGYKSLRIARLLCKSKGSSLVISGLLSMLILSFVTPIEGTITSYPESRKYTLEEITDVVEGLVSEQNIKEYIVFYTSLFGSLILLLAFIMSITLSKITSILARRNVIYCEECSMYHSKRGIKYNGDFTNKCGFCTCNEQEDAEGLVIHKVSKRCTYKCQLKWAKVLMITLVLLLIAQNTILIVAAKTDCWTKKSLDIDCIGPMLDIGSCTNKNTRSYDTEAQKLVTQSKVSQLDADQASLLGSSIDSAIKAIRTQKTYPTMHLLETIFLMKNCDYYTSFNHNSGYSQARWRLIAKTGHFDICSRHSTHHFCRCISDGTKCQNGDWDFAGEMNEPYNSKNDFYLHDLNLFYTIFENAFPGTTESLFYQLIQKRDTTGASKVLGKLITKYGNNNMFVGVWKFGQYLLTLPYINNTELSQNRKQTILATQEPLSRSHPGRQESMSSAIQGSVTKECHNAKDVGCISPRFGIPIGNLTACGDSPNYKIYKTPEKLYKSNNKGEVWCSNDVHCLNDFEPADEEVVNKVKKLTCFLTDVLVKTDIFSVAASTCKMADKGICTVNDAKWNIIKCDSGLYYFTDHREGQDTGNDFGEYCISHSCNTERFPINPDILKDCTWEFHSRKSKYISTISLESLEEFRRAMAEKLSHTLTIYNFKPTANLPHIRPTYKFITANGVENSDGIESAYILSSIPALSGISVGYNVQTKDNFPLLDIIVFIKSAVIRTTYNHIYDTGPTIGINTQHDEHCTGPCPAVVPHKENWITFSQERTSRWGCEEFGCLAINTGCVFGSCQDIIHPETKVYRKAVEEEVVLTVCINFPGNNYCTEINAIEPKITDEIELQFKTVDTKTLPNLLAVQNHKLYSGQINDLGSFSQGCGNVQKTNHSILGMGTAKFDYVCHGASRKDVIVRRCYNNNFDSCKLLKEETSLIFADNHETLEVAHTKHLIGELQFKIMLGDIRYKSFAESPELEIDAKCVGCPSCFESYSCNFQIVTNIDTVCSVEGPCTLFHNRIIISANKQSYGLKMSCQTKPNQNEEFIICNRKYSVLFTTIDKNDKIEVNTGDQTSYIYEKDSRCKTWLCRVRDEGISVLFEPLKAFFGSYFSIIFYVVIGIIVLFLIVYIFLPMFFKLKDVLKKNEYLYLQELKHK

SEQ ID NO: 1842 - protein, 1434 aa, Artificial Sequence
  derived and/or modified protein sequence (wt) from MAGV(OBS 6657)__KX100116.1__GP
MELLIIILLLGSAASSPVSTRCFHGGQLIAESKSATSISEFCLKDDVSMIKSEVTYTKNDTGIYGHNKVFRSWTIKDWKLCNPIPTAGGSINVIEVNSDLSLATKAYVCSRDCTITIDKEDAQIIFQTDKLNHFEVSGTTLSSGWFKTKASVTLDRTCEHIKVTCGKKSLQFHACFKHHMSCIRFFHHTILPGTMVSSMCQNIELIIIIGLTLVLFILMVILTKTYICYLLMPIFMPIAYIYGWAYNKSCKKCNCCGLAYHPFTNCGSHCVCGLKFEASDRMRIHRESGLCQGYKSLRIARMLCKSKGSSLVISGLLSMLLLSFITPIEGTLTNYPNERQYTLEEIADVVEGILTEQHLKEYVVFYTSLFGGLILLLTLILSITINKVTDLLASTNVIYCEECSMYHSKKGIKYNGDFTNKCGFCTCSEQEDIEGVVIHKVSRKCTYKYQLKWVRVIMIILALLLTLQNTVLIVAAEVDCWTKKSIEIDCIGPLLNIGTCTDKSSRTYETEVNKLVRQSKVTQADAEQVSILGSTLDSAIKAIRSQKTYETMHFLETVFLMKNCDYYSSFEHNSGYSQTKWRLIAKTSHFDICSRHSAHHFCRCVNEGTKCQNGDWDFAREMNDTYNSKNDFYLHDLDLFYTLFENAFPGTTESLFYQLLQKKNTTGASKLLGKLITKYGNNNLFVGIWKFGQYLLKLPYINDTELSTDRKSTIMKSQQMLSRSQTGRQESLSSATPGTATKECSNAKDIGCISPRFGIPIGNLTACGDSPNYKIYKTPEKIYKSNNKGEVWCSDDVHCLADFEPAEEEVVNRIKQMTCFLTDVTTKTDVFSVAISTCKMADKGVCTVNDAKWNILKCNSGLYYFTDHRDGQDTGNDFGEYCISHSCNTERFPINPDVLKDCIWEYHSRKSKYISTISLESLDEFRRAMSDKLSHTLMIYNFKPTANLPHIKPTYKFITANGIENSDGIDSAYILSSIPALGGMSVGYNVQTKDNFPLLDIIVFIKSAIIKTTYNHIYDTGPTIGINTQHDEHCTGPCPTLIPHKENWLTFSQERTSRWGCEEFGCLAINTGCVFGSCQDIIHPEAKVYRKAIEEEVVLTVCITFPGNTYCTEINAIEPKITDEIELQFKTVDTKTLPNLLMVQNHKLYSGQINDLGSFSQGCGNVQKTNQSVIGTGTAKFDYVCHGASRKDVIVRRCYNNNYESCKLLKEESSLIFADNHETLEVANTKHLIGELQFKIMLGDIRYKSFAESPELEVDAKCVGCPSCFESYSCNFQIVTNIDTVCSVDGPCTLFHNRLIISAAKQSYGLKMSCSRRPEQTEEFQICNRKYSVLFTTIDKNDKIEINTGDQTSYIYEKDNRCKTWLCRVRDEGISVIFEPLKAFFGSYFSIIFYVIVGIIVLFLIIYIFLPMFFKLRDILKRNEYLYLQELKHK

SEQ ID NO: 1843 - protein, 1433 aa, Artificial Sequence
  derived and/or modified protein sequence (wt) from NORV(0234)__EU004188.1__GP
MIWFILLLAIAPSFGTPIATRCFHGGQLIAEAKSQTSISEFCLKDDVSMIKSEVTYTKNDTGIFGHSKVYRSWTIKDWKLCNPVPTVGGSINVIEVTADLSLSTKAYVCSRDCTITIDKEGAQIVFQTDKLNHFEVSGTTLSSGWFKTKASVTLDRTCEHIKVTCGKKTLQFHACFKHHMSCIRFFHNTILPGSMVASMCQNIELIIILGLTLIIFILMAILTKTYICYLLMPIFMPIAYAYGWAYNKSCKKCHCCGLAYHPFTNCGSHCVCGLKFEASDRMRIHRESGLCQGYKSLRVARLLCKSKGSSLVISILLSMLILSFVTPIEGTLTNYPESRRYTLEEIADVVEGIIAEQDLKEYIVFYTSLFGSLILLLAFILSVTLTKVLDLLAKTNVIYCEECSMYHPRKGIKYNGDFTNKCGFCTCDEQEDVEGVIIHKVSKKCTYRYQVKWAKIIMIIVVILLMAQNTILIVAAETDCWTKKSLELDCIGPLLNIGSCSGKEARTYETEVKKLVSQSKVTHIDAEHISILGATIDSAIKSIRAQKTYATMHLLETVFLMKNCDYYTVFEHNSGYSQAKWRLIAKTNHFDICSRHSAHHFCRCINDETKCQNGNWDFAGEMNNTYSTKKDFYRHDLDLFYTIFENAFPGSTESLFYHLLQTKNTTGASRILEKLSTKFGNNNMFVGIWKFGQYLLTLPYVNETELSPSRQSTILTNSNSLSRSTGRQESLSSAIPGPNTKECSNARDVGCISPRFGIPIGNLTACGESPSYKIYKTPEKLYKSNNKGEIWCSDDVHCLKNFEPATEEIVNRIKQMTCFLTDVSTKTDIFSIATSTCRMVDKGVCTVNDAKWNILKCDSGLFYFTDQREGQDTGNDFGEYCISHSCNTERFPINPDILKDCTWEYHSRKSKYISTISLESLDEFRRAMSDKLSHTLMIYNFKPTANLPHIKPTYKFITANGIENSDGLDSAYIVSSIPALGGMSVGYNVQTKDNFPLLDIIVFIKSAVIRTTYNHIYDTGPTIGINTQHDEHCTGACPTQIPHKDNWLTFSQERTSRWGCEEFGCLAINTGCVFGSCQDIIHPETKVYRKAMEEEVILTVCVTFPGNTYCTEINAIEPKITDEIELQFKTVDTKTLPNILAVQNHKLYSGQINDLGSFSQGCGNVQKTNQSILGTGTAKFDYVCHGASRKDIIVRRCYNNNHDSCKLLKEETSLIFADNHETLVVANTKHLIGELQFKIMLGDIRYKSFAESPELEIDAKCVGCPSCFESYSCNFQIITNIDTVCSVSGPCTLFHNRLIITATKQSYGIKMSCPTKPEGTETFEICNKQYKIFFTTIDKNDKIEINTGDQTSYIYEKDNRCKTWLCRVRDEGISVLFEPLRAFFGSYFSIIFYAVVGIIILFLAVYIFLPMIFKLRDMLKKNEYLYLQESKHK

SEQ ID NO: 1844 - protein, 1434 aa, Artificial Sequence
  derived and/or modified protein sequence (wt) from PLAV(75V3066)__KX100122.1__GP
MLFLLILAFLGFSTSNPIATRCFHGGQLIAESKSATSISEFCLKDDVSMLKSEVVYIKNDTGLFGHNKVFRSWTIKDWKLCNPIPTAGGTINVIEVNKDLSLMTKTYICSRDCTITIDKEEAQIIFQTDKLNHFEVSGTTLSSGWFKSKASVTLDRTCEHVKVTCGKKSLQFHACFKHHMSCVRFFHNTILPGNMITSMCQNIELIIILGLTLAIFILMVMLTKTYICYLLMPIFMPIAYLYGWAYNKSCKKCNCCGLAYHPFTNCGSHCVCGLKFEASDRMRIHRESGLCQGYKSLRIARLLCKSKGSSLVISGLLSMLILSFVTPIEGTITSYPESRKYTLEEITDVVEGLVSEQNIKEYIVFYTSLFGSLILLLAFIMSITLSKITSILAKRNVIYCEECSMYHSKRGIKYNGDFTNKCGFCTCNEQEDTEGLVIHKVSKRCTYKYQLKWAKVLMITLVLLLIAQNTILIVAAETDCWTKKSLDIDCIGPMLDIGSCTNKNTRSYDAEAQKLVSQSKISQLDADQVSLLGNSIDSAIKAIRAQKTYPTMHLLETIFLMKNCDYYTNFNHNSGYSQAKWRLIAKTGHFDICSRHSTHHFCRCINDGTKCQNGDWDFAGEMNETYNSKNDFYSHDLNLFYTIFENAFPGTTESLFYQLIQKKNTTGASKVLGKLITKYGNNNMFVGVWKFGQYLLTLPYINNTELSQNRRLTILATQEILSRSHSGRQESMSNAIQGSITKECHNAKGVGCISPRFGIPIGNLTACGDSPNYKIYKTPEKLYKSNNKGEVWCSNDVHCLNDFEPADEEVINKIKKLTCFLTDVSVEVDIFSVAASTCKMADKGVCTVNGAKWNIIKCDSGLYYFTDHREGQDTGNDFGEYCISHSCNTERFPINPDTLKDCTWEFHSRKSKYISTISLESLEEFRRAMAEKLSHTLTIYNFKPTANLPHIRPTYKFITANGVENSDGIESAYILSSIPALGGISVGYNVQTKDNFPLLDIIVFIKSAVIRTTYNHIYDTGPTIGINTQHDEHCTGPCPAVVPHKENWMTFSQERTSRWGCEEFGCLAINTGCVFGSCQDIIHPETKVYRKAVEEEVVLTVCINFPGNSYCTEINAIEPKITDEIELQFKTVDTKTLPNLLAVQNHKLYSGQINDLGSFSQGCGNVQKTNHSILGMGTVKFDYVCHGASRKDVTVRRCYNNNFDSCKLLKEETSLIFADNHETLEVAHTKHLIGELQFKIMLGDIRYKSFAESPELEIDAKCVGCPSCFESYSCNFQIVTNIDTVCSVEGPCTLFHNRIIISANKQSYGLKMSCQTKPNQNEEFIICNRKYSVLFTTIDKNDKIEVNTGDQTSYIYEKDSRCKTWLCRVRDEGISVLFEPLKAFFGSYFSIIFYVVVGIIVLFLIVYIFLPMFFKLKDVLKRNEYLYLQELKHK

SEQ ID NO: 1845 - protein, 1434 aa, Artificial Sequence
  derived and/or modified protein sequence (wt) from PLAV(75V5758)__KX100128.1__GP
MELLIIILLLGSAASSPVSTRCFHGGQLIAESRSATSISEFCLKDDVSMIKSEVTYTKNDTGIYGHNKVFRSWTIKDWKLCNPIPTAGGSINVIEVNSDLSLATKAYVCSRDCTITIDKEDAQIIFQTDKLNHFEVSGTTLSSGWFKTKASVTLDRTCEHIKVTCGKKSLQFHACFKHHMSCIRFFHHTILPGTMVSSMCQNIELIIIIGLTLAIFILMVILTKTYICYLLMPVFMPIAYIYGWAYNKSCKKCNCCGLAYHPFTNCGSHCVCGLKFEASDRMRIHRESGLCQGYKSLRIARMLCKSKGSSLVISGLLSMLLLSFITPIEGTLTNYPNEKQYTLEEIADVVEGIMTEQHLKEYVVFYTSLFGGLILLLTLILSITINKVTDLLASTNVIYCEECSMYHSKKGIKYNGDFTNKCGFCTCSEQEDVEGVVIHKVSRKCTYKYQLKWVRVIMIILALLLTIQNTVLIVAAEVDCWTKKSIEIDCIGPLLNIGSCTDKSGKTYETEVNKLVRQSKVTQADAEQISVLGNTLDSAIKAIRSQKTYETMHFLETVFLMKNCDYYSSFEHNSGYSQTKWRLIAKTSHFDICSRHSAHHFCRCVNEGTKCQNGDWDFAGEMNNTYNSKNDFYLHDLDLFYTLFENAFPGTTESLFYQLLQKKNTTGASKLLGKLITKYGNNNMFVGIWKFGQYLLKLPYINDTELSADRKSTIMKSQQVLSRSQTGRQESLSSATPGTATKECSNAKDIGCISPRFGIPIGNLTACGDSPNYKIYKTPEKIYKSNNKGEVWCSDDVHCLADFEPAEEEVVNRIKQMTCFLTDVTTKTDVFSIAVSTCKMVDKGVCTVNDAKWNILKCNSGLYYFTDHRDGQDTGNDFGEYCISHSCNTERFPINPDVLKDCIWEYHSRKSKYISTISLESLDEFRRAMSDKLSHTLMIYNFKPTANLPHIKPAYKFITANGIENSDGIDSAYILSSIPALGGMSVGYNVQTKDNFPLLDIIVFIKSAIIKTTYNHIYDTGPTIGINTQHDEHCTGPCPTLIPHKENWLTFSQERTSRWGCEEFGCLAINTGCVFGSCQDIIHPEAKVYRKAIEEEVVLTVCITFPGNTYCTEINAIEPKITDEIELQFKTVDTKTLPNLLMVHNHKLYSGQINDLGSFSQGCGNVQKTNQSVIGAGTVKFDYVCHGASRKDVIVRRCYNNNYESCKLLKEETSLIFADNHETLEVANTKHLIGELQFKIMLGDIRYKSFAESPELEVDAKCVGCPSCFESYSCNFQIVTNIDTVCSVNGPCTLFHNRLIISATKQSYGLKMSCSRKPEPTEEFQICNRKYSVLFTTIDKNDKIEINTGDQTSYIYEKDNRCKTWLCRVRDEGISVIFEPLKAFFGSYFSIIFYVIVGIIVLFLIVYIFLPMFFKLRDILKRNEYLYLQELKHK

SEQ ID NO: 1846 - protein, 1438 aa, Artificial Sequence
  derived and/or modified protein sequence (wt) from POTV(89-3380)__EU004189.1__GP
MEPPMKLFLILATAVAAVYSLPASRCFSDGIIIKEKQDSKAVSEFCLKDDVSMIKSHVVYSKNESGIFANSQILRKWIIKDWKLCSPLPTAGGQINVIEINHDLTLSTKTYVCTTDCTIGIDKENAQITFQTNKLNYFEVSGTTISSGWFKSKTSVSLDQTCEHLKVSCGKKSMQFHACFKQHMSCIRYLHKTALPGYMAASICSNIELIIMTTLTLAIFILLCIITKTYICYLLMPLFMPIAYIYGWLYNKSCKKCNCCGLSYHPFTNCGSYCVCGAKFETSDRMRIHRESGLCQGYKSLRVARKLCKSKGSSLVISVTLSVFIFSFITPIGGVIINDKLSEEKYSINQMMDAIVDLENFSHNVSGTQQVISVIFLLISCLFLLLTYRLNKIIQHLARSGLLFCEECSMYHSKKDIKYNGDFTNKCGFCTCGQPEDPEGLNLHILSQNCTYKQQFKWVKIIISILLSLIIIESSMILAAAETDCFSEKQISEFCLGPLLSISSCEDKNSRTFKGEAQKLVALKKITSDEAMLIESMGAKVEDALKMIQAQKSPDSMYTMEYVFLNTYCDYYSLFEHNSGYSQIKWRYILKTHQFDACARHSNNHFCRCMSDGMHCPSLDWDIADELNNTYITKPNFFKHDYNLLLDVITAAFPGTGAVFVIDACKKANATAIKTFSNNIIARFPYNNLLKGVMKFLQYISKHPSFKKYQPDTRHYDLIPVAPTARGRSLGRSNSYSDAQVGPPTKDCQKLKEVGCLSPKFGLPLESIISCGSSPNYKLYKKPQKYYKSNNKENTWCSKDVHCLHDFEPITEDVLEKVKVMTCWEIEPGTIEDIFTIASETCKINDRGVCEVNAAKWKIVKCETGLYYYTDHREGDDTGSDLGHYCLTHKCAGGRYPINPEILQNCIWEFHSQKSQYINQVDLEQIEEYKKALTEKLTHTLNHYNFLPTKNLPHISPNYKYVTLNGQETSDGIENSYIVSEIPAIAGTSIGLKVQTKNNGNIFDLIIYVKRADIIASYNHIYDTGPTIGHNVEHEELCTGQCPQHIPAKANWLTFSQERTSRWGCEEFGCLAINTGCVYGSCQDIIKPVAKVYRKSTEEKVELELCIVLPDRNFCTTLNALEPKITEEIELQFKTIDQVSLPNIVLLRDHKLFKGQINDLGTFGQNCGNVQKTNQSILGAGTVRFDYLCHSASRKDIIIRRCYNNNYDSCNHLQLAESLIFLDNHETLEVRKPNHILGTLSMKLMLGDFQYKTFAKDIELDFTGRCVGCIGCFEGFVCEMHITTTVEATCNLEASCQFFHNQLHIKPDVLKYYTKMTCQTDEYIPSKIKICNKEYKITIGKVRKNDKIEIDNSDQTSYIKEKDERCKTWLCRVRDEGISVIFEPLLNIFGNYGRIAVAVISAILALIVLVYILMPICMKIRDILKTNEKEFLIESKYK

SEQ ID NO: 1847 - protein, 1436 aa, Artificial Sequence
  derived and/or modified protein sequence (wt) from TENV(TSV-FE3-66FB)__FJ943508.1__GP
MEIFFIALLAIANSVNSTPLATRCFHGGQLIAESKSATSLSEFCLKDDVSMIKSEIYYVKNETGIFSHNKVLRSWTIKDWKFCNPVPTAGGSINVIEVNSDMSLATKTYVCSRDCTITIDREEAQIIFQTEKLNHFEVSGTTLSSGWFKSKASVTLDRTCEHLKVTCGKKSLQFHACFKHHMSCIRFFHNTMLPGRIVNSMCQNIELIIILGLTIVIFILMVILTKTYICYILMPLFMPIAYIYGWAYNKSCKKCNCCGLAYHPFTNCGSHCVCGLKFEASDRMRIHRESGLCQGYKSLRIARLLCKSKGSSLVISILLSMLLLSFVTPIEGALTNYPQSKLYSLEEIADVVEGLITEHNVKEYIVFYTSLFGGLILLLAFILSIMLTKVTSMLARTNVIYCEECSMYHSKTGIKYNGDFTNKCGFCTCDEQEDAEGIIIHKVSKKCTYKYQLKWARIIMIILIVLLTTQNTILIVAAEVDCWERATLSQECIGPLQKIEDCQNKEEKTYMSEANKLVSQSKITQADADQVSVLGDTIDSAIKAIRSQKTYQTMHLLETVFLMKNCDYYSTFEHNSGYSQAKWRLMAKTNHFDICSRHSNHHFCRCVTEGTKCQNGDWDFAGEMNSTYNTKSDFYQHDLNLFFSLYESAFPGTAESLFYQLISEKNTTGASQLLGQIIKKFANNNMLIGVWKFGQYLLTLPYVNTTKLSKSREETILTNHQRLVRSYTGRQQSMANAEVGESTKNCLNAKNVGCISPRFGVPIGNLTVCGESTNYKVYKTPAKIYKSNNRPKTWCSEDVHCLSNFEPASAEVVNKIKRMTCFLTDVTTNVDVFSIAISTCKMADKGVCTVNDARWSILKCDSGLLYFTDHREGQDTGNDFGEYCISHNCNTERYPINPDIIKDCIWEYHSRKSKYISAINLESLEEFRRAMSEKLSHTLVIYNFKPTANLPHIKPSYKSITVNGIENSDGIESAYILSNIPAIGGMSVGYNVLTKDGFPLLDIIIFIKSAVIKTTYNHIYDTGPTIGINTLHDEKCTGPCPSIIPHKENWLTFSQERTSRWGCEEFGCLAINTGCVFGSCQDIIRPETKIYRKAVEEEVILNACINFPGNTYCTEINAIEPKITDEIELQFKTVDTKTLPNLLAVQNHKLYSGQINDIGTFSQGCGNVQKTNQTMLGTGTVRFDYVCHGASRKDIIVRRCYNNNYESCKLLKEEKSLIFADNHETLEVANTRHLLGELQFKIMLGDIRYKAFAEKPELEIDAKCVGCPSCFESYSCNFQIVSNVDTVCYIEGPCTLFHNRIIIKTMKQAYGIKMSCKTKPAPSEEFKICGRTYNVAFNTVEKNDKIEINTGDQTSYISEKDDRCKTWLCRVRDEGISVIFEPLKNLFGNYFNIAFYIIIGLIALFLTIYIFLPMFFKLRDVLKRNEYLYLQELKHK

SEQ ID NO: 1848 - protein, 1436 aa, Artificial Sequence
  derived and/or modified protein sequence (wt) from TENV(TSV-FL06)__FJ943506.1__GP
MEIFFIALLAIASSVNSTPLATRCFHGGQLIAESKSATSLSEFCLKDDVSMIKSEIYYVKNETGIFSYNKVLRSWTIKDWKFCNPVPTAGGSINVIEVNSDMSLATKTYVCSRDCTITIDREEAQIIFQTEKLNHFEVSGTTLSSGWFKSKASVTLDRTCEHLKVTCGKKSLQFHACFKHHMSCIRFFHNTMLPGRIVNSMCQNIELIIILGLTIVIFILMVILTKTYICYILMPLFMPVAYIYGWAYNKSCKKCNCCGLAYHPFTNCGSHCVCGLKFEASDRMRIHRESGLCQGYKSLRIARLLCKSKGSSLVISILLSMLLLSFVTPIEGALTNYPQSKLYSLEEIADVVEGLITEHNVKEYIVFYTSLFGGLILLLAFILSIMLTKVTSMLARTNVIYCEECSMYHSKTGIKYNGDFTNKCGFCTCDEQEDAEGIIIHKVSKKCTYKYQLKWARIIMIILIVLLTTQNTILIVAAEVDCWERATLSHECIGPLQKIEDCQNKEEKTYMSEANKLVSQSKITQADADQVSVLGDTIDSAIKAIRSQKTYQTMHLLETVFLMKNCDYYSTFEHNSGYSQAKWRLMAKTNHFDICSRHSNHHFCRCVTEGTKCQNGDWDFAGEMNSTYNTKSDFYQHDLNLFFSLYESAFPGTAESLFYQLISEKNTTGASQLLGQIIKKFANNNMLIGVWKFGQYLLTLPYVNTTKLSKSREETTLTNHQRLVRSYTGRQQSMANAEVGESTKNCLNAKNVGCISPRFGVPIGNLTVCGESTNYKVYKTPAKIYKSNNRPKTWCSEDVHCLSNFEPASAEVVNKIKRMTCFLTDVTTNVDVFSIAISTCKMADKGVCTVNDARWSILKCDSGLLYFTDHREGQDTGNDFGEYCISHNCNTERYPINPDIIKDCIWEYYSRKSKYISAINLESLEEFRRAMSEKLSHTLVIYNFKPTANLPHIKPSYKSITVNGIENSDGIESAYILSNIPAIGGMSVGYNVLTKDGFPLLDIIIFIKSAVIKTTYNHIYDTGPTIGINTLHDEKCTGPCPSIIPHKENWLTFSQERTSRWGCEEFGCLAINTGCVFGSCQDIIRPETKIYRKAVEEEVILNACINFPGNTYCTEINAFEPKITDEIELQFKTVDTKTLPNLLAVQNHKLYSGQINDIGTFSQGCGNVQKTNQTMLGTGTVRFDYVCHGASRKDIIVRRCYNNNYESCKLLKEEKSLIFADNHETLEVANTRHLLGELQFRIMLGDIRYKAFAEKPELEIDAKCVGCPSCFESYSCNFQIVSNVDTVCYIEGPCTLFHNRVIIKTMKQAYGIKMSCKTKPAPSEEFKICGRTYNVAFNTVEKNDKIEINTGDQTSYISEKDDRCKTWLCRVRDEGISVIFEPLKNLFGNYFNIAFYIIIGLIALFLTIYIFLPMFFKLRDVLKRNEYLYLQELKHK

SEQ ID NO: 1849 - protein, 1434 aa, Artificial Sequence
  derived and/or modified protein sequence (wt) from TLAV(61D240)__KX100119.1__GP
MLFLLILAFLGFSTSNPIATRCFHGGQLIAESKSATSISEFCLKDDVSMLKSEVVYTKNDTGLFGHNKVFRSWTIKDWKLCNPIPTAGGTINVIEVNKDLSLMTKTYICSRDCTITIDKEEAQIIFQTDKLNHFEVSGTTLNSGWFKSKASVTLDRTCEHVKVTCGKKSLQFHACFKHHMSCVRFFHNTILPGNMITSMCQNIELIIILGLTLAIFILMVMLTKTYICYLLMPIFMPIAYLYGWAYNKSCKKCNCCGLAYHPFTNCGSHCVCGLKFEASDRMRIHRESGLCQGYKSLRIARLLCKSKGSSLVISGLLSMLILSFVTPIEGTITSYPESRKYTLEEITDVVEGLVSEQNIKEYIVFYTSLFGSLILLLAFIMSITLSKITSILARRNVIYCEECSMYHSKRGIKYNGDFTNKCGFCTCNEQEDAEGLVIHKVSKRCTYKYQLKWAKVLMVTLVLLLIAQNTILIVAAGTDCWTKKSLDIDCIGPMLDIGSCTNKNTRNYDTEAQKLVSQSKVSQLDADQASLLGNSIDSAIKAIRAQKTYPTMHLLETIFLMKNCDYYTSFNHNSGYSQAKWRLIAKTGHFDICSRHSTHHFCRCINDGTKCQNGDWDFAGEMNETYNSKNDFYSHDLNLFYTIFENAFPGTTESLFYQLIQKKNTTGASKILGKLITKYGNKNMFVGVWKFGQYLLTLPYINNTELSQNRRQTILATQESLSRSHSGRQESMSSAIQGSVTKECHNAKDVGCISPRFGIPIGNLTACGDSPNYKIYKTPEKLYKSNNKGEVWCSNDVHCLNDFEPADEEVVNKVKKLTCFLTDVSVKTDIFSVAASTCKMADKGVCTVNDAKWNIIKCDSGLYYFTDHREGQDTGNDFGEYCISHSCNTERFPINPDILKDCTWEFHSRKSKYISTISLESLEEFRRAMTEKLSHTLTIYNFKPTANLPHIRPTYKFITANGVENSDGIESAYILSSIPALGGISVGYNVQTKDNFPLLDIIVFIKSAVIRTTYNHIYDTGPTIGINTQHDEHCTGPCPAVVPHKENWITFSQERTSRWGCEEFGCLAINTGCVFGSCQDIIHPETKVYRKAVEEEVILTVCINFPGNNYCTEINAIEPKITDEIELQFKTVDTKTLPNLLAVQNHKLYSGQINDLGSFSQGCGNVQKTNHSILGMGTAKFDYVCHGASRKDVIVRRCYNNNFDSCKLLKEETSLIFADNHETLEVAHTKHLIGELQFKIMLGDIRYKSFAESPELEIDAKCVGCPSCFESYSCNFQIVTNIDTVCSVEGPCTLFHNRIIISANKQSYGLKMSCQTKPNQNEEFIICNRKYSVLFTTIDKNDKIEVNTGDQTSYIYEKDSRCKTWLCRVRDEGISVLFEPLKAFFGSYFSIIFYVVVGIIVLFLIIYIFLPMFFKLKDVLKRNEYLYLQELKHK

SEQ ID NO: 1850 - protein, 1434 aa, Artificial Sequence
  derived and/or modified protein sequence (wt) from NRIV(9800535)__AY593725.1__GP
MLLLLVLLIPCYVSASPVVTRCFHGGQLIAEKKSQTAVSEFCLKDDVSTIKSEITYEKNNTGLFAHSKVLRNWIIKDWKNCNPVPTAGGSINVIEVNTDLSLTTKTYVCSRDCTITVDKEDAQIIFQTEKLNHFEVSGTTLSSGWFKTKASVTLDRTCEHIKVTCGKKTLQFHACFKHHMSCIRFFHGTILPGTMATSICQNIELIIIISLTLIIFILMIILTKTYICYLLMPLFMPIAYFYGWSYNKSCKKCSCCGLAYHPFTNCGSHCVCGLKFEASDRMRIHRESGLCQGYKSLRVARLLCKSKGSSLVISILLSMLILSFVTPIEGTLTNYPESRKYDLEEIADVLEGFIVEKGIKEYVVFYTSIFGALLLLIALVITITLNKVTEYLTNINVLYCYECSMYHSKKNIKYIGDFTNKCGFCTCGELEDQEGLKIHKVSRKCIYKYQLTWSKIIMTILVCLLIAQNTILIVAASDDCWTKKSLEMECIGPLQQVDTCDDKASRSYSGEARKLVRASKISDLDAAQVGLLGSTIESAIASIRKQRTYPTMHLLESVFLGKHCDYYKTFEHNSGYSQAKWRLTAKTHHFDICSRHSTHHFCRCISDGTKCQNGDLDFAGEMNSTYQSKKDFFEHDFKLFCTLVENAFPGTTESLFYEMLSKKNTTGIKQLLDKLTRKFGNNNMFVGIWKFGQYLMSLPYINETSLTPAQISKILEVTDQHHRSISGRQESLASATPGSKSKECGHAKKVSCISPRFSVPMEGLMACGDSPNYKIYKTPTKLYKSNNKGEVWCSGDVHCSQELSPASQESVDRIKQITCFLTEPEVSDDVFSIAISTCKVQDKGVCTVNEDRWNVIKCDSGLIYYTDQRDGQDTGNDFGEYCLSHSCRIERFPINPAIIRDCLWEYHSRKSKYITSLDLENLEEFKRAISEKLSHTLIVYNFKPTANLPHIKPVYKYITVQGVENSDGVDSAYIAASMPALSGTSIGYNIMSRDNFPLFDIIIFIKSAIIKATYNHIYDTGPTIGINVMHDEHCTGQCPTDIPHKENWITFAQERTSRWGCEEFGCLAVNTGCVFGSCQDIIRPETKVYRKAVEESVLLTVCITYPGKTFCTEINAIEPKITDELELQFKTVDTKTLPNILAVQNHKLYSGQINDLGSFSQGCGNIQRTNSSIIGTGTAKFDYVCHGASRKDIIVRRCYNNNYESCKLLKEEQSLMFADNHETIDVANVRHLLGDLQFKLMLGDLRYKSFAENPDLEIEAKCVGCPSCFTSYSCSFKIASNIDTVCSIEGPCTTFHNRLMITSTKQDYGIKMSCKTKPKETEEFQICKKTYTVLFTTVEKNDKIEISTGDQTSFIQERDDRCKTWLCRVRDEGISVIFEPIRAFFGSYFSIAFYVVISIIVLFLAIYIFLPMVFKLRDVLKRNEYLYLQEIKHK

SEQ ID NO: 1851 - protein, 1434 aa, Artificial Sequence
  derived and/or modified protein sequence (wt) from NRIV(GSA/TS7/5170/WT)__KM514677.1__GP
MLLLLVLLIPCYVSASPVVTRCFHGGQLIAEKKSQTAVSEFCLKDDVSTIKSEITYERNNTGLFAHSKVLRNWIIKDWKNCNPVPTAGGSINVIEVNTDLSLTTKTYVCSRDCTITVDKEDAQIIFQTEKLNHFEVSGTTLSSGWFKTKASVTLDRTCEHIKVTCGKKTLQFHACFKHHMSCIRFFHGTILPGTMATSICQNIELIIIISLTLIIFILMVILTKTYICYLLMPLFMPIAYFYGWSYNKSCKKCSCCGLAYHPFTNCGSHCVCGLKFEASDRMRIHRESGLCQGYKSLRVARLLCKSKGSSLVISILLSMLILSFVTPIEGTLTNYPESRKYDLEEIADVLEGFIVEKGIKEYVVFYTSIFGALLLLMALVITITLNKVTEYLTNINVLYCHECSMYHSKKNIKYIGDFTNKCGFCTCGELEDQEGLKIHKVSRKCIYRYQLTWSKIIMTILVCLLIAQNTILIVAASDDCWTKKSLEMECIGPLQQVDTCDDKASRSYSGEAKKLVRASKISDLDAAQVGLLGSTIESAIASIRKQRTYPTMHLLESVFLGKHCDYYKTFEHNSGYSQAKWRLTAKTHHFDICSRHSTHHFCRCISDGTKCQNGDWDFASEMNSTYQSKKDFFEHDFKLFCTLVENAFPGTTESLFYEMLSKKNTTGIKNLLDKLTRKFGNNNMFVGIWKFGQYLISLPYVNETSLTPAQVSKILEVTDQHHRSISGRQESLASATSGSKSKECGHAKKVSCISPRFSVPMEGLMACGDSPNYKIYKTPAKLYKSNNKGEVWCSGDVHCSQELSPASQESVDRIKQITCFLTEPEVSDDVFSIAISTCKVQDKGVCTVNEDRWNVIKCDSGLIYYTDQRDGQDTGNDFGEYCLSHSCRIERFPINPTIISDCLWEYHSRKSKYITSLDLENLEEFKRAISEKLSHTLIVYNFKPTANLPHIKPVYKYITVQGVENSDGVDSAYISASMPALSGTSIGYNIMSRDNFPLFDIIIFIKSAIIKATYNHIYDTGPTIGINVMHDEHCTGQCPTDIPHKENWITFAQERTSRWGCEEFGCLAVNTGCVFGSCQDIIRPETKVYRKAVEESVLLTVCITYPGKTFCTEINAIEPKITDELELQFKTVDTKTLPNILAVQNHKLYSGQINDLGSFSQGCGNIQKTNSSIIGTGTAKFDYVCHGASRKDIIVRRCYNNNYESCKLLKEEQSLMFADNHETIDVANVRHLLGDLQFKLMLGDLRYKSFAENPDLEIEAKCVGCPSCFTSYSCSFKIASNIDTVCSIEGPCTTFHNRLMITSTKQDYGIKMSCKTKPKETEEFQICKKTYTVLFTTVEKNDKIEISTGDQTSFIQERDDRCKTWLCRVRDEGISVIFEPIRAFFGSYFSIAFYVVVIIIVLFLAIYIFLPMVFKLRDVLKRNEYLYLQEIKHK

SEQ ID NO: 1852 - protein, 1434 aa, Artificial Sequence
  derived and/or modified protein sequence (wt) from NRIV(TND/S1/19801/WT)__KM514679.1__GP
MLLLLVLLIPCYVSASPVVTRCFHGGQLIAEKKSQTAVSEFCLKDDVSTIKSEITYERNNTGLFAHSKVLRNWIIKDWKNCNPVPTAGGSINVIEVNTDLSLTTKTYVCSRDCTITVDKEDAQIIFQTEKLNHFEVSGTTLSSGWFKTKASVTLDRTCEHIKVTCGKKTLQFHACFKHHMSCIRFFHGTILPGTMATSICQNIELIIIISLTLIIFILMVILTKTYICYLLMPLFMPIAYFYGWSYNKSCKKCSCCGLAYHPFTNCGSHCVCGLKFEASDRMRIHRESGLCQGYKSLRVARLLCKSKGSSLVISILLSMLILSFVTPIEGTLTNYPESRKYDLEEIADVLEGFIVEKGIKEYVVFYTSIFGALLLLMALVITITLNKVTEYLTNINVLYCHECSMYHSKKNIKYIGDFTNKCGFCTCGELEDQEGLKIHKVSRKCIYRYQLTWSKIIMTILVCLLIAQNTILIVAASDDCWTKKSLEMECIGPLQQVDTCDDKASRSYSGEAKKLVRASKISDLDAAQVGLLGSTIESAIASIRKQRTYPTMHLLESVFLGKHCDYYKTFEHNSGYSQAKWRLTAKTHHFDICSRHSTHHFCRCISDGTKCQNGDWDFASEMNSTYQSKKDFFEHDFKLFCTLVENAFPGTTESLFYEMLSKKNTTGIKNLLDKLTRKFGNNNMFVGIWKFGQYLISLPYVNETSLTPAQVSKILEVTDQHHRSISGRQESLASATSGSKSKECGHAKKVSCISPRFSVPMEGLMACGDSPNYKIYKTPAKLYKSNNKGEVWCSGDVHCSQELSPASQESVDRIKQITCFLTEPEVSDDVFSIAISTCKVQDKGVCTVNEDRWNVIKCDSGLIYYTDQRDGQDTANDFGEYCLSHSCRIERFPINPTIISDCLWEYHSRKSKYITSLDLENLEEFKRAISEKLSHTLIVYNFKPTANLPHIKPVYKYITVQGVENSDGVDSAYISASMPALSGTSIGYNIMSRDNFPLFDIIIFIKSAIIKATYNHIYDTGPTIGINVMHDEHCTGQCPTDIPHKENWITFAQERTSRWGCEEFGCLAVNTGCVFGSCQDIIRPETKVYRKAVEESVLLTVCITYPGKTFCTEINAIEPKITDELELQFKTVDTKTLPNILAVQNHKLYSGQINDLGSFSQGCGNIQKTNSSIIGTGTAKFDYVCHGASRKDIIVRRCYNNNYESCKLLKEEQSLMFADNHETIDVANVRHLLGDLQFKLMLGDLRYKSFAENPDLEIEAKCVGCPSCFTSYSCSFKIASNIDTVCSIEGPCTTFHNRLMITSTKQDYGIKMSCKTKPKETEEFQICKKTYTVLFTTVEKNDKIEISTGDQTSFIQERDDRCKTWLCRVRDEGISVIFEPIRAFFGSYFSIAFYVVVIIIVLFLAIYIFLPMVFKLRDVLKRNEYLYLQEIKHK

SEQ ID NO: 1853 - protein, 1434 aa, Artificial Sequence
  derived and/or modified protein sequence (wt) from NRIV(9800521)__JX857326.1__GP
MLLLLVLLIPCYVSASPVVTRCFHGGQLIAEKKSQTAVSEFCLKDDVSTIKSEITYEKNNTGLFAHSKVLRNWIIKDWKNCNPVPTAGGSINVIEVNTDLSLTTKTYVCSRDCTITVDKEDAQIIFQTEKLNHFEVSGTTLSSGWFKTKASVTLDRTCEHIKVTCGKKTLQFHACFKHHMSCIRFFHGTILPGTMATSICQNIELIIIISLTLIIFILMIILTKTYICYLLMPLFMPIAYFYGWSYNKSCKKCSCCGLAYHPFTNCGSHCVCGLKFEASDRMRIHRESGLCQGYKSLRVARLLCKSKGSSLVISILLSMLILSFVTPIEGTLTNYPESRKYDLEEIADVLEGFIVEKGIKEYVVFYTSIFGALLLLMALVITITLNKVTEYLTNINVLYCHECSMYHSKKNIKYIGDFTNKCGFCTCGELEDQEGLKIHKVSRKCIYKYQLTWSKIIMTILVCLLIAQNTILIVAASDDCWTKKSLEMECIGPLQQVDTCDDKASRSYSGEARKLVRASKISDLDAAQVGLLGSTIESAIASIRKQRTYPTMHLLESVFLGKHCDYYKTFEHNSGYSQAKWRLTAKTHHFDICSRHSTHHFCRCISDGTKCQNGDWDFAGEMNSTYQSKKDFFEHDFKLFCTLVENAFPGTTESLFYEMLSKKNTTGIKQLLDKLTRKFGNNNMFVGIWKFGQYLMSLPYVNEASLTPAQISKILEVTDQHHRSISGRQESLASATPGSKSKECGHAKKVSCISPRFSVPMEGLMACGDSPNYKIYKTPTKLYKSNNKGEVWCSGDVHCSQELSPASQESVDRIKQITCFLTEPEVSDDVFSIAISTCKVQDKGVCTVNEDRWNVIKCDSGLIYYTDQRDGQDTGNDFGEYCLSHSCRIERFPINPAIIRDCLWEYHSRKSKYITSLDLENLEEFKRAISEKLSHTLIVYNFKPTANLPHIKPVYKYITVQGVENSDGVDSAYIAASMPALSGTSIGYNIMSRDNFPLFDIIIFIKSAIIKATYNHIYDTGPTIGINVMHDEHCTGQCPTDIPHKENWITFAQERTSRWGCEEFGCLAVNTGCVFGSCQDIIRPETKVYRKAVEESVLLTVCITYPGKTFCTEINAIEPKITDELELQFKTVDTKTLPNILAVQNHKLYSGQINDLGSFSQGCGNIQRTNSSIIGTGTAKFDYVCHGASRKDIIVRRCYNNNYESCKLLKEEQSLMFADNHETIDVANVRHLLGDLQFKLMLGDLRYKSFAENPDLEIEAKCVGCPSCFTSYSCSFKIATNIDTVCSIEGPCTTFHNRLMITSTKQDYGIKMSCKTKPKETEEFQICKKTYTVLFTTVEKNDKIEISTGDQTSFIQERDDRCKTWLCRVRDEGISVIFEPIRAFFGSYFSIAFYVVISIIVLFLAIYIFLPMVFKLRDVLKRNEYLYLQEIKHK

SEQ ID NO: 1854 - protein, 1434 aa, Artificial Sequence
  derived and/or modified protein sequence (wt) from NRIV(Adrar)__KJ716849.1__GP
MLLLLVLLIPCYVSASPVVTRCFHGGQLIAEKKSQTAVSEFCLKDDVSTIKSEITYEKNNTGLFAHSKVLRNWIIKDWKNCNPVPTAGGSINVIEVNTDLSLTTKTYVCSRDCTITVDKEDAQIIFQTEKLNHFEVSGTTLSSGWFKTKASVTLDRTCEHIKVTCGKKTLQFHACFKHHMSCIRFFHGTILPGTMATSICQNIELIIIISLTLIIFILMVILTKTYICYLLMPLFMPIAYFYGWSYNKSCKKCSCCGLAYHPFTNCGSHCVCGLKFEASDRMRIHRESGLCQGYKSLRVARLLCKSKGSSLVISILLSMLILSFVTPIEGTLTNYPESRKYDLEEIADVLEGFIVEKGIKEYVVFYTSIFGALLLLMALVITITLNKVTEYLTNINVLYCHECSMYHSKKNIKYIGDFTNKCGFCTCGELEDQEGLKIHKVSRKCIYKYQLTWSKIIMTILVCLLIAQNTILIVAASDDCWTKKSLEMECIGPLQQVDTCDDKASRSYSGEAKKLVRASKISDLDAAQVGLLGSTIESAIASIRKQRTYPTMHLLESVFLGKHCDYYKTFEHNSGYSQAKWRLTAKTHHFDICSRHSTHHFCRCISDGTKCQNGDWDFAGEMNSTYQSKKDFFEHDFKLFCTLVENAFPGTTESLFYEMLSKKNTTGIKKLLDKLTRKFGNNNMFVGIWKFGQYLISLPYVNETSLTPAQVSKILEVTDQHHRSISGRQESLASATPGSKSKECGHAKKVSCISPRFSVPMEGLMACGDSPNYKIYKTPAKLYKSNNKGEVWCSGDVHCSQELSPASQESVDRIKQITCFLTEPEVSDDVFSIAISTCKVQDKGVCTVNEDRWNVIKCDSGLIYYTDQREGQDTGNDFGEYCLSHSCRIERFPINPAIISDCLWEYHSRKSKYITSLDLENLEEFKRAISEKLSHTLIVYNFKPTANLPHIKPIYKYITVQGVENSDGVDSAYIAASMPALSGTSIGYNIMSRDNFPLFDIIIFIKSAIIKATYNHIYDTGPTIGINVMHDEHCTGQCPTDIPHKENWITFAQERTSRWGCEEFGCLAVNTGCVFGSCQDIIRSETKVYRKAVEESVLLTVCITYPGKTFCTEINAIEPKITDELELQFKTVDTKTLPNILAVQNHKLYSGQINDLGSFSQGCGNIQKTNLSIIGTGTAKFDYVCHGASRKDIIVRRCYNNNYESCKLLKEEQSLMFADNHETIDVANVRHLLGDLQFKLMLGDLRYKSFAENPDLEIEAKCVGCPSCFTSYSCSFKIASNIDTVCSIEGPCTTFHNRLMITSTKQDYGIKMSCKTKPKETEEFQICKKTYTVLFTTVEKNDKIEISTGDQTSFIQEKDDRCKTWLCRVRDEGISVIFEPIRAFFGSYFSIAFYVVISIIVLFLAIYIFLPMVFKLRDVLKRNEYLYLQEIKHK

SEQ ID NO: 1855 - protein, 1434 aa, Artificial Sequence
  derived and/or modified protein sequence (wt) from NRIV(DakArD28542)__JX857317.1__GP
MLLLLVLLIPCYVSASPVVTRCFHGGQLIAEKKSQTAVSEFCLKDDVSTIKSEITYEKNNTGLFAHSKVLRNWIIKDWKNCNPVPTAGGSINVIEVNTDLSLTTKTYVCSRDCTITVDKEDAQIIFQTEKLNHFEVSGTTLSSGWFKTKASVTLDRTCEHIKVTCGKKTLQFHACFKHHMSCIRFFHGTILPGTMATSICQNIELIIIISLTLIIFILMVILTKTYICYLLMPLFMPIAYFYGWSYNKSCKKCSCCGLAYHPFTNCGSHCVCGLKFEASDRMRIHRESGLCQGYKSLRVARLLCKSKGSSLIISILLSMLILSFVTPIEGTLTNYPESRKYDLEEIADVLEGFIVEKGIKEYVVFYTSIFGALFLLMALVITITLNKVTEYLTNINVLYCHECSMYHSKKNIKYIGDFTNKCGFCTCGELEDQEGLKIHKVSRKCIYKYQLTWSKIIMTILVCLLIAQNTILIVAASDDCWTKKSLEMECIGPLQQVDTCDDKASRSYSGEAKKLVRASKISDLDAAQVGLLGPTIESAIASIRKQRTYSTMHLLESVFLGKHCDYYKTFEHNSGYSQAKWRLTAKTHHFDICSRHSTHHFCRCISDGTKCQNGDWDFAGEMNSTYQSKKDFFEHDLKLFCTLVENAFPGTTESLFYEMLSKKNTTGVKKLLDKLTRKFGNNNMFVGIWKFGQYLMSLPYVNETSLTPAQVAKILEVTDQHHRSISGRQESLASATPGSKSKECSHAKKVSCISPRFSVPMEGLMACGDSPNYKIYKTPAKLYKSNNKGEVWCSGDVHCSQELSPASQESVDRIKQITCFLTEPEVSDDVFSIAISTCKVQDKGVCTVNEDRWNVIKCDSGLIYYTDQRDGQDTGNDFGEYCLSHSCRIERFPINPAIISDCLWEYHSRKSKYITSLDLENLEEFKRAISEKLSHTLIVYNFKPTANLPHIKPVYKYITVQGVENSDGVDSAYIAASMPALSGTSIGYNIMSRDNFPLFDIIIFIKSAIIKATYNHIYDTGPTIGINVMHDEHCTGQCPTDIPHKENWITFAQERTSRWGCEEFGCLAVNTGCVFGSCQDIIRPETKVYRKAVEESVLLTVCITYPGKTFCTEINAIEPKITDELELQFKTVDTKTLPNILAVQNHKLYSGQINDLGSFSQGCGNIQKTNSSIIGTGTAKFDYVCHGASRKDIIVRRCYNNNYESCKLLKEEQSLMFADNHETIDVANVRHLLGDLQFKLMLGDLRYKSFAENPDLEIEAKCVGCPSCFTSYSCSFKIASNIDTVCSIEGPCTTFHNRLMITSTKQDYGIKMSCKTKPKETEEFQICKKTYTVLFTTVEKNDKIEISTGDQTSFIQERDDRCKTWLCRVRDEGISVIFEPIRAFFGSYFSIAFYVVVSIIVLFLAIYIFLPMVFKLRDVLKRNEYLYLQEIKHK

SEQ ID NO: 1856 - protein, 1434 aa, Artificial Sequence
  derived and/or modified protein sequence (wt) from NRIV(SUD-HKV141)__JX857323.1__GP
MLLLLVLLIPCYVSASPVVTRCFHGGQLIAEKKSQTAVSEFCLKDDVSTIKSEITYEKNNTGLFAHSKVLRNWIIKDWKNCNPVPTAGGSINVIEVNTDLSLTTKTYVCSRDCTITVDKEDAQIIFQTEKLNHFEVSGTTLSSGWFKTKASVTLDRTCEHIKVTCGKKTLQFHACFKHHMSCIRFFHGTILPGTMATSICQNIELIIIISLTLIIFILMVILTKTYICYLLMPLFMPIAYFYGWSYNKSCKKCSCCGLAYHPFTNCGSHCVCGLKFEASDRMRIHRESGLCQGYKSLRVARLLCKSKGSSLIISILLSMLILSFVTPIEGTLTNYPESRKYDLEEIADVLEGFIVEKGIKEYVVFYTSIFGALFLLMALVITITLNKVTEYLTNINVLYCHECSMYHSKKNIKYIGDFTNKCGFCTCGELEDQEGLKIHKVSRKCIYKYQLTWSKIIMTILVCLLIAQNTILIVAASDDCWTKKSLEMECIGPLQQVDTCDDKASRSYSGEAKKLVRASKISDLDAAQVGLLGPTIESAIASIRKQRTYSTMHLLESVFLGKHCDYYKTFEHNSGYSQAKWRLTAKTHHFDICSRHSTHHFCRCISDGTKCQNGDWDFAGEMNSTYQSKKDFFEHDLKLFCTLVENAFPGTTESLFYEMLSKKNTTGVKKLLDKLTRKFGNNNMFVGIWKFGQYLMSLPYVNETSLTPAQVAKILEVTDQHHRSISGRQESLASATPGSKSKECGHAKKVSCISPRFSVPMEGLMACGDSPNYKIYKTPAKLYKSNNKGEVWCSGDVHCSQELTPASQESVDRIKQITCFLTEPEVSDDVFSIAISTCKVQDKGVCTVNEDRWNVIKCDSGLIYYTDQRDGQDTGNDFGEYCLSHSCRIERFPINPAIISDCLWEYHSRKSKYITSLDLENLEEFKRAISEKLSHTLIVYNFKPTANLPHIKPVYKYITVQGVENSDGVDSAYIAASMPALSGTSIGYNIMSRDNFPLFDIIIFIKSAIIKATYNHIYDTGPTIGINVMHDEHCTGQCPTDIPHKENWITFAQERTSRWGCEEFGCLAVNTGCVFGSCQDIIRPETKVYRKAVEESVLLTVCITYPGKTFCTEINAIEPKITDELELQFKTVDTKTLPNILAVQNHKLYSGQINDLGSFSQGCGNIQKTNSSIIGTGTAKFDYVCHGASRKDIIVRRCYNNNYESCKLLKEEQSLMFADNHETIDVANVRHLLGDLQFKLMLGDLRYKSFAENPDLEIEAKCVGCPSCFTSYSCSFKIVSNIDTVCSIEGPCTTFHNRLMITSTKQDYGIKMSCKTKPKETEEFQICKKTYTVLFTTVEKNDKIEISTGDQTSFIQERDDRCKTWLCRVRDEGISVIFEPIRAFFGSYFSIAFYVVVSIIVLFLAIYIFLPMVFKLRDVLKRNEYLYLQEIKHK

SEQ ID NO: 1857 - protein, 1434 aa, Artificial Sequence
  derived and/or modified protein sequence (wt) from NRIV(SUD-HKV66)__JX857320.1__GP
MLLLLVLLIPCYVSASPVVTRCFHGGQLIAEKKSQTAVSEFCLKDDVSTIKSEITYEKNNTGLFAHSKVLRNWIIKDWKNCNPVPTAGGSINVIEVNTDLSLTTKTYVCSRDCTITVDKEDAQIIFQTEKLNHFEVSGTTLSSGWFKTKASVTLDRTCEHIKVTCGKKTLQFHACFKHHMSCIRFFHGTILPGTMATSICQNIELIIIISLTLIIFILMVILTKTYICYLLMPLFMPIAYFYGWSYNKSCKKCSCCGLAYHPFTNCGSHCVCGLKFEASDRMRIHRESGLCQGYKSLRVARLLCKSKGSSLIISILLAMLILSFVTPIEGTLTNYPESRKYDLEEIADVLEGFIVEKGIKEYVVFYTSIFGALFLLMALVITITLNKVTEYLTNINVLYCHECSMYHSKKNIKYIGDFTNKCGFCTCGELEDQEGLKIHKVSRKCIYKYQLTWSKIIMTILVCLLIAQNTILIVAASDDCWTKKSLEMECIGPLQQVDTCDDKASRSYSGEAKKLVRASKISDLDAAQVRLLGPTIESAIASIRKQRTYSTMHLLESVFLGKHCDYYKTFEHNSGYSQAKWRLTAKTHHFDICSRHSTHHFCRCISDATKCQNGDWDFAGEMNSTYQSKKDFFEHDLKLFCTLVENAFPGTTESLFYEMLSKKNTTGVKKLLDKLTRKFGNNNMFVGIWKFGQYLMSLPYVNETSLTPAQVAKILEVTDQHHRSISGRQESLASATPGSKSKECGHAKKVSCISPRFSVPMEGLMACGDSPNYKIYKTPAKLYKSNNKGEVWCSGDVHCSQELTPASQESVDRIKQITCFLTEPEVSDDVFSIAISTCKVQDKGVCTVNEDRWNVIKCDSGLIYYTDQRDGQDTGNDFGEYCLSHSCRIERFPINPAIISDCLWEYHSRKSKYITSLDLENLEEFKRAISEKLSHTLIVYNFKPTANLPHIKPVYKYITVQGVENSDGVDSAYIAASMPALSGTSIGYNIMSRDNFPLFDIIIFIKSAIIKATYNHIYDTGPTIGINVMHDEHCTGQCPTDIPHKENWITFAQERTSRWGCEEFGCLAVNTGCVFGSCQDIIRPETKVYRKAVEESVLLTVCITYPGKTFCTEINAIEPKITDELELQFKTVDTKTLPNILAVQNHKLYSGQINDLGSFSQGCGNIQKTNSSIIGTGTAKFDYVCHGASRKDIIVRRCYNNNYESCKLLKEEQSLMFADNHETIDVANVRHLLGDLQFKLMLGDLRYKSFAENPDLEIEAKCVGCPSCFTSYSCSFKIASNIDTVCSIEGPCTTFHNRLMITSTKQDYGIKMSCKTKPKETEEFQICKKTYTVLFTTVEKNDKIEISTGDQTSFIQERDDRCKTWLCRVRDEGISVIFEPIRAFFGSYFSIAFYVVVSIIVLFLAIYIFLPMVFKLRDVLKRNEYLYLQEIKHK

SEQ ID NO: 1858 - protein, 1447 aa, Artificial Sequence
  derived and/or modified protein sequence (wt) from BWAV(M459)__NC_034490.1__GP
MAMFELIVLLAFSYVTGVPQELTRCFTGGSVVRQHWSKNAISELCLKDDVSIIKSEIEYKKNETGTFALSKIYRKWITTDWEKCQPQKSTGGHISVLEVRHDLTLASATYICGNPCTINVDREMAQVHLQTEGVNHFEISGTTIKSGWFKTTTYITLDQTCEHLKVSCGKQSVQFHACFKQHMACVRFLHRTILPGNMANSICQNIEIIILLALTLSIFILLCILTKTYICYILLPIFIPISYIYGYFYNRSCKKCSQCGLVYHPFTECGRNCVCGARYDTSERMKLHRLSGLCPGYKSLKAARVLCKSKGSASILSILISLLILTFVTPINGLMLKDTDITNLKIDTLPDDMLELIHNVDYLKLILEINITIFGFILIIILFMLLMFYRYQHIFISIYVIDCKECNMYHSKSGLRYNGDFTNKCMTCTCGEVDDMEGLNKHKKRYNCLIKYKTTILQHFFLSILVCLILKESVLFAAAQSEEIIKCLEQESLTSKCTGPLLKTPQCTEQQKNLLFIEIAKQMEKDNIITSLDNALIAKLPNEIAGSMAILDTKKYYHEQITLEYAILSKYCDYYKKYEGNTGYSQTTWRTYLRSQDLEICLILPYQFFCRCFKSGTGCIDTKMEIKSTMDTYYSSHQTKFDSDLNYMLHVIHLAFRGSATSYIAKCLIEKNYTETISYLTKIQEKYPNNQLLKVAIFFTNHLLNQSLVENFEVSTEWSRYKHSTAQPEHEWKKGSELKMLDPNKLKTGPAIQTCLHIKDLHCISPRSRAPTSGIITCGLNDQACVYRKPDKKIYASHMTQHGFCVMDGHCLKPFEPISGEMLQIIKKSKCWTEDIEDLITEGQDKGRISCQPIDVGNCNVSGNLWTITLCSDKKFYYTDNKHVHDNSKDIGYYCMEENCKIPRFPIHPDFVKDCEWDLNHIKIDHLKQINIEDINSYKKILTEKLTTALNSFKYKGNENLPHSIPKYKYITIQGTQTIDGIENAFIEVEIPALSGSATGFKISSRDGIELFDAILYVKQASFSSVYKKLYVTGPTIGINTKHDERCTGACPMTLPHSYGWLTFSKERTSQWGCEEYGCLAISDGCVFGSCQDIIKDDLTIYRKETEELSLAEICITFMHNTFCTSIDSTTPTITDILEAQFKTVESFKLPNTVGLKMHKLYIGTINDIGVYKKACGNVQKYNNTILGSGSPKFDYVCHLAKRKDVILRKCFDNDYNSCKLLKVANDLRIEEDGEKLKVINYKKVMGTLKFKAIFGDIKYKSFTQDVDIDAEATCVGCLNCFENINCEIKVQSPLETTCEVESSCDLFTTRILFHQDIHKYALKLICSKEASSKFWIRFCNKEIKSSISLINAAPILELAPIDQTSYVKEEDERCGTWMCRVAQEGIGVIFEPFKNLFGSYLGIFYIIIIVIILLVLFVYIFLPMILKLKEILQKNEVAYQRDMKIR

SEQ ID NO: 1859 - protein, 1447 aa, Artificial Sequence
  derived and/or modified protein sequence (wt) from BWAV(UgAr1888)__KJ867186.1__GP
MAIFKLIVLLAFSYATGVPQELSRCFTGGSVVRQHWSKNAISELCLKDDVSIIKSEIEYKKNETGTFALNKIYRKWITTDWEKCQPQKSTGGHISVLEVRHDLTLASATYICGNPCTINVDREMAQVHLQTEGVNHFEISGTTIKSGWFKTTTYITLDQTCEHLKVSCGKQSVQFHACFKQHMACVRFLHRTILPGNMANSICQNIEIIILLALTLSIFILLCILTKTYICYILLPIFIPISYIYGYFYNRSCKKCSQCGLVYHPFTECGRNCVCGARYDTSERMKLHRLSGLCPGYKSLKTARVLCKSKGSASILSILISLLILTFVTPINGLMLKDTDITNLKIDTLPDDMLELIHNVDYLKLILEINIMIFGFILIIILFMLLMFYRYQHIFISIYVIDCKECDMYHSKSGLRYNGDFTNKCMTCTCGEVDDMEGLNKHKKRYNCLIKYKTTILQHFSLSMLVCLILKESVLFAAAQPEEIIKCLEQESLTSECTGPLLKTPQCTEQQKNLLFMEIAKQMEKDNVITSLDNALIAKLPNEIAGSMAILDTKKYYHEQITLEYAILSKYCDYYKKYEGNTGYSQTTWRTYLRSQDLEICLILPYQFFCRCFKSGTGCIDTKIEFKSTMDTYYSSHQTKFDSDLNYMLHVIHLAFRGSATSYIAKCLIEKNYTETISYLTKIQEKYPNNQLLKVAIFFTNHLLNQSLVENFEVSTEWSRYKHSATQPEHEWKKGSELKILDSNKLKTGPAIQTCLHIKDLHCISPRSRAPTSGIITCGLNDQACVYRKPNKEIYASHMTQHGFCIMDGHCLKPFEPISGEMLQIIKKSKCWTEDIEDLITEGQDKGRISCQPIDVGNCNVSGNLWTITLCSDKKFYYTDNKHVHDSSKDVGYYCMEENCKIPRFPIHPDFVKDCEWDLNHMEIDHLKQINIEDINSYKKILTEKLITALNSFKYKGNENLPHSIPKYEYITIQGTQTIDGIENAFIEVEIPALSGSATGFKISSRDGIELFDAILYVKQASFSSVYKKLYVTGPTIGINTKHDERCTGACPVTLPHSYGWLTFSKERTSQWGCEEYGCLAISDGCVFGSCQDIIKDDLTVYRKETEELSLAEICITFMHNTFCTSIDSTTPTITDILEAQFKTVESFKLPNTVGLKMHKLYIGTINDIGVYKKACGNVQKYNNTILGSGSPKFDYVCHLAKRKDVILRKCFDNDYNSCKLLKVANDLRIEEDGEKLKVINYKKVMGTLKFKAIFGDVKYKSFTQDVDIDAEATCVGCLNCFENINCEIKVQSPLETTCEVESSCDLFTTRILFHQDIHKYALKLICSKEATSKFWIRFCKKEIKSSISLINAAPILELAPIDQTSYVKEEDERCGTWMCRVAQEGIGVIFEPFKNLFGSYLGIFYIIIIVIILLVLFVYIFLPMILKLKEILQKNEVAYQRDMKVR

SEQ ID NO: 1860 - protein, 1443 aa, Artificial Sequence
  derived and/or modified protein sequence (wt) from BWAV/PGAV(SAAr1)__KJ867177.1__GP
MICICIFVAIFPAIYAIPDSYSRCFTGGTVVKEMWSKDAVTELCIKDDVSIVKTETSYKKNGTGTFALNKVTRKWLMTDWEKCKPQKSSSGHINVIEVRDDLTLATSTYICSSSCTINVDRETAQIQLNTDSINHFEIAGTTIKTGWFKSTTLVALDQTCEHLKVSCGKQSVQFHACFNQHMSCVRFLHRTILPGNMAKSICQNIEIIILVGLIILIFLLLCILTKTYICYILLPIFIPLSYAYGYFYNKACKKCSQCGLVYHPFTECGSNCVCGARYDTSERMKLHRISGLCPGYKSLRTARVLCKSKGSASILSILISILILMFVTPINGYMITNEFDEGKLTVDSLPDDMLSMISRLSALQFIFTLNIACSVLVTLLTCLFLIIFYRFQHRFLSKYAINCTECDMYHQKKGLIYNGDFTNKCMTCTCGEVNDMEGLNKHKKRYNCLIKYKAAWFLNLTITIICLMLIKDGSMMAAAETNIETCMAKPSLTTDCTGPFLKITKCDESQKALPFQEIAKQLVKSNVLTLLDKHIVEKLPNEIAGSLSILDKKQHYHEQLAVEYGILSKYCDYYELYKSNSGYSQSTWGTYLRSHDFEICLLLPYQYVCRCFKSGTGCTDTKFEFEQKMNETYNSKNDMYNSDFTLALTVLHLAMRGTASTYIIDNVLQKNYSNVIEYLNTTKNNFKSNQVFGVLVDFTIYLLRHASYAKYNLPQSLKKFRSVSSDLTTISGRSSGQNIVSDLHQGDVIKTCLNIKQLNCISPKSRTTTTNLITCGSSQISVYNLPRGQLYESVTTEHGTCAGDGHCLTDFMPINSDFLATLKKSKCWTTDIPNIIKLVESDGKISCQPIDVGSCNVSGNIWTITKCSDNKYYYTDNKHVHDDEKDIGHYCMEETCKFVRFPINDKFVSNCEWDLNHIEINKLNQVELDNINAYKKVLTEKLTSSLSVFKYKLTQNLPHVIPKFKYITIQGTQTVDGIENSFIEVEIPALSGAASGFKIMTKENNELFDAILYVKQASFSSIYKKIYTTGPTIGINTKHDEKCTGACPVNLPHSTGWLTFAKERTSTWGCEEYGCLAINDGCVFGSCQDIIKDEMYIFKKETEEVALVEICISFNHKTFCTDVDSTTPIITDTLEAQFKTVESYKLPNHVALKQHKLYVGQINDFGVYKKACGNVQKINNTIYGEGTPRFDYLCHLAKRKDVLVRKCFDNDYNSCSLLTIADDLRLEEDGEKLKVINYRKVLGSMKFKALFGDIRYKSFTEDIELDVEASCAGCINCFDNIHCEIKLTNGLDTSCSFESSCDAFNSRILFNSNQHVYSTKLICTKEQTKAFEIKICGKTIKADLVVTEAKPILELTPIDQTSYIKEEDTRCGTWFCRLTKEGFSVLLEPFKNLFGSYLGIAYTIIIALLCLFVFIYIILPMIMKLKEVLKQNEIAYQKEQKKR

SEQ ID NO: 1861 - protein, 1443 aa, Artificial Sequence
  derived and/or modified protein sequence (wt) from BWAV/PGAV(191B-07)__KJ867180.1__GP
MIYIYIFVAIFPAIYAIPDSYSRCFTGGTVVKEMWSKDAVTELCIKDDVSIVKTETSYKKNGTGTFALNKVTRKWLMTDWEKCKPQKSSSGHINVIEVRDDLTLATSTYICSSSCTINVDRETAQIQLNTDSINHFEIAGTTIKTGWFKSTTLVALDQTCEHLKVSCGKQSVQFHACFNQHMSCVRFLHRTILPGNMAKSICQNIEIIILVGLTILIFLLLCILTKTYICYILLPIFIPLSYAYGYFYNKACKKCSQCGLVYHPFTECGSNCVCGARYDTSERMKLHRISGLCPGYKSLRTARVLCKSKGSASILSILISILILMFVTPINGYMITNEFDEGKLTVDSLPDDMLSMISRLSALQFIFTLNIACSVLVTLLTCLFLIIFYRFQHRFLSKYAINCTECDMYHQKKGLIYNGDFTNKCMTCTCGEVDDMEGLNKHKKRYNCLIKYKAAWFLNLTITIICLMLIKDGSMMAAAESNIETCMAKPSLTTDCTGPFLKITKCDESQKALPFQEIAKQLVKSNVLTLLDKHIVEKLPNEIAGSLSILDKKQHYHEQLAVEYGILSKYCDYYELYKSNSGYSQSTWRTYLRSHDFEICLLLPYQYVCRCFKSGTGCTDTKFEFEQKMNETYNSKNDMYNSDFTLALTVLHLAMRGTASTYIIDNVLQKNYSNVIEYLNTTKNNFKSNQVFGVLVDFTIYLLRHASYAKYNLPQSLKKFRSVSSDLTTISGRSSGQNIVSDLHQGDVIKTCLNIKQLNCISPRSRTTTTNLITCGTSQISVYNLPRGQLYESVTTEHGTCADDGHCLTDFMPINSDFLATLKKSKCWTTDIPNIIKLVESDGKISCQPIDVGSCNVSGNIWTITKCSDNKYYYTDNKHVHDDAKDIGHYCMEETCKFVRFPINDKFVSNCEWDLNHIEINKLNQVELDNINAYKKVLTEKLTSSLSVFKYKLTQNLPHVIPKFKYITIQGTQTVDGIENSFIEVEIPALSGAASGFKIMTKENNELFDAILYVKQASFSSIYKKIYTTGPTIGINTKHDEKCTGACPVNLPHNTGWLTFAKERTSTWGCEEYGCLAINDGCVFGSCQDIIKDEMYIFKKETEEVALVEICISFNHKTFCTDVDSTTPIITDTLEAQFKTVESYKLPNHVALKQHKLYVGQINDFGVYKKACGNVQKINNTIYGEGTPRFDYLCHLAKRKDVLVRKCFDNDYNSCSLLTIADDLRLEEDSEKLKVINYRKVLGSMKFKALFGDIRYKSFTEDIELDVEASCAGCINCFDNIHCEIKLTNGLDTSCSFESSCDAFNSRILFNSNQHVYSTKLICTKEQTKAFEIKICGKTIKADLVVTEAKPILELTPIDQTSYIKEEDTRCGTWFCRLTKEGFSVLLEPFKNLFGSYLGIAYTVIIALLCLFVFIYIILPMIMKLKEVLKQNEIAYQKEQKKR

SEQ ID NO: 1862 - protein, 1441 aa, Artificial Sequence
  derived and/or modified protein sequence (wt) from CEV(283)__KX817313.1__GP
MIFMLILFAVAAASPVYQRCFQDGAIVKQNPSKEAVTEVCLKDDVSMIKTEARYTKNSTGVFSNNVAIRKWLVSDWHDCRPRKVVGGHINVIEVGDDLTLHTESYVCSADCTIGVDKETAQVRLQTDTTNHFEIAGTTVKSGWFKSTTYISLDQTCEHLKVSCGPKSIQFHACFNQHMSCVRFLHRTILPGSIANSICQNVEIIILVTLALLIFILLSIISKTYICYLLMPIFIPIAYIYGLIYNKSCKKCKLCGLVYHPFTECGTHCVCGARYDTSDRMKLHRASGLCPGYKSLRAARVMCKSKGPASILSIITAVLILTFVTPINAMMVGESKETFELEELPDDMLEMANNLNTYYMLCVANYAVTWSLLIVALIIGLLFKKYQHRFLDIYAMYCEECDMYHDRSGIKWNGDFTNKCGHCTCGQYEDASGLLVHRKTYNCLIQYKSKWIMNFLVTYVILVLLKDSVVIVQAKGVDFSECIEAEKVRWNCTGPFVNLGNCEKKQKKEPYSNIAAQLKGLGAISILDVPIIASIPEDIAGALRYIEDQRSYHSQLTVEYAMLTRYCDYYTQFSDNSGYSQTTWRVYLRSHDFEACVLYPNQHFCRCVKHGDKCSSSNWDFASEMKNYYSGKQSKFDKDLNLALTSLHHAFRGTSSSYIAGLLSSKANDELVQYTSKIREKFPGNALLKAVIDYIAYMKGLTEMSNFKKDEFWDELVYVPDPTKPPKLSRSSGTVYDFKSATSNLGEKNCKDVKGVVCLSPRSGVTYDSIIACGEGSSPNIYRIPKTGVYQSNSEPSNYCVSDSHCLEDFEVINQEELDAIKKSRCWEVDYLYANPSKQSDGIRSCRMRDAGHCNVTTNRWPIIQCDDNKYYYSELQRDYDKEQDIGHFCLSPRCTTVRFPIHPKHVSNCDWQVSHSTVDKVDVHNLEDIEQYRKAITQKLQNSLSIFKYARTKNLPHIKPIYKYITIEGTETAEGIESAYIESEIPALAGTSIGFKINTKEGKHLLDVIAYVKQASYSSLYNKMYVTGPTVGINTKHDELCTGPCPVNVPHSDGWLTFARERTSSWGCEEFGCLAISDGCVFGSCQDLIKEELAVYRKETEEATNVELCLTFSDKTYCTELNPITPIITNLFEVQFKTVETYSLPRVVAVQNHEIRIGQINDLGIYSKGCGNVQKVNNTIYGNGVPKFDYLCHLASRKEVIVRKCFDNDFQACKFLQSPPSYRLEEDDGSITVIDYKKILGTIKMKAILGDVKYKTFAENIDITAEGVCTGCVNCFENIHCELTIHTTIEASCPVTSPCTLFHDRILITPDEHKYAMKVICTEKQTGTLPFKICNSKVDATLTLVEAKPILELASVDQTAYIREKDERCKTWMCRVRDEGIQVILEPFKNLFGSYIGIFYTSILIVITIFIIIYVILPICFKLKDTLQKHEDAYKREMKIR

SEQ ID NO: 1863 - protein, 1441 aa, Artificial Sequence
  derived and/or modified protein sequence (wt) from CEV(BFS283)__AF123483.1__GP
MIFILILFAVAAASPVYQRCFQDGAIVKQNPSKEAVTEVCLKDDVSMIKTEARYTKNSTGVFSNNVAIRKWLVSDWHDCRPRKVVGGHINVIEVGDDLTLHTESYVCSADCTIGVDKETAQVRLQTDTTNHFEIAGTTVKSGWFKSTTYISLDQTCEHLKVSCGPKSIQFHACFNQHMSCVRFLHRTILPGSIANSICQNVEIIILVTLALLIFILLSIISKTYICYLLMPIFIPIAYIYGLIYNKSCKKCKLCGLVYHPITECGTHCVCGARYDTSDRMKLHRASGLCPGYKSLRAARVMCKSKGPASILSIITAVLILTFVTPINAMMVGGSKETFELEELPDDMLEMANNLNTYYMLCVTNYAVTWSLLIIALAIGLLFKRYQHRFLDIYAMYCEECDMYHDRSGIKWNGDFTNKCGQCTCGQYEDASGLLVHRKTYNCLIQYKSKWIMNFLITYVILVLLKDSVVIVQAKGTDFSECIDADKIKWNCTGPFVNLGNCEKKQKKEPYSNIAAQLKGLSAISILDVPIIASIPEDIAGALRYIEDQRSYHSQLTVEYAMLTRYCDYYTQFSDNSGYSQTTWRVYLRSHVFEACILYPNQHFCRCVKHGDKCSSSNWDFASEMKNYYSGKQNKFNKDLNLALTSLHHAFRGTSSSYIAGLLSTKANDELVQYTSKIREKFPGNALLKAIIDYIAYMKGLTEMSNFKKDEFWDELVYVPDPTKPPKLSRGSETVYDFKSATSNLGEKNCKDVKGVVCLSPRSGVTYDSIIACGEGSSPNIYKIPKTGVYQSNSEPSNYCVSDSHCLEDFEVISQEELDAIKKSRCWEVDYLYANPPKQSDGVRSCRMKDAGHCNVTTNRWPIIQCDDNKYYYSELQRDYDKEQDIGHFCLSPRCATVRFPIHPKHISNCDWQVSHSTVDKVNVHNLEDIEQYRKAITQKLQNSLSIFKYARTKNLPHIKPIYKYITIEGTETAEGIESAYIESEIPALAGTSIGFKINTKEGKHLLDVIAYVKQASYSSLYNKMYVTGPTVGINTKHDELCTGPCPVNVPHSDGWLTFARERTSSWGCEEFGCLAISDGCVFGSCQDLIKEELTVYRKETEEATNVELCLTFADKTYCTELNPVTPIITNLFEVQFKTVETYSLPRVVAVQNHEIRIGQINDLGVYSKGCGNVQKVNNTIYGNGVPKFDYLCHLASRKEVIVRKCFDNDFQACKFLQSPPSYRLEEDDGSITVIDYKKILGTIKMKAILGDVKYKTFAENIDITAEGVCTGCINCFENIHCELTIHTTIEASCPVTSPCTLFHDRILITPDEHKYAIKVICTEKQTGTLPFKICNSKIDATLTLVEAKPILELAPVDQTAYIREKDERCKTWMYRVRDEGIQVILEPFKNLFGSYIGIFYTSILVVIAMFIIVYVILPICFKLKDTLQRHEDAYKREMKIR

SEQ ID NO: 1864 - protein, 1442 aa, Artificial Sequence
  derived and/or modified protein sequence (wt) from CHATV(Mohko ILO8-3)__KF719222.1__GP
MMIFILILFAVSAASPVYQRCFQDGAIVKQNPSKEAVTEVCLKDDVSMIKTEARYVKNATGIYSNNVAIRKWLVSDWHDCRPRKVSGGHINVIEVGDDLSLHTESYVCSADCTIGVDKETAQVRLQTDTTNHFEIAGTTVKSGWFKSTTYITLDQTCEHLKVSCGPKSVQFHACFNQHMSCVRFLHRTILPGSIANSICQNIEIIILVTLTLLIFVLLSILSKTYICYLLMPIFIPIAYIYGIIYNKSCKKCKLCGLVYHPFTECGTHCVCGARYDTSDRMKLHRSSGLCPGYKSLRAARVMCKSKGPASILSIITAILVLTFVTPINSMVIGESKEVFELEELPDDMLEMALKINLYYFVCVINYAVTWSLVIVALLIALIFKKYQHRFLNLYAMYCEECDMYHDRIGLKRNGDFTNKCRQCTCGQYEDATGLMTHRKTYNCLVQYKSKWILNFLITYMILTLIKDSAIIVQAAGTDFSACLEAQSVDWNCTGPFLNLGNCQKQQKKESYANIATQLKGLQAISVLDVPMIANIPEDIAGALRYIEEKDTFHVQLTAEYAMLTRYCDYYTQFADNSGYSQTTWRVYLRSHDFDACILYPNQHFCRCVKHGDKCSSSNWDFANEMKNYYSGKQNKFDKDLNLALMAVHHAFRGTSSAYIATMLSKKSNNDLVTYTNKIKEKFPGNALLKAIMDYISYMKGLSEMTNFKYDEFWDDLLHKPSPTNAPPLSRDSEPSYNFKSVISSRSVKSCKNVKNVVCLSPRSGVSYDSILACGEPNGPSVYKKPSDGVFQSNSDKTMYCLADSHCLEDFEVVSQEELDAIKKSKCWVTEYPNVKLSKLSDGITSCRMKDSGKCNVAANRWPIIQCENDKFYYSELQNDYDKTQDIGHFCLSPGCSTIRFPINQKHISNCNWQVSRSSIAKIDVHDIEDIDQYRKAITQKLQTGLSLFKYAKTKNLPHIKPIYKYITIEGTETAEGIESAYIESEIPALAGTSIGFKINSKEGKHLLDIVGYVKSASYSSVYTKLYSTGPTSGINTKHDELCTGPCPVNINHQTGWLTFAKERTSSWGCEEFGCLAISDGCVFGSCQDIVRDELSVYRKETEEVTDVELCLTFSDKTYCTNLNPITPIITDLFEVQFKTVETYSLPRIVAIQNHEVKIGQINDLGVYSKGCGNVQKVNGTVYGNGVPKFDYLCHLASRKEVIVRKCFDNDYQACKFLQTPASYRLEESSGTVTVIDYKKILGTIKMKAILGDVKYKTFADNVDMTAEGSCAGCINCFENIHCELTLHTTIDASCPVTSPCTVFHDRILITPNEHKYAMKVICTEKPGNTLTIKICGTKIDASLALIDAKPILELAPVDQTAYIREKDERCKTWMCRVRDEGLQVILEPFKNLFGSYIGIFYTFIICIIVLLIVIYIVLPICFKLRDTLRQHEDAYKREMKIR

SEQ ID NO: 1865 - protein, 1442 aa, Artificial Sequence
  derived and/or modified protein sequence (wt) from CHATV(Mohko M07-1)__KF719225.1__GP
MMIFILILFAVSAASPVYQRCFQDGAIVKQNPSKEAVTEVCLKDDVSMIKTEARYVKNATGIYSNNVAIRKWLVSDWHDCRPRKVSGGHINVIEVGDDLSLHTESYVCSADCTIGVDKETAQVRLQTDTTNHFEIAGTTVKSGWFKSTTYITLDQTCEHLKVSCGPKSVQFHACFNQHMSCVRFLHRTILPGSIANSICQNIEIIILVTLTLLIFVLLSILSKTYICYLLMPIFIPIAYMYGIIYNKSCKKCKLCGLVYHPFTECGTHCVCGARYDTSDRMKLHRSSGLCPGYKSLRAARVMCKSKGPASILSIITAILVLTFVTPINSMVIGESKEVFELEELPDDMLEMALKINLYYFVCVINYAVTWSLIIVALLIALIFKKYQHRFLNLYAMYCEECDMYHDRIGLKRNGDFTNKCRQCTCGQYEDATGLMTHRKTYNCLVQYKSKWILNFLITYMVLTLIKDSAIIVQAAGTDFSACLEAQSVDWNCTGPFLNLGNCQKQQKKESYANIATQLKGLQAISVLDVPMIANIPEDIAGALRYIEEKDTFHVQLTAEYAMLTRYCDYYTQFADNSGYSQTTWRVYLRSHDFDACILYPNQHFCRCVKHGDKCGSSNRDFANEMKNYYSGKQNKFDKDLNLALMAVHHAFRGTSSAYIATMLSKKSNNDLVTYTNKIKEKFPGNALLKAIMDYISYMKGLSEMTNFKYDEFWDDLLHKPSPTNAPPLSRDSEPSYNFKSVISSRSVKSCKNVKNVVCLSPRSGVSYDSILACGEPNGPSVYKKPSDGIFQSNSDKTMYCLADSHCLEDFEVVSQEELDAIKKSKCWVTEYPNVKLSKLSDGITSCRMKDSGKCNVAANRWPIIQCENDKFYYSELQNDYDKTQDIGHFCLSPGCSTIRFPINQKHISNCNWQVSRSSIAKIDVHDIEDIDQYRKAITQKLQTGLSLFKYAKTKNLPHIKPIYKYITIEGTETAEGIESAYIESEIPALAGTSIGFKINSKEGKHLLDIVGYVKSASYSSVYTKLYSTGPTSGINTKHDELCTGPCPVNINHQTGWLTFAKERTSSWGCEEFGCLAISDGCVFGSCQDIVRDELSVYRKETEEVTDVELCLTFSDKTYCTNLNPITPIITDLFEVQFKTVETYSLPRIVAIQNHEVKIGQINDLGVYSKGCGNVQKVNGTVYGNGVPKFDYLCHLASRKEVIVRKCFDNDYQACKFLQTPASYRLEENSGTVTVIDYKKILGTIKMKAILGDVKYKTFADNVDMTAEGSCAGCINCFENIHCELTLHTTIDASCPVTSPCTVFHDRILITPNEHKYAMKVICTEKPGNTLTIKICGTKIDASLALIDAKPILELAPVDQTAYIREKDERCKTWMCRVRDEGLQVILEPFKNLFGSYIGIFYTFIICMIVLLIVIYIVLPICFKLRDTLRQHEDAYKREMKIR

SEQ ID NO: 1866 - protein, 1442 aa, Artificial Sequence
  derived and/or modified protein sequence (wt) from CHATV(Mohko M07-2-83)__KF719228.1__GP
MMIFILILFAVSAASPVYQRCFQDGAIVKQNPSKEAVTEVCLKDDVSMIKTEARYVKNATGIYSNNVAIRKWLVSDWHDCRPRKVSGGHINVIEVGDDLSLHTESYVCSADCTIGVDKETAQVRLQTDTTNHFEIAGTTVKSGWFKSTTYITLDQTCEHLKVSCGPKSVQFHACFNQHMSCVRFLHRTILPGSIANSICQNIEIIILVTLTLLIFVLLSILSKTYICYLLMPIFIPIAYMYGIIYNKSCKKCKLCGLVYHPFTECGTHCVCGARYDTSDRMKLHRSSGLCPGYKSLRAARVMCKSKGPASILSIITAILVLTFVTPINSMVIGESKEVFELEELPDDMLEMALKINLYYFVCVINYAVTWSLIIVALLIALIFKKYQHRFLNLYAMYCEECDMYHDRIGLKRNGDFTNKCRQCTCGQYEDATGLMTHRKTYNCLVQYKSKWILNFLITYMVLTLIKDSAIIVQAAGTDFSACLEAQSVDWNCTGPFLNLGNCQKQQKKESYANIATQLKGLQAISVLDVPMIANIPEDIAGALRYIEEKDTFHVQLTAEYAMLTRYCDYYTQFADNSGYSQTTWRVYLRSHDFDACILYPNQHFCRCVKHGDKCGSSNWDFANEMKNYYSGKQNKFDKDLNLALMAVHHAFRGTSSAYIATMLSKKSNNDLVTYTNKIKEKFPGNALLKAIMDYISYMKGLSEMTNFKYDEFWDDLLHKPSPTNAPPLSRDSEPSYNFKSVISSRSVKSCKNVKNVVCLSPRSGVSYDSILACGEPNGPSVYKKPSDGIFQSNSDKTMYCLADSHCLEDFEVVSQEELDAIKKSKCWVTEYPNVKLSKLSDGITSCRMKDSGKCNVAANRWPIIQCENDKFYYSELQNDYDKTQDIGHFCLSPGCSTIRFPINQKHISNCNWQVSRSSIAKIDVHDIEDIDQYRKAITQKLQTGLSLFKYAKTKNLPHIKPIYKYITIEGTETAEGIESAYIESEIPALAGTSIGFKINSKEGKHLLDIVGYVKSASYSSVYTKLYSTGPTSGINTKHDELCTGPCPVNINHQTGWLTFAKERTSSWGCEEFGCLAISDGCVFGSCQDIVRDELSVYRKETEEVTDVELCLTFSDKTYCTNLNPITPIITDLFEVQFKTVETYSLPRIVAIQNHEVKIGQINDLGVYSKGCGNVQKVNGTVYGNGVPKFDYLCHLASRKEVIVRKCFDNDYQACKFLQTPASYRLEENSGTVTVIDYKKILGTIKMKAILGDVKYKTFADNVDMTAEGSCAGCINCFENIHCELTLHTTIDASCPVTSPCTVFHDRILITPNEHKYAMKVICTEKPGNTLTIKICGTKIDASLALIDAKPILELAPVDQTAYIREKDERCKTWMCRVRDEGLQVILEPFKNLFGSYIGIFYTFIICMIVLLIVIYIVLPICFKLRDTLRQHEDAYKREMKIR

SEQ ID NO: 1867 - protein, 1441 aa, Artificial Sequence
  derived and/or modified protein sequence (wt) from CHATV(LEIV-15854)__HQ734820.1__GP
MIFILILFAVSAASPVYQRCFQDGAIVKQNPSKEAVTEVCLKDDVSMIKTEARYVKNATGIYSNNVAIRKWLVSDWHDCRPRKVSGGHINVIEVGDDLSLHTESYVCSADCTIGVDKETAQVRLQTDTTNHFEIAGTTVKSGWFKSTTYITLDQTCEHLKVSCGPKSVQFHACFNQHMSCVRFLHRTILPGSIANSICQNIEIIILVTLTLLIFVLLSILSKTYICYLLMPIFIPIAYVYGIIYNKSCKKCKLCGLVYHPFTECGTHCVCGARYDTSDRMKLHRSSGLCPGYKSLRAARVMCKSKGPASILSIITAILVLTFVTPINSMVIGESKEVFELEELPDDMLEMALKINLYYFVCVMNYAVTWSLVIVALLIALIFKKYQHRFLNLYAMYCEECDMYHDRIGLKRNGDFTNKCRQCTCGQYEDATGLMTHRKTYNCLVQYKSKWILNFLITYMVLTLIKDSAIIVQAAGTDFSACLEAQSVDWNCTGPFLNLGNCQKQQKKESYANIATQLKGLQAISVLDVPMIANIPEDIAGALRYIEEKDTFHVQLTAEYAMLTRYCDYYTQFADNSGYSQTTWRVYLRSHDFDACILYPNQHFCRCVKHGDKCSSSNWDFANEMKNYYSGKQNKFDKDLNLALMAVHHAFRGTSSAYIATMLSKKLNNDLITYTNKIKEKFPGNALLKAIMDYISYMKGLSEMTNFKYDEFWDDLLHKPSPTNAPPLSRDSEPSYNFKSVISSRSVKSCKNVKNVVCLSPRSGASYDSILACGEPNGPSVYKKPSDGVFQSNSDKTMYCLADSHCLEDFEVVSQEELDAIKKSKCWVTEYPNVKLSKLSDGITSCRMKDSGKCNVAANRWPIIQCENDKFYYSELQNDYDKTQDIGHFCLSPGCSTIRFPINQKHISNCNWQVSRSSIAKIDVHDIEDIDQYRKAITQKLQTGLSLFKYAKTKNLPHIKPIYKYITIEGTETAEGIESAYIESEIPALAGTSIGFKINSKEGKHLLDIVGYVKSASYSSVYTKLYSTGPTSGINTKHDELCTGPCPVNINHQTGWLTFAKERTSSWGCEEFGCLAISDGCVFGSCQDIVRDELSVYRKETEEVTDVELCLTFSDKTYCTNLNPITPIITDLFEVQFKTVETYSLPRIVAVQNHEVKIGQINDLGIYSKGCGNVQKVNGTVYGNGVPKFDYLCHLASRKEVIVRKCFDNDYQACKFLQTPASYRLEENSGTVTVIDYKKILGTIKMKAILGDVKYKTFADNVDMTAEGSCAGCINCFENIHCELTLHTTIDASCPVTSPCTVFHDRILITPNEHKYAMKVICTEKPGNTLTIKICSTKIDASLALIDAKPILELAPVDQTAYIREKDERCKTWMCRVRDEGLQVILEPFKNLFGSYIGIFYTFIICVIVLLIVIYIVLPICFKLRDTLRQHEDAYKREMKIR

SEQ ID NO: 1868 - protein, 1441 aa, Artificial Sequence
  derived and/or modified protein sequence (wt) from CHATV(LEIV-17756)__EU621834.1__GP
MIFILILFAVSTASPVYQRCFQDGAIVKQNPSKEAVTEVCLKDDVSMIKTEARYIRNATGTFSNNVAIRKWIVSDWHDCRPKKVSGGHINVIEVGDDLSLHTESYVCSADCTIGVDKETAQVRLQTDTTNHFEIAGTTVKSGWFKSTTYITLDQTCEHLKVSCGPKSVQFHACFNQHMSCVRFLHRTILPGSIANSICQNIEIIILVTLTLLIFVLLSILSKTYICYLLMPIFIPIAYIYGIIYNKSCKKCKLCGLVYHPFTECGTHCVCGARYDTSDRMKLHRSSGLCPGYKSLRAARVMCKSKGPASILSIITAILVLTFVTPINSMVVGESKEVFELEELPDDMLEMALKINFYYFVCVMNYAVTWGLIVVALLIGLIFKKYQHRFLNLYAMYCEECDMYHDRTGLKRNGDFTNKCRQCTCGQYEDATGLMTHRKTYNCLVQYKSKWILNFLITYMVLTLIKDSAIVVQATGTDFSSCLETQSVNWNCTGPFLNLGNCQKQQKKESYANIATQLKGLQAISVLDMPMIASIPEDIAGALRYIEERETFHVQLTAEYAMLTRYCDYYTQFADNSGYSQTTWRVYLRSHDFDACILYPNQHFCRCVKHGDKCSSSNWDFANEMKNYYSGKQNKFDKDLNLALMTMHHAFRGTSSAYIAALLSKRSNDDLVAYTNKIKEKFPGNALLKAVMDYISYMKSLSEMSNFKYDEFWDDLLHKPNPTKAPSLSRGDEPAYNFKLAISSRSMKSCKNVKSVVCLSPRSGVSYDSILACGEPNAPSVHRKPSDGVFQSNSDKTMYCLADSHCLEDFEVVSQEELDAIKKSECWVTEYPNVKLSKLSDGIKSCRMKDSGKCNVATNRWPIIQCENDKFYYSELQNDYDKTQDIGHFCLSPGCSTIRFPINQKHISNCNWQVSRSSIAKIDVHNIEDIEQYRKAITQKLQTSLSLFKYARTKNLPHIKPIYKYITIEGTETAEGIESAYIESEIPALAGTSIGFKINSKEGKHLLDVIGYVKSASYSSVYTKLYSTGPTSGINTKHDELCTGPCPANIKHQTGWLTFARERTSSWGCEEFGCLAISDGCVFGSCQDIVRDELSVYRKETEEVTDVELCLTFSDKTYCTNLNPITPIITDLFEVQFKTVETYSLPRIVAIQNHEIKIGQINDLGVYSKGCGNVQKVNGTVYGNGVPKFDYLCHLASRKEVIVRKCFDNDYQACKFLQTPASYRLEENSGTVTVIDYKKILGTIKMKAILGDVKYKTFADNVDITAEGSCTGCINCFENIHCELTIHTTIDASCPVTSPCTVFHDRILVTPNEHKYAMKVICTEKPGSTLAIKICNTKIDASLALIDAKPILELAPVDQTAYIREKDERCKTWMCRVRDEGLQVILEPFKNLFGSYIGIFYTFVISIIALLIVIYIILPICFKLRDTLRKHEDAYKREMKIR

SEQ ID NO: 1869 - protein, 1441 aa, Artificial Sequence
  derived and/or modified protein sequence (wt) from CHATV(LEIV-18733)__HQ734821.1__GP
MIFILVLLAVSTASPVYQRCFQDGAIVKQNPSKEAVTEVCLKDDVSMIKTEARYMKNATGTFSNNVAIRKWLVSDWHDCRPKKVSGGHINVIEVGDDLSLHTESYVCSADCTIGVDKETAQVRLQTDTTNHFEIAGTTVKSGWFKSTTYITLDQTCEHLKVSCGPKSVQFHACFNQHMSCVRFLHRTVLPGSIANSICQNIEIIILVTLTLLIFVLLSILSKTYICYLLMPIFIPIAYVYGIIYNKSCKKCKLCGLVYHPFTECGTHCVCGARYDTSDRMKLHRSSGLCPGYKSLRAARVMCKSKGPASILSIITAILVLTFVTPINSMVIGESKEVFELEELPDDMLEMALKINFYYFVCVINYAVTWGLIVVALLIGLVFKKYQHRFLNLYAMYCEECDMYHDRTGLKRNGDFTNKCRQCTCGQYEDATGLITHRKTYNCLVKYKSKWILNFLITYMVLTLIKDSAIVVQAAGTDFSACLEAQSVDWNCTGPFLNLGNCQKQQKKESYANIATQLKGLQAISVLDMPMIASIPEDIAGALRYIEEKETFHVQLTAEYAMLTRYCDYYTQFADNSGYSQTTWRVYLRSHDFDACILYPNQHFCRCVKHGDKCSSSNWDFANEMKNYYSGKQSKFDKDLNLALMTVHHAFRGTSSAYIATMLSKKSNNDLVAYTNKIKEKFPGNALLKAVMDYISYMKSLSEMTNFKYDEFWDDLLYRPNPTKAPSLSRESETSYNFKLVISPKSMKSCKNVKSVVCLSPRSGASYDSILACGEPNGPSVYRKPSGGVFQSNSDKTMYCLADSHCLEDFEVIGQEELDAIKKSVCWAVEYPDVTLSKLSDGVKSCRMKDSGKCNVAANRWPIIQCENDKFYYSELQNDYDKTQDIGHFCLSPGCSTVRFPINQKHISNCNWQVSRSSIAKIDVHDIEDIDQYRKAITQKLQTSLSLFKYAKTKNLPHIKPIYKYITIEGTETAEGIESAYIESEIPALAGTSVGFKINSKEGKHLLDIIGYVKSASYSSVYTKLYSTGPTSGINTKHDELCTGPCPANINHQNGWLTFAKERTSSWGCEEFGCLAISDGCVFGSCQDIVRDELSVYRKETEEVTDVELCLTFSDKTYCTNLNPITPIITDLFEVQFKTVETYSLPRIVAIQNHEIKIGQINDLGVYSKGCGNVQKVNGTVYGNGVPKFDYLCHLASRKEVIVRKCFDNDYQACKFLQTPASYRLEENSGTITVIDYKKILGTIKMKAILGDVKYKTFADNVDITVEGSCAGCINCFENIHCELTIHTTIEASCPVTSPCTVFHDRILITPNEHKYAMKVVCTEKPGNTLTLKVCNTKVDASLALIDAKPILELAPVDQTAYIREKDERCKTWMCRVRDEGLQVILEPFKNLFGSYIGIFYTIIISIIVLLIVIYIILPVCFKLRDTLRQHEDAYKREMKVR

SEQ ID NO: 1870 - protein, 1441 aa, Artificial Sequence
  derived and/or modified protein sequence (wt) from CHATV(LEIV-22712)__HQ734822.1__GP
MIFILILFAVSAASPVYQRCFQDGAIVKQNPSKEAVTEVCLKDDVSMIKTEARYTKNATGTFSNNVAIRKWLVSDWHDCRPKKVSGGHINVIEVGDDLSLHTESYVCSADCTIGVDKETAQIRLQTDTTNHFEIAGTTVKSGWFKSTTYITLDQTCEHLKVSCGPKSVQFHACFNQHMSCVRFLHRTVLPGSIANSICQNIEIIILVTLTLLIFVLLSILSKTYICYLLMPIFIPIAYVYGIIYNKSCKKCKLCGLVYHPFTECGTHCVCGARYDTSDRMKLHRSSGLCPGYKSLRAARVMCKSKGPASVLSIITAILVLTFVTPINSMVVGESKEVFELEELPDDMLEMALKINFYYFICVMNYAVTWGLIVVGLLIGLVFKKYQHRFLNLYAMYCEECDMYHDRTGLKRNGDFTNKCRQCTCGQYEDATGLITHRKTYNCLVQYKSKWILNFLIAYMTLTLIKDSAIIVQATGTDFISCLETQSVNWNCTGPFLNLGNCQKQQKKEPYANIATQLKGLQAISVLDIPMIANIPEDIAGALRYIEEKETFHVQLTAEYAMLTRYCDYYTQFADNSGYSQTTWRVYLRSHDFDACILYPNQHFCRCVKHGDKCSSSNWDFANEMKNYYSGKQSKFDKDLNLALMTMHHAFRGTSSAYIATLLSKKLNDDLAAYTNKIKEKFPGNALLKAMMDYISYMKSLSEMANFKYDEFWDDLLHKPDPTKAPLLSRGSEPVYNFKLVVSSRSVKSCKNVKSVVCLSPRSGVSYDSVLACGEPNGPSVYRKPSDGVFQSNSDKTIYCLADSHCLEDFEVISQEELDAIKKSECWVIEYPNVKLTKPSDGIKSCRMKDSGKCNVATNRWPIIQCENNNFYYSELQNDYDKTQDIGHFCLSPGCSTIRYPINQKHISNCNWQVSHSSIAKIDVHNIEDIEQYRKAITQKLQTSLSLFKYAKTKNLPHIKPIYKYITIEGTETAEGIESAYIESEIPALAGTSIGFKINSKEGKHLLDVIGYVKSASYSSVYSKLYSTGPTSGINTKHDELCTGPCPENIKHQTGWLTFARERTSSWGCEEFGCLAISDGCVFGSCQDIVKDELSVYRKETEEVTDVELCLTFSDKTYCTNLNPITPIITNLFEVQFKTVETYSLPRIVAIQNHEIKIGQINDLGVYSKGCGNVQKVNGTVYGNGVPKFDYLCHLASRKEVIVRKCFDNDYQACKFLQTPASYRLEENSGAITVIDYKKILGTIKMKAILGDVKYKTFADNVDITAEGSCTGCINCFENIHCELTIHTTIEASCPVTSPCTVFHDRILVTPNEHKYAMKVVCTEKPGSTLVIKVCNTKIDASLALIDAKPILELAPVDQTAYIREKDERCKTWMCRVRDEGLQVILEPFKNLFGSYIGIFYTFIISIIVLLIVIYIILPICFKLRDTLRKHEDAYKREMKIR

SEQ ID NO: 1871 - protein, 1443 aa, Artificial Sequence
  derived and/or modified protein sequence (wt) from INKV(KN3641)__U88059.1__GP
MEVLNLIWLLTLCSASPVFQRCFQDGAIVKQNPSKEAVTEVCLKDDVSMIKTEAKYIKNTTGTFANNIAMRKWLVADWHDCRPQKSSGGHINVIEVGDDLSLHTESYICSADCVITVDKETAQIRLQTDNTNHFEVAGTTVKSGWFKSTTYITLDQTCEHLKVSCGPKSIQFHACFNQHMSCVRFLHRTILPGSIANSICQNIEIIILVTLSLVIFIFLTIVSKTYVCYLLMPIFIPIAYIYGWIYNKSCKKCRLCGLVYHPFTECGTHCVCGARYETSDRMKLHRASGLCPGYKNLRAARVMCKSKGPASVLSIMTAVLILTFVTPISAMVIGESSEVYTLGDLPDDMVEMAERVNIYYQIIIINYSITWVFLLLGLIIAYFFRKYQHRFLSFYAMYCKECDMYHERAGLTYWGDFTNKCRQCTCGQFEDVTGLMVHKKSYNCIIKYKAKWIRDMLITYLLIMLIKDSLLFVGATGTDFAACIDEKTVTWNRTGPFLNLGRCDKSQKKTGYTDIADQLKGLGAISVLDIPMIKKMPDEISGSLKCIDDLETHHEQLTAEYAFLTRYCDYYTQYTDNSGYSQTVWRTYLRSHDFGACVVYPNQHFCRCVKHGDKCNSAKWDFANEMKTFYTGQKAKFNKDLNLALLVLHKAFRGTGTSYIAESMARKDNRSMTHFALEIKKKFPTNALLTALIDYISYLQSPAEMSTFELDEDWEDFKYKPEPTESPQLRSHRTDQYNFKNADSNSNVKVCKNIQKVSCISPRSRAKFENIIACGEHANPSVYTMPNVSIYQSNSERSHYCIADSHCLEEYEVVETELLNALKKSKCWAREMDDIVLHKQVDGLRSCRMKDTGNCNVQENDWTIVLCENGNYYYSEAHRDYDKDQDVGHFCLSPRCSTIRYPISKRHIKNCDWQISHSTIDKISVQELADIEQYKKAISQKLQTSLSIFKYVKTKNLPHIKPAYKYITVEGVETVEGIENAFIESEIPALAGTAIGFKINSREGNYLMDVIGYVKSGSYSATYTKLYITGPTIGVNTKHDEKCTGPCPAIIDHKEGWLTFAKGRTSTWGCEEFGCLAVSDGCVFGSCQDIIKDELAVHRKTTEEPTTVELCLTFSDKTYCTNLNAITPIITDKFEVQFKTVESYTLPRIIAIKNHEIKVGQINDLGVYSKGCGNVQKINGTNYGNGLPKFDYLCHLAGRKEVIIRKCFDNDYQACKFLQSPPSYRLEEHQGTVTVIDYKKILGTIKMEAILGDVKYRNYQSNIEINAKGTCAGCINCFENIHCEFTIHTTVEASCPIVTDWVSFHDRILITPDEHKYALKVVCQEKPKLSLKFKICNTNIDASMTVVDSKPILELAPVDQTTYIRERDERCKTWMCRVRDEGFQVILEPFKNLFGSYIGIFYTGILCIVCLLIVIYIILPICFKLRDTLRQLEDAYKKEVKIR

SEQ ID NO: 1872 - protein, 1443 aa, Artificial Sequence
  derived and/or modified protein sequence (wt) from INKV(SWAR83-161)__U88060.1__GP
MEVLNLIWLLTLCSASPVFQRCFQDGAIVKQNPSKEAVTEVCLKDDVSMIKTEAKYIKNATGTFANNIAMRKWLVADWHDCRPQKSSGGHINVIEVGDDLSLHTESYICSADCVITVDKETAQIRLQTDNTNHFEVAGTTVKSGWFKSTTYITLDQTCEHLKVSCGPKSIQFHACFNQHMSCVRFLHRTILPGSIANSICQNIEIIILVTLSLAIFIFLTIVSKTYVCYLLMPIFIPIAYIYGWIYNKSCKKCKLCGLVYHPFTECGTHCVCGARYETSDRMKLHRASGLCPGYKNLRAARVMCKSKGPASVLSIMTAILILTFVTPISAMVIGESSEVYTLDELPDDMVQMAERVNIYYQIIIINYSITWAFLLFGLVLAYFFKKYQHRFLSFYAMYCKECDMYHERAGLTYWGDFTNKCRQCTCGQFEDVTGLMVHKKSYNCIIKYKAKWIRDILITYLIIMLIKDSLLFVGATGTDFAACIDEKTVTWNCTGPFLNLGKCDKSQKKIGYADIADQLKGLGAISVLDIPMIKRMPDEISGSLKYIDGLETYHEQLTAEYAFLTRYCDYYTQYTDNSGYSQTVWRTYLRSHDFGACVVYPNQHFCRCVKHGDKCNSAKWDFANEMKTFYTGQKAKFNKDLNLALLVLHKAFRGTGTSYIAESMARKDNRSMTHFALEIKKKFPTNALLTALIDYISYLQSLAEMSTFELDEDWEDFKYKPEPTEAPQLRSHRTDQYNFKNADSNSNVKVCKNIQKVSCISPRSRAKFENIIACGEHANPSVYMMPNVSIYQSNSERSHYCIADSHCLEEYEVVESELLNALKKSKCWAKEMDDIVLHKQSDGLRSCRMKDTGNCNVQENDWTIVLCENGNYYYSEAHRDYDKDQDVGHFCLSPRCSTIRYPINKRHIRNCDWQISHSTIDKISVQELADIEQYKKAISQKLQTSLSIFKYVKTKNLPHIKPAYKYITVEGIETVEGIENAFIESEIPALAGTAIGFKINSREGNYLMDVIGYVKSASYSATYTKLYTTGPTIGVNTKHDEKCTGPCPPIIDHKEGWLTFAKERTSTWGCEEFGCLAVSDGCVFGSCQDIIKDELAVYRKTTEELTTVELCLTFSDKTYCTNLNAITPIITDKFEVQFKTVESYTLPRIIAIKNHEIKVGQINDLGVYSKGCGNVQKINGTNYGNGVPKFDYLCHLASRKEVIIRKCFDNDYQACKFLQSPPSYRLEEHQGTVTVIDYKKILGIIKMKAILGDVKYKNYQSNIEINAEGTCAGCINCFENIHCEFTIHTTVEASCPIVTDCVSFHDRILITPDEHKYALKVVCQEKPKLSLKFKICNTNIDASMTIVDSKPILELAPVDQTTYIREKDERCKTWMCRVRDEGFQVILEPFKNLFGSYIGIFYTGILCIICLLIVIYIILPICFKLRDTLRQHEDAYKKEMKIR

SEQ ID NO: 1873 - protein, 1443 aa, Artificial Sequence
  derived and/or modified protein sequence (wt) from INKV(Lovanger)__KU681435.1__GP
MEVLNLIWLLTLCSASPVFQRCFQDGAIVKQNPSKEAVTEVCLKDDVSMIKTEAKYIKNATGTFANNIAMRKWLVADWHDCRPQKSSGGHINVIEVGDDLSLHTESYICSADCVITVDKETAQIRLQTDNTNHFEVAGTTVKSGWFKSTTYITLDQTCEHLKVSCGPKSIQFHACFNQHMSCVRFLHRTILPGSIANSICQNIEIIILVTLSLAIFIFLTIVSKTYVCYLLMPIFIPIAYIYGWIYNKSCKKCKLCGLVYHPFTECGTHCVCGARYETSDRMKLHRASGLCPGYKSLRAARVMCKSRGPASVLSIMTAILILTFVTPISAMVIGESSEVYTLDELPDDMVQMAERVNIYYQIIIINYSITWAFLLFGLVLAYFFKKYQHRFLSFYAMYCKECDMYHERAGLTYWGDFTNKCRQCTCGQFEDVTGLMVHKKSYNCIIKYKAKWIRDILITYLIIMLIKDSLLFVGATGTDFAACIDEKTVTWNCTGPFLNLGRCDKSQKKIGYADIADQLKGLGAISVLDIPMIKRMPDEISGSLKYIDGLETYHEQLTAEYAFLTRYCDYYTQYTDNSGYSQTVWRTYLRSHDFGACVVYPNQHFCRCVKHGDKCNSAKWDFANEMKTFYTGQKAKFNKDLNLALLVLHKAFRGTGTSYIAESMARKDNRSMTHFALEIKKKFPTNALLTALIDYISYLQSLAEMSTFELDEDWEDFKYKPEPTEAPQLRSHRTDQYNFKNADSNSNVKVCKNIQKVSCISPRSRAKFENIIACGEHANPSVYMMPNVSIYQSNSERSHYCIADSHCLEEYEVVESELLNALKKSKCWAKEMDDIVLHKQADGLRSCRMKDTGNCNVQENDWTIVLCENGNYYYSEAHRDYDKDQDVGHFCLSPRCSTIRYPINKRHIRNCDWQISHSTIDKISVQELADIEQYKKAISQKLQTSLSIFKYVKTKNLPHIKPAYKYITVEGVETVEGIENAFIESEIPALAGTAIGFKINSREGNYLMDVIGYVKSASYSATYTKLYTTGPTIGVNTKHDEKCTGPCPPIIDHKEGWLTFAKERTSTWGCEEFGCLAVSDGCVFGSCQDIIKDELVVYRKTTEELTTVELCLTFSDKTYCTNLNAITPIITDKFEVQFKTVESYTLPRIIAIKNHEIKVGQINDLGVYSKGCGNVQKINGTNYGNGWPKFDYLCHLASRKEVIIRKCFDNDYKACKFLQSPPSYRLEEHQGTVTVIDYKKILGTIKMKAILGDVKYKNYQSNIEINAEGTCAGCINCFENIHCEFTIHTTVEASCPIVTDCVSFHDRILITPDEHKYALKVVCQEKPKLSLKFKICNTNIDASMTIVDSKPILELAPVDQTTYIREKDERCKTWMCRVRDEGFQVILEPFKNLFGSYIGIFYTGILCIICLLIIIYIILPICFKLRDTLRQHEDAYKKEMKIR

SEQ ID NO: 1874 - protein, 1443 aa, Artificial Sequence
  derived and/or modified protein sequence (wt) from INKV(Lovanger)__KX554936.1__GP
MEVLNLIWLLTLCSASPVFQRCFQDGAIVKQNPSKEAVTEVCLKDDVSMIKTEAKYIKNATGTFANNIAMRKWLVADWHDCRPQKSSGGHINVIEVGDDLSLHTESYICSADCVITVDKETAQIRLQTDNTNHFEVAGTTVKSGWFKSTTYITLDQTCEHLKVSCGPKSIQFHACFNQHMSCVRFLHRTILPGSIANSICQNIEIIILVTLSLAIFIFLTIVSKTYVCYLLMPIFIPIAYIYGWIYNKSCKKCKLCGLVYHPFTECGTHCVCGARYETSDRMKLHRASGLCPGYKSLRAARVMCKSRGPASVLSIMTAILILTFVTPISAMVIGESSEVYTLDELPDDMVQMAERVNIYYQIIIINYGITWAFLLFGLVLAYFFKKYQHRFLSFYAMYCKECDMYHERAGLTYWGDFTNKCRQCTCGQFEDVTGLMVHKKSYNCIIKYKAKWIRDILITYLIIMLIKDSLLFVGATGTDFAACIDEKTVTWNCTGPFLNLGRCDKSQKKIGYADIADQLKGLGAISVLDIPMIKRIPDEISGSLKYIDGLETYHEQLTAEYAFLTRYCDYYTQYTDNSGYSQTVWRTYLRSHDFGACVVYPNQHFCRCVKHGDKCNSAKWDFANEMKTFYTGQKAKFNKDLNLALLVLHKAFRGTGTSYIAESMARKDNRSMTHFALEIKKKFPTNALLTALIDYISYLQSLAEMSTFELDEDWEDFKYKPEPTEAPQLRSHRTDQYNLKNADSNSNVKVCKNIQKVSCISPRSRAKFENIIACGEHANPSVYMMPNVSIYQSNSERSHYCIADSHCLEEYEVVESELLNALKKSKCWAKEMDDIVLHKQADGLRSCRMKDTGNCNVQENDWTIVLCENGNYYYSEAHRDYDKDQDVGHFCLSPRCSTIRYPINKRHIRNCDWQISHSTIDKISVQELADIEQYKKAISQKLQTSLSIFKYVKTKNLPHIKPAYKYITVEGVETVEGIENAFIESEIPALAGTAIGFKINSREGNYLMDVIGYVKSASYSATYTKLYTTGPTIGVNTKHDEKCTGPCPPIIDHKEGWLTFAKERTSTWGCEEFGCLAVSDGCVFGSCQDIIKDELAVYRKTTEELTTVELCLTFSDKTYCTNLNAITPIITDKFEVQFKTVESYTLPRIIAIKNHEIKVGQINDLGVYSKGCGNVQKINGTNYGNGLPKFDYLCHLASRKEVIIRKCFDNDYQACKFLQSPPSYRLEEHQGTVTVIDYKKILGTIKMKAILGDVKYKNYQSNIEINAEGTCAGCINCFENIHCEFTIHTTVEASCPIVTDCVSFHDRILITPDEHKYALKVVCQEKPKLSLKFKICNTNIDASMTIVDSKPILELAPVDQTTYIREKDERCKTWMCRVRDEGFQVILEPFKNLFGSYIGIFYTGILCIICLLIVIYIILPICFKLRDTLRQHEDAYKKEMKIR

SEQ ID NO: 1875 - protein, 1444 aa, Artificial Sequence
  derived and/or modified protein sequence (wt) from JSV__AF123487.1__GP
MEVLNLIWLLALCSASPVFQRCFQDGAIVKQNPSKEAVTEVCLKDDVSMIKTEAKYVKNTTGTFANNIAMRKWLVADWHDCRPQKSSGGHINVIEVGDDLSLHTESYICSADCVITVDKETAQIRLQTDNTNHFEVAGTTVKSGWFKSTTYITLDQTCEHLKVSCGPKSIQFHACFNQHMSCVRFLHRTILPGSIANSICQNIEIIILVTLSLVIFIFLSIVSKTYVCYLLMPIFIPIAFIYGWIYNKSCKKCKLCGLVYHPFTECGTHCVCGARYETSDRMKLHRASGLCPGYKSLRAARVMCKSKGPASILSIMTAILILTFVTPISAMVIGESSEVYTLDDLPDDMVQMAERVNIYYQIIIINYGVTWAFLLLGLILAYFFKKYQHKFLDFYAMYCEECDMYHEKSGLTHWGDFTNKCRQCTCGQFEDVAGLMIHRKSYNCLVKYKARWIRDILIMYLAMILIKDSLLFVGASGTDFAACIDEKVVTWNCTGPFLNLGRCDKSQKKTNYEGIANQLKGLGVISVLDIPMIKNMPDEISGSLKYIDSLETYHEQLTAEYAFLTRYCDYYTQYTDNSGYSRTVWRTYLRSHDFGACVVYPNHHLCRCVKYGDKCNSAKWDFANEMKTFYTGQKVKFNKDLNLALLVLHKAFRGTGTAYVAEAMARKDNGSMAHFALEIRKKFPTNALLAALIDYIVYLQSLAEIATFELDEDWEDFKYKPEPTESTPQARSHRNDQYNFKNAESNSNTKVCKNVQKVLCISPRSKAKFENIIACGEHANPSVYMMPNVSIYQSNSERSHYCIADSHCLEKYEVVETELLNALKKSKCWAKEMDDIVLHKQSDGLRSCRIKDTGNCNVQENDWTIVLCENGNYYYSEVHKDYDKDQDVGHFCLSPRCTTIRYPISRRHIRKCEWQISHSTIDKISVQELADIEQYKKAISQKLQTSLSIFKYVRTKNLPHIKPAYKYITVEGVETIEGIENAFIESEIPALAGTAIGFKINSREGNYLMDVIGYVKSASYSAVYTKLYTTGPTIGINTKHDEKCTGPCPAVIDHKDGWLTFSKERTSTWGCEEFGCLAVSDGCVFGSCQDIIKDELAVYRKTTEELTTVELCLTFSDKTYCTNLNAITPIITDKFEVQFKTVESYTLPRVIAIKNHEIKVGQINDLGVYSKGCGNVQKVNGTNYGNGSPRFDYLCHLASRKEVILRKCFDNDYQACKFLQSPSSYRLEEHQGTVTVIDYKKILGTIKMKAILGDVIYINYQNNIEINAEGTCAGCIDCFENIHCEFTIHTTVEASCPITTECVSFHDRILITPDEHKYALKIVCHDKPKVSLKFKICNTNVDAAMTIVDSKPILELAPVDQTTYIREKDERCKTWMCRVRDEGFQVILEPFKNLFGSYIGIFYTGILSIICLLIVVYIILPICFKLRDTLRQHEDAYRKEMKIR

SEQ ID NO: 1876 - protein, 1444 aa, Artificial Sequence
  derived and/or modified protein sequence (wt) from JSV(BFS 4474)__KX817319.1__GP
MEVLNLIWLLALCSASPVFQRCFQDGAIVKQNPSKEAVTEVCLKDDVSMIKTEAKYVKNTTGTFANNIAMRKWLVADWHDCRPQKSSGGHINVIEVGDDLSLHTESYICSADCVITVDKETAQIRLQTDNTNHFEVAGTTVKSGWFKSTTYITLDQTCEHLKVSCGPKSIQFHACFNQHMSCVRFLHRTILPGSIANSICQNIEIIILVTLSLVIFIFLSIVSKTYVCYLLMPIFIPIAFIYGWIYNKSCKKCKLCGLVYHPFTECGTHCVCGARYETSDRMKLHRASGLCPGYKSLRAARVMCKSKGPASILSIMTAILILTFVTPISAMVIGESSEVYTLDDLPDDMVQMAERVNIYYQIIIINYGVTWAFLLLGLILAYFFKKYQHKFLDFYAMYCEECDMYHEKSGLTHWGDFTNKCRQCTCGQFEDVAGLMIHRKSYNCLVKYKARWIRDILIMYLAMILIKDSLLFVGASGTDFAACIDEKVVTWNCTGPFLNLGRCDKSQKKTNYEGIANQLKGLGVISVLDIPMIKNMPDEISGSLKYIDSLETYHEQLTAEYAFLTRYCDYYTQYTDNSGYSKTVWRTYLRSHDFGACVVYPNQHFCRCVKYGDKCNSAKWDFANEMKTFYTGQKVKFNKDLNLALLVLHKAFRGTGTAYVAEAMARKDNGSMAHFALEIRKKFPTNALLAALIDYIVYLQSLAEIATFELDEDWEDFKYKPEPTESTPQARSHRNDQYNFKNAESNSNTKVCKNVQKVLCISPRSKAKFENIIACGEHANPSVYMMPNVSIYQSNSERSHYCIADSHCLEKYEVVETELLNALKKSKCWAKEMDDIVLHKQSDGLRSCRIKDTGNCNVQENDWTIVLCENGNYYYSEVHKDYDKDQDVGHFCLSPRCTTIRYPISRRHIRKCEWQISHSTIDKISVQELADIEQYKKAISQKLQTSLSIFKYVRTKNLPHIKPAYKYITVEGVETIEGIENAFIESEIPALAGTAIGFKINSREGNYLMDVIGYVKSASYSAVYTKLYTTGPTIGINTKHDEKCTGPCPAVIDHKDGWLTFSKERTSTWGCEEFGCLAVSDGCVFGSCQDIIKDELAVYRKTTEELTTVELCLTFSDKTYCTNLNAITPIITDKFEVQFKTVESYTLPRVIAIKNHEIKVGQINDLGVYSKGCGNVQKVNGTNYGNGSPRFDYLCHLASRKEVILRKCFDNDYQACKFLQSPSSYRLEEHQGTVTVIDYKKILGTIKMKAILGDVKYKNYQNNIEINAEGTCAGCIDCFENIHCEFTIHTTVEASCPITTECVSFHDRILITPDEHKYALKIVCHDKPKVSLKFKICNTNVDAAMTIVDSKPILELAPVDQTTYIREKDERCKTWMCRVRDEGFQVILEPFKNLFGSYIGIFYTGILSIICLLIVVYIILPICFKLRDTLRQHEDAYRKEMKIR

SEQ ID NO: 1877 - protein, 1440 aa, Artificial Sequence
  derived and/or modified protein sequence (wt) from LUMV__AF123484.1__GP
MILVLFFVALSAAGPVYQRCFQDGAIVKQSPSKQAVTEVCLKDDVSMIKTEARYFKNTTGIYANNVAIRKWLVADWHDCRPKKVSGGHINVIEVGDDLTLHTEAYVCNADCIIGVDKETAQVRLQTDTTNHFEIAGTTVKSGWFKSTTYITLGQTCEHLKVSCGPKSIQFHACFNQHMSCVRFLHRTILPGSIANSVCQNIEIIILTVLTLLIFTLLSILSKTYICYILMPIFIPLAYIYGLIYNKSCKKCKLCGLVYHPFTECGTHCVCGARYDTSDRMKLHRASGLCPGYKSLRAARVMCKSKGPASVLSIITAVLILTFITPINAMIAGETQETFKLEDLPDDMLSMAMKINMYYIMCMLNYVATWSFIFCALIIALIFKKYQHKFLSYYAMYCQECDMYHDRSGLKYNGGFTNKCRQCTCGQYEDATGLMAHRKTYNCLIQYKSKWLVNFLITYIILMLIKDSVLIVHAEGTDFEKCSSDINIVWNCTGPFLSLGNCEKKQKKESYNDIAAQLKGLDAISVLDIPMISKIPEDIAGALRFIEEQNSYHVQLTVEYAMLTRYCDYYTQFSDNSGYSQTTWRTYLRSHDFEACILYPNQHFCRCVKHGDKCSRSNWDFANEMKNYYSGKQSKYNKDLNLALMSFHHAFRGTSSFYTAKLLREKKTEELKNYIDKIRTEYPGNALLKAVIDYIKYMMGLTEVSNFKHDEMWDDFIFENPSTRSSLSRNSESSYDFKTNINSDPTNTCKNIKAVTCLSPKSGVSFDSVIACGESNQPSIYQKPRKQVYQSNSEQTHFCLLDTHCLEGYETVGEEVLSAIKKSKCWETDFTEYIQFKQSDGVRSCRMKDSGECTVTTNKWPIILCENNRYYYSELHKDYDKDQDIGHFCLSPRCNTIRYPINQNHISNCTWQVRHNNIDKIEVHELEDLEQYRKAITQKLQTSLTLFKYSRTKNLPHIKPIYKYITIEGTETAEGIESAYIESEIPALAGTSIGFKITSKSGKHLLDVISYVKSASYSAVYTKLYTTGPTIGVNTKHDELCTGSCPVNVPHNTGWLTFARERTSSWGCEEFGCLAISDGCVFGSCQDIIKDELTVYREETEETTNVELCLTFADKTYCTNLNAITPIITDQFEVQFKTVEAYSLPRIIAVRNHEIMVGQINDIGVYSKGCGNVQKINNTNYGNGVPKFDYLCHLASRKEVIIRKCFDNDYQACKFLQTPASYRLEEEGGSVTVIDYKKILGTIKMKAILGDVKYKTFADNVDITVEGACTGCINCFDNIHCELTIHSTVEASCPITSSCTVFHDRILITPNEHKYAIKVICNGKPGISLPFKICNTKVDAAMTLTDAKQILELAPVDQTTYIKEKDERCKTWMCRVRDEGLQVIFEPFKNLFGSYIGIFYTFVIFLVVIFIVIYIVLPICFKLRDTLRQHEDAYKREMKIR

SEQ ID NO: 1878 - protein, 1440 aa, Artificial Sequence
  derived and/or modified protein sequence (wt) from LUMV(SAAr 1881)__KX817325.1__GP
MILVLFFVALSAAGPVYQRCFQDGAIVKQSPSKQAVTEVCLKDDVSMIKTEARYFKNTTGIYANNVAIRKWLVADWHDCRPKKVSGGHINVIEVGDDLTLHTEAYVCNADCIIGVDKETAQVRLQTDTTNHFEIAGTTVKSGWFKSTTYITLDQTCEHLKVSCGPKSIQFHACFNQHMSCVRFLHRTILPGSIANSVCQNIEIIILTVLTLLIFTLLSILSKTYICYILMPIFIPLAYIYGLIYNKSCKKCKLCGLVYHPFTECGTHCVCGARYDTSDRMKLHRASGLCPGYKSLRAARVMCKSKGPASVLSIITAVLILTFITPINAMIAGETQETFKLEDLPDDMLSMAMKINMYYIMCMLNYVATWSFIFCALIIALIFKKYQHKFLSYYAMYCQECDMYHDRSGLKYNGGFTNKCRQCTCGQYEDATGLMAHRKTYNCLIQYKSKWLVNFLITYIILMLIKDSVLIVHAEGTDFEKCSSDINIVWNCTGPFLSLGNCEKKQKKESYNDIAAQLKGLDAISVLDIPMISKIPEDIAGALRFIEEQNSYHVQLTVEYAMLTRYCDYYTQFSDNSGYSQTTWRTYLRSHDFEACILYPNQHFCRCVKHGDKCSRSNWDFANEMKNYYSGKQSKYNKDLNLALMSFHHAFRGTSSFYTAKLLREKKTEELKNYIDKIRTKYPGNALLKAVIDYIKYMMGLTEVSNFKHDEMWDDFIFENPSTRSSLSRNSESSYDFKTNINSDPTNTCKNIKAVTCLSPKSGVSFDSVIACGESNQPSIYQKPRKQVYQSNSEQTHFCLLDTHCLEGYETVGEEVLSAIKKSKCWETDFTEYIQFKQSDGVRSCRMKDSGECTVTTNKWPIILCENNRYYYSELHKDYDKDQDIGHFCLSPRCNTIRYPINQNHISNCTWQVRHNNIDKIEVHELEDLEQYRKAITQKLQTSLTLFKYSRTKNLPHIKPIYKYITIEGTETAEGIESAYIESEIPALAGTSIGFKITSKSGKHLLDVISYVKSASYSAVYTKLYTTGPTIGVNTKHDELCTGSCPVNVPHNTGWLTFARERTSSWGCEEFGCLAISDGCVFGSCQDIIKDELTVYRKETEETTNVELCLTFADKTYCTNLNAITPIITDQFEVQFKTVEAYSLPRIIAVRNHEIMVGQINDIGVYSKGCGNVQKINNTNYGNGVPKFDYLCHLASRKEVIIRKCFDNDYQACKFLQTPASYRLEEEGGSVTVIDYKKILGTIKMKAILGDVKYKTFADNVDITVEGACTGCINCFDNIHCELTIHSTVEASCPITSSCTVFHDRILITPNEHKYAIKVICNGKPGISLPFKICNTKVDAAMTLTDAKQILELAPVDQTTYIKEKDERCKTWMCRVRDEGLQVIFEPFKNLFGSYIGIFYTFVIFLVVIFIVIYIVLPICFKLRDTLRQHEDAYKREMKIR

SEQ ID NO: 1879 - protein, 1442 aa, Artificial Sequence
  derived and/or modified protein sequence (wt) from MELV__U88057.1__GP
MIALIFLIAIAAASPVYQRCFQDGGIVKQNPSKDAVTEVCLKDDVSMIKTEAKYMKNDTGTFSNNVAMRKWLVADWHDCRPQKSSGGHINVIEVGDDLSLHTEAYICSADCMISVDKETAQIRLQTDSTTHFEIAGTTVKSGWFKSTTYITLDQTCEHLKVSCGPKSIQFHACFNQHMSCVRFLHRTILPGSIANSICQNIEIIILVTLTLLIFIFLSILSKTYICYILMPMFIPVAYIYGWIYNKSCKKCKLCGLVYHPFTECGTHCVCGARYETSDRMKLHRSSGLCPGYKSLRAARVMCKSKGPASILSVLTAVLILTFVTPMNALTLGSSEENYKLENLPDDMLDMAERIDIYYLSIILNYSITWGLVILLGLTFILFRRFQHRFLNCYAMYCSECDMYHDKNGLVRNGDFTNKCRQCTCGQYEDAAGLIIHQKSYNCLIKYKAKWIRNILLTYIILILIKDSVLLTSAEGPDFSVCIEQKAISWNCTGPFLNLGRCEKTQKKASYATIATQLRSIDAISVLDIPMIAKIPEDISGALKYIESLKTYHEQLTAEYAMLTRYCDYYTQFSDNSGYSQTSWRKFLRSHDFESCIIYPNQHFCRCVKQDEKCSSAKWDFASEMKGFYLNKQAKFNKDLNLALSTFHKAFRGTPISYVTELISKNKNSSLLMYVSEIKRKFPGNALLVALLDFIMYLQSLSEISGFELGDEWEDFKYDPEPTEPALMPRSHRSDQYNFKNAASVSKTKTCENIKRVLCLSPRSRATFDDVVACGEFANPSVYMLPNITIYQSNIERSHYCIADSHCLEEFELVKPELLTALKKSTCWAGEIDDIVLHKQSDGLRSCRIKDTGTCDVLGNEWTIVLCENNNFYYSEVHRDYDKDQDIGHFCLSPRCNIIRYPINPRHIRTCKWQISHSTIDKITVHELADIEQYKKAITQKLQNSLSIFKYKRTKNLPHIKPIYKYIAIEGTETVEGIENAYIESEIPALAGTAIGFKINSKDGNHLMDVIGYVKSASYSSTYTKLYTTGPTIGINTKHDEKCTGSCPTQVKHKTGWLTFAKERTSTWGCEEFGCLAISDGCVFGSCQDIIKDELTVYRKTTDEVTELELCLTFADKTYCTNLNAVTPIITDKFEVQFKTVESYSLPRIIAVKNHEIKVGQINDIGVYSKGCGNVQKVNGTSYGNGVPKFDYLCHLASRKEVTIRKCFDNDYQACKFLQTPSSYRLEEHQGTVTIIDYKKILGSIKMKAILGDVKYKNYASNIDINAEGSCAGCINCFENIHCEFTIHSTVETSCQIESDCTSFHDRVLITPNEHKYALKLICHDKPASSLKFKICNTKVEAAMTLVDARPIIELAPVDQTAYIREKDERCKTWMCRVRDEGIQVIFEPFKNLFGSYIGIFYAIVICIIVLFLIVYIVLPICFKLKDTLKQHEDAYKREMKIR

SEQ ID NO: 1880 - protein, 1441 aa, Artificial Sequence
  derived and/or modified protein sequence (wt) from SAV__AF123486.1__GP
MIPLLFLVTLVSAGPVFQRCFQDGAIVKQNPSKEAVTEVCIKDDVSMIKTEARYVRNSSGVFSNNVALRKWLVSDWHDCKPKKVSGGHINVIEVGNDLTLHTESYVCSADCTIGIDKETAQIRLQTDTTNHFEVAGTTVKSGWFKSTTYITLDQTCEHLKVSCGPKSIQFHACFNQHMSCVRFLHRTILPGSMANSICQNIEIIILTTLALLIFLLLTILSKTYICYLLMPIFIPIAHLYGLIYNKSCKKCQLCGLVYHPFTECGTHCVCGARYETSDRMKLHRASGLCPGYKSLRAARVMCKSKGPASNLSIITAVLTLTFVTPINGLTIGDSKEVLNPDELPDDMLEMAQKLNMYQLICIINYTATWSIIIIGLAVFYIFKKYQHRFYNYYAMYCQECDMYHERSGLKWNGDFTNKCRQCTCGEYEDAAGLISHRKSYNCLLQYKVKWVMNFLTIYVALIILKDSTLIVQAAGTDFSDCIETEELNWNCTGPFLNLGNCEKKQKKESYSNIAEQLKGLQAISVLDIPLIARIPEDISGGLRYIESIRTHHAQLTAEYAMLTRYCDYHKLFGDNSGYSQTTWRMYLRSHDFGACILYPNQHFCRCVKHGEKCSSSSWDFASEMKNYYSGKQGKFNKDLNLALQSIHHAFRGTSSSYIATILSEKRNDQLVEYMEKLREKFIGNALLRAVLDFITYMKSLTEMTNFKHDEFWDEFVHLPAPTKAPSMRRSGNENYDFKAPTSPAGTKSCKNIKNVVCLSPRSGASYEGIVACGEPSAPQIFKMPSESIYHNNADQSMYCIADTHCLQDYSPVEDEELNAIKKSKCWETEFTNAVPFKQSDGIRSCRMRDSGNCNVTTNLWPVMQCDDGKFYYSEHQKDYDKDQDIGHFCLSPRCNMVRFPISEKNILACDWIVSHPNIDKIDVHSLEDLEQYKKAITQKLQTSLSIFKYAKTMNLPHVKPIYKYISIEGTETAEGVENAFIESEIPALAGTSIGFKVNSKDGKHIMDIIGYVKTASYSSVYTKLYTTSPTTGVNTKHDELCTGPCPKQIEHKNGWITFSKERTSSWGCEEFGCLAISDGCVFGSCQDIIKDEMSVYRKETEETTIVELCLTFSDKTYCVELNPVTPIITDLFEVQFKTVESYTLPRIVAVKNHEVMVGQINDLGVYSKGCGNVQKVNGTVYGNGVPKFDYLCHLASRKEVIIRKCFDNDYQACKFLQSPSSYRLEEDASTVSIIDYKKILGTIKMKAILGDVRYKTFSESIDISAEGTCTGCVNCFENIHCEFTIHSTVEASCPVVSTCTLFHDRILIGPDNHKYAMKVICTEAPKTSLSFKICNTKVDAAITIVDSKPIVELAPVDQTAYIREKDDRCKTWMCRVRDEGMQVLSEPFKNLFGSYIGIFYTGLAVLIIALIAVYIVMPICFKVKDILKKHDDAYRRELKIR

SEQ ID NO: 1881 - protein, 1441 aa, Artificial Sequence
  derived and/or modified protein sequence (wt) from SAV(20230)__KX817331.1__GP
MIPLLFLVTLVSAGPVFQRCFQDGAIVKQNPSKEAVTEVCIKDDVSMIKTEARYVRNSSGVFSNNVALRKWLVSDWHDCKPKKVSGGHINVIEVGNDLTLHTESYVCSADCTIGIDKETAQIRLQTDTTNHFEVAGTTVKSGWFKSTTYITLDQTCEHLKVSCGPKSIQFHACFNQHMSCVRFLHRTILPGSMANSICQNIEIIILTTLALLIFLLLTILSKTYICYLLMPIFIPIAYLYGLIYNKSCKKCQLCGLVYHPFTECGTHCVCGARYETSDRMKLHRASGLCPGYKSLRAARVMCKSKGPASILSIITAVLILTFVTPINGLTIGDSKEVFNLDELPDDMLEMAQKLNMYQLICIINYTATWSIIIIGLAVFYIFKKYQHRFYNYYAMYCQECDMYHERSGLKWNGDFTNKCRQCTCGEYEDAAGLISHKKSYNCLLQYKVKWVMNFLTIYVALIILKDSTLIVQAAGTDFSDCIETEELNWNCTGPFLNLGNCEKKQKKESYSNIAEQLKGLQAISVLDIPLIARIPEDISGGLRYIESIRTHHAQLTAEYAMLTRYCDYYKLFGDNSGYSQTTWRMYLRSHDFEACILYPNRHFCRCVKHGEKCSSSSWDFASEMKNYYSGKQGKFNKDLNLALQSIHHAFRGTSSSYIATILSEKRNDQLVEYMKKLREKFIGNALLRAVLDFITYMKSLTEMTNFKHDEFWDEFVHLPAPTKAPSMRRSGNENYDFKAPTSPAGTKSCKNIKNVVCLSPRSGASYEGIVACGEPSAPQIFKMPSESIYHNNADQSMYCIADTHCLQDYSPVEDEELNAIKKSKCWETEFTNAVPFKQSDGIRSCRMRDSGNCNVTTNLWPVMQCDDGKFYYSEHQKDYDKDQDIGHFCLSPRCNMVRFPISEKNILACDWIVSHPNIDKIDVHSLEDLEQYKKAITQKLQTSLSIFKYAKTMNLPHIKPIYKYISIEGTETAEGVENAFIESEIPALAGTSIGFKVNSKDGKHIMDIIGYVKTASYSSVYTKLYTTGPTTGVNTKHDELCTGPCPKQIEHKNGWITFSKERTSSWGCEEFGCLAISDGCVFGSCQDIIKDEMSVYRKETEETTIVELCLTFSDKTYCVELNPVTPIITDLFEVQFKTVESYTLPRIVAVKNHEVMVGQINDLGVYSKGCGNVQKVNGTVYGNGVPKFDYLCHLASRKEVIIRKCFDNDYQACKFLQSPSSYRLEEDASTVSIIDYKKILGTIKMKAILGDVRYKTFSESIDISAEGTCTGCVNCFENIHCEFTIHSTVEASCPVVSTCTLFHDRILIGPDNHKYAMKVICTEAPKTSLSFKICNTKVDAAITIVDSKPIVELAPVDQTAYIREKDDRCKTWMCRVRDEGMQVLLEPFKNLFGSYIGIFYTGLAVLIIALIAVYIVMPICFKVKDILKKHDDAYRRELKIR

SEQ ID NO: 1882 - protein, 1442 aa, Artificial Sequence
  derived and/or modified protein sequence (wt) from SDNV__AF123490.1__GP
MICILLLIALASASPVYQRCFQDGAIVKQYPAKDAVTEVCLKDDVSMIKTQANYMKNTTGTFSNNVAMRKWLVADWHDCRPQKSSGGHINVIEVGDDLSLHTEAYICSADCVISIDKETAQIRLQTDSTNHFEVSGTTVKSGWFKSTTYITLDQTCEHLKVSCGPKSIQFHACFNQHMSCVRFLHRTILPGSMANSICQNIEIIILVTLTLMIFILLTIISKTYICYILMPIFIPIAYIYGWIYNKSCKKCKLCGLVYHPFTECGTHCVCGARYETSDRMKLHRSSGLCPGYKSLRAARVMCKSRGPASILSILTAVLILTFVTPMSALVIGSSEELYKLDELPDDMIDMAEKVNLYYLVIVLNYSATWGLLLLMGILALLFKKYQHIFLNYYAMYCTECDMYHDKKELTYNGDSPTNAWQCTCGQYEDATGLIVHQKSYNCLVKYKVKWIKNILIMYIVLTLIKDSVLIASAEGPDFATCIEEKTITWNCTGPFLNLGRCDKTQKKTDYATIASQLKGIDAISILDVPMISKIPEDISGALKYIESLKTYHEQLTAEYAMFTRYCDYYTQFSDNSGYSQTTWRTYLRSHDFEVCIAYPNQHFCRCVKNGEKCSSAQWDFATEIKGYYTGRQNKFNKDLNLALMTFHTAFRGTATSYVTELISKGKNSSLLMYASAIKSKFNGNALLKALLDFMMYLQSLGEISGFKLTDEWEDFKYEEEPTEQTLMPRGHRGGQYNFKNAASNGKTKVCKNVKKVLCLSPRSRATFDDVIACGEHANPSVYMIPNTTIYQSNTERSHYCIADSHCLEEYELVKPELLTALKKSRCWAGDIDTIVLHKQSDGLRSCRIKDTGSCNVMGNDWTIVLCEDNKYYYSEVHQDYDKDQDVGHFCLSPRCNTIRYPISPRHINSCKWQISHSTIGKISVHELADIEQYKKAISQKLQTSLSIFKYAKTKNLPHIKPVYKYIAIEGTETVEGVENAFIESEIPALAGTAIGFKINSKEGYHLMDIIGYVKSASYSSTYTKLYTTGPTIGINTKHDEKCTGSCPGTIHHKTGWLTFSKERTSTWGCEEFGCLAVSDGCVYGSCQDIIKDELTVYRKISDEVTEVELCLTFSDKTYCTNLNAVTPIITDKFEVQFKTVESYSLPRIVGVRNHKIQIGQINDIGVYSKGCGNVQKVNGTNYGNGVPKFDYLCHLASRKEVIIRKCFDNDYQACKFLQTPASYRLEEHQGTVTIINYKKILGSIKMKPYWVMLRYKNYANSLDINAEGTCSGCVGCFENIHCEFTIHTTIEASCQIESDCTTFHDRILVTPNEHKYALKVICHDKPKTIFNFKICNTEIEAAIAIVDAKPIIELAPVDQTAYIREKDERCKTWMCRVRDEGIQVLLEPFKNLFGSYIGIFYTILIVIFILVIIIYIILPICFKLQDTLKQHEDAYKREMKIR

SEQ ID NO: 1883 - protein, 1442 aa, Artificial Sequence
  derived and/or modified protein sequence (wt) from SDNV(BeAr103645)__KX817334.1__GP
MICILLLIALASASPVYQRCFQDGAIVKQYPAKDAVTEVCLKDDVSMIKTQANYMKNTTGTFSNNVAMRKWLVADWHDCRPQKSSGGHINVIEVGDDLSLHTEAYICSADCVISIDKETAQIRLQTDSTNHFEVSGTTVKSGWFKSTTYITLDQTCEHLKVSCGPKSIQFHACFNQHMSCVRFLHRTILPGSMANSICQNIEIIILVTLTLMIFILLTIISKTYICYILMPIFIPIAYIYGWIYNKSCKKCKLCGLVYHPFTECGTHCVCGARYETSDRMKLHRSSGLCPGYKSLRAARVMCKSRGPASILSILTAVLILTFVTPMSALVIGSSEELYKLDELPDDMIDMAEKVNLYYLVIVLNYSATWGLLLLMGILALLFKKYQHIFLNYYAMYCTECDMYHDKKELTYNGDFTNKCRQCTCGQYEDATGLIVHQKSYNCLVKYKVKWIKNILIMYIILTLIKDSVLIASAEGPDFATCIEEKTITWNCTGPFLNLGRCDKTQKKTDYATIASQLKGIDAISILDVPMISKIPEDISGALKYIESLKTYHEQLTAEYAMFTRYCDYYTQFSDNSGYSQTTWRTYLRSHDFEVCIAYPNQHFCRCVKNGEKCSSAQWDFATEIKGYYTGKQNKFNKDLNLALMTFHTAFRGTATSYVTELISKGKNSSLLMYASAIKSKFNGNALLKALLDFMMYLQSLGEISGFKLTDEWEDFKYEEEPTEQTLMPRGHRGGQYNFKNAASNSKTKVCKNVKKVLCLSPRSRATFDDVIACGEHANPSVYMIPNTTIYQSNTERSHYCIADSHCLEEYELVKPELLTALKKSRCWAGDIDTIVLHKQSDGLRSCRIKDTGSCNVMGNDWTIVLCEDNKYYYSEVHQDYDKDQDVGHFCLSPRCNTIRYPISPRHINSCKWQISHSTIGKISVHELADIEQYKKAISQKLQTSLSIFKYAKTKNLPHIKPVYKYIAIEGTETVEGVENAFIESEIPALAGTAIGFKINSKEGNHLMDIIGYVKSASYSSTYTKLYTTGPTIGINTKHDEKCTGSCPGTIHHKTGWLTFSKERTSTWGCEEFGCLAVSDGCVYGSCQDIIKDELTVYRKISDEVTEVELCLTFSDKTYCTNLNAVTPIITDKFEVQFKTVESYSLPRIVGVRNHKIQIGQINDIGVYSKGCGNVQKVNGTNYGNGVPKFDYLCHLASRKEVIIRKCFDNDYQACKFLQTPASYRLEEHQGTVTIIDYKKILGSIKMKAILGDVRYKNYANSLDINAEGTCAGCVGCFENIHCEFTIHTTIEASCQIESDCTTFHDRILVTPNEHKYALKVICHDKPKTILNFKICNTKIEAAITIVDAKPIIELAPVDQTAYIREKDERCKTWMCRVRDEGIQVLLEPFKNLFGSYIGIFYTILIVIFILVIIIYIILPICFKLQDTLKQHEDAYKREMKIR

SEQ ID NO: 1884 - protein, 1441 aa, Artificial Sequence
  derived and/or modified protein sequence (wt) from SSHV__EU262553.1__GP
MICILILFAVTAASPVYQRCFQDGAIVKQNPSKEAVTEVCLKDDVSMIKTEARYIKNATGVFSNNVAIRKWLVSDWHDCRPKKITGGHINVIEVGDDLSLHTESYVCSADCTIGVDKETAQVRLQTDTTNHFEIAGTTVKSGWFKSTTYITLDQTCEHLKVSCGPKSIQFHACFNQHMSCVRFLHRTILPGSIANSICQNIEIIILVTLTLLIFILLSVLSKTYICYLLMPVFIPIAYAYGIIYNKSCKKCKLCGLVYHPFTECGTHCVCGARYDTSDRMKLHRASGLCPGYKSLRAARVMCKSKGPASILSVITAILILTFVTPINSMVVGESKEVFELEQLPDDMLDMALRINFYYFVCIMNYAVTWGLIIIGLLIGLLFKKYQHRFSNLYAMYCEECDMYHDRSGLKRNGDFTNKCRQCTCGQYEDATGLMTHRKTYNCLVRYKAKWVMNFLIAYMLLTLIKDSAIVVQAAGTDFTTCLETENINWNCTGPFLNLGNCQKQQKKEPYANIATQLKGLQAISVLDMPMIASIPEDIAGALRYIEEKETFHVQLTAEYAMLSRYCDYYAQFSDNSGYSQTTWRVYLRSHDFDACILYPNQHFCRCVKHGDKCSSSNRDFANEMKNYYSGKQNKFDKDLNLALMALHHAFRGTSSAYIATMLSKKSNDDLIAYTNKIKEKFPGNALLKAIVDYIAYMKSLSEMSSFKYDEFWDDLLYKSAPTKAPSLSRGSEPSYNFKLVVSSRSIKSCKNVKSVVCLSPRSGVSYDSIIACGDPNGPSVYRKPSDGVFQSNADQSTYCLADSHCLEDFEVVSQEELDAIKKSKCWEAEYPDVKLSKLTDGVKSCRMKDSGNCNVAANRWPIIQCENDKFYYSELQKDYDKTQDIGHFCLSPGCSTVRFPINPKHISNCNWQVSRSSIAKIDVHNIEDIDQYRKAITQKLQTSLSLFKYAKTKNLPHIKPIYKYITIEGTETAEGIESAYIESEIPALAGTSIGFKITSKEGKHLLDVIGYVKSASYSSIYTKLYTTGPTSGINTKHDELCTGPCPAKINHQTGWLTFAKERTSSWGCEEFGCLAISDGCVFGSCQDIIRDELTVYRKETDEVTDVELCLTFSDKTYCTNLNPITPIITDLFEVQFKTVETYSLPRIVAIQNHEIKIGQVNDLGVYSKGCGNVQKVNGTVYGNGVPKFDYLCHLASRKEVIVRKCFDNDYQACKFLQSPASYRLEEDSGTVTVIDYKKILGTIKMKAILGDVKYKTFADNVDMTAEGSCTGCINCFENIHCELTLHTTIEASCPIVSTCTVFHDRILVTPNEHKYALKVVCTEKPGNTLTIRICNTKVEASLALVDAKPILELAPVDQTAYIREKDERCKTWMCRVRDEGLQVILEPFKNLFGSYIGIFYTFIISIIALLIIIYIVLPICFKLRDTLRKHEDAYKREMKIR

SEQ ID NO: 1885 - protein, 1441 aa, Artificial Sequence
  derived and/or modified protein sequence (wt) from SSHV__K02539.1__GP
MICILILFAVTAASPVYQRCFQDGAIVKQNPSKEAVTEVCLKDDVSMIKTEARYIKNATGVFSNNVAIRKWLVSDWHDCRPKKITGGHINVIEVGDDLSLHTESYVCSADCTIGVDKETAQVRLQTDTTNHFEIAGTIVKSGWFKSTTYITLDQTCEHLKVSCGPKSIQFHACFNQHMSCVRFLHRTILPGSIANSICQNIEIIILVTLTLLIFILLSVLSKTYICYLLMPVFIPIAYAYGIIYNKSCKKCKLCGLVYHPFTECGTHCVCGARYDTSDRMKLHRASGLCPGYKSLRAARVMCKSKGPASILSVITAILILTFVTPINSMVVGESKEVFELEQLPDDMLDMALRINFYYFVCIMNYAVTWGLIIIGLLIGLLFKKYQHRFSNLYAMYCEECDMYHDRSGLKRNGDFTNKCRQCTCGQYEDATGLMTHRKTYNCLVRYKAKWVMNFLIAYMLLTLIKDSAIVVQAAGTDFTTCLETENINWNCTGPFLNLGNCQKQQKKEPYANIATQLKGLQAISVLDMPMIASIPEDIAGALRYIEEKETFHVQLTAEYAMLSRYCDYYAQFSDNSGYSQTTWRVYLRSHDFDACILYPNQHFCRCVKRGDKCSSSNGDFANEMKNYYSGKQNKFDKDLNLALMALHHAFRGTSSAYIATMLSKKSNDDLIAYTNKIKEKFPGNALLKAIVDYIAYMKSLSEMSSFKYDEFWDDLLYKSAPTKAPSLSRGSEPSYNFKLVVSSRSIKSCKNVKSVVCLSPRSGVSYDSIIACGDPNGPSVYRKPSDGVFQSNADQSTYCLADSHCLEDFEVVSQEELDAIKKSKCWEAEYPDVKLSKLTDGVKSCRMKDSGNCNVAANRWPIIQCENDKFYYSELQKDYDKTQDIGHFCLSPGCSTVRFPINPKHISNCNWQVSRSSIAKIDVHNIEDIDQYRKAITQKLQTSLSLFKYAKTKNLPHIKPIYKYITIEGTETAEGIESAYIESEIPALAGTSIGFKITSKEGKHLLDVIGYVKSASCSSIYTKLYTTGPTSGINTKHDELCTGPCPAKINHQTGWLTFAKERTSSWGCEEFGCLAISDGCVFGSCQDIIRDELTVYRKETDEVTDVELCLTFSDKTYCTNLNPITPIITDLFEVQFKTVETYSLPRIVAIQNHEIKIGQVNDLGVYSKGCGNVQKVNGTVYGNGVPKFDYLCHLASRKEVIVRKCFDNDYQACKFLQSPASYRLEEDSGTVTVIDYKKILGTIKMKAILGDVKYKTFADNVDMTAEGSCTGCINCFENIHCELTLHTTIEASCPIVSTCTVFHDRILVTPNEHKYALKVVCTEKPGNTLTIRICNTKVEASLALVDAKPILELAPVDQTAYIREKDERCKTWMCRVRDEGLQVILEPFKNLFGSYIGIFYTFIISIIALLIIIYIVLPICFKLRDTLRKHEDAYKREMKIR

SEQ ID NO: 1886 - protein, 1444 aa, Artificial Sequence
  derived and/or modified protein sequence (wt) from SORV__AF123488.1__GP
MEVLSLIWLLTLCSASPVFQRCFQDGAIVKQNPSKEAVTEVCLKDDVSMIKTETKYVKNTTGTFANNIAMRKWLVADWHDCRPQKSSGGHINVIEVGDDLSLHTESYICSADCVITVDKETAQIRLQTDNTNHFEVAGTTVKSGWFKSTTYITLDQTCEHLKVSCGPKSIQFHACFNQHMSCVRFLHRTILPGSIANSICQNIEIIILVTLSLVIFIFLTIVSKTYICYLLMPIFIPIAFIYGWIYNKSCKKCKLCGLVYHPFTECGTHCVCGARYETSDRMKLHRASGLCPGYKSLRAARVMCKSKGPASILSILTAILILTFVTPISAMVVGESNEIYTLDDLPDDMVQMAERINIYYQILIINYGVTWAFLLLGLVLAYFFKKYQHKFLDYYAMYCEECDMYHEKSGMTYWGDFTNKCRQCTCGQFEDATGLMVHKKSYNCLVKYKAKWIRNILIAYLMIMLVKDSLLFVGATRADFASCVDEKTVTWNCTGPFLNLGRCDKTQKKTGYKDIANQLKGLGVISILDIPMIEKMPDEISGSLKYIDSLETYHEQLTAEYAFLTRYCDYYTQYTDNSGYSQTVWRTYLRSHDFGACVVYPNQHFCRCVKYDDKCNSAKWDFANEMKTFYTGRKVKFNKDLNLALLVLHKAFRGTGTAYIAEAMARKDNGSMAHFALEIRKKFPTNALLAALIDYIVYLQSLAEISTFELEEDWEDFKYKPEPTESTLQPRSHRSDQYNFKNADSNSNVKVCKNVKKVLCVSPRSRAKFENIIACGEHANPSVYMMPNISIYQSNSERSHYCIADSHCLEEYEIVNTELLTALKKSRCWAKEMDDVVLHKQSDGLRSCRIKDTGSCNVLGNDWTIVLCENGNYYYSEIHKDYDKDQDVGHFCLSPRCSTIRYPINRRHIRKCDWQISHSTIDKISVQELADIEQYKKAISQKLQTSLSIFKYVKTKNLPHIKPAYKYITVEGTETIEGIENAFIESEIPALAGTAIGFKINSREGNYLMDVIGYVKSASYSATYTKLYTTGPTIGINTRHDEKCTGPCPVTIDHKDGWLTFSKERTSTWGCEEFGCLAVSDGCVFGSCQDIIKDELAVYRKTTEELTTVELCLTFSDKTYCTNLNAITPIITDKFEVQFKTVESYTLPRIIAVKNHEIKVGQINDLGVYSKGCGNVQKVNGTNYGNGVPKFDYLCHLASRKEVILRKCFDNDYQACKFLQSPASYRLEEHQGTVTVIDYKKILGSIKMKAILGDVKYKNYQSNIEINAEGTCAGCVNCFENIHCEFTIHTTVETSCPIVTDCVSFHDRILITPDEHKYALKIVCQDKPKVSLKFKICNTNIDASMTIVDSKPILELAPVDQTAYIKEKDERCKTWMCRVRDEGFQVILEPFKNLFGSYIGIFYTGILSVICLLIVIYIVLPICFKLRDTLKQHEDAYKKEMKIR

SEQ ID NO: 1887 - protein, 1444 aa, Artificial Sequence
  derived and/or modified protein sequence (wt) from SORV(SORV-252)__JN815081.1__GP
MEVLSLIWLLAVCSANPVFQRCFQDGAIVKQNPSKEAVTEVCLKDDVSMIKTEAKYVKNTTGTFSNNVAMRKWLVADWHDCRPQKSSGGHINVIEVGDDLSLHTESYICSADCVITVDKETAQIRLQTDSTNHFEVAGTTVKSGWFKSTTYITLDQTCEHLKVSCGPKSIQFHACFNQHMSCVRFLHRTILPGSIANSICQNIEIIILVTLSLIIFIFLTIVSKTYICYLLMPIFIPIAFIYGWIYNKSCKKCKLCGLVYHPFTECGTHCVCGARYETSDRMKLHRASGLCPGYKSLRAARVMCKSKGPASILSILTAVLILTFVTPISAIIIDESKEIYTLDDLPDDMVQMAERINIYYQILLINYGVTWAFLLLGLILAYFFKKYQHKFLDYYAMYCEECDMYHEKSGMTYWGDFTNKCRQCTCGQYEDAAGLMVHKKSYNCLIKYKAKWIKNILILYLIMILVKDSLLFVGATGTDFAACIDEKSVTWNCTGPFLNLGRCDKPQKKASFKDIANQLKGLGVISVLDIPMIEKMPDDISGSLKYIDSLRTYHEQLTAEYAFLTRYCDYYAQYTDNSGYSQTVWRTYLRSHDFGACVVYPNQHFCRCVKYGDKCNSAKWDFANEMKSFYTGQKAKFNKDLNLALLVLHKAFRGTGTAYIAETLARKDNGSMVHFALEIRKKFPTNALLAALIDYIVYLQSLAEISTFEPEEDWEDSKYQPEPTESVLQPRAHRSDQYNFKNADSNSNVKVCKNIKKVLCISPRSRAKFENIIACGEHANPSVYMMPNTSIYQSNSERSHYCIADSHCLEEYEIVNTELLTAFKKSRCWAKEIDDIVLHKQSDGLRSCRIKDTGSCNVLGNDWTIVLCENGNYYYSEVHKDYDKDQDVGHFCLSPRCNTIRYPISRRHIGECNWQITHSTIDKISVQELADIEQYKKAISQKLQTSLSIFKYVKTKNLPHIKPAYRYITVGGTETIEGVENAFIESEIPALAGTAIGFKINSREGNYLMDVIGYVKSASYSATYTKLYTTGPTIGINTKHDEKCTGSCPVTINHKDGWLTFSKERTSTWGCEEFGCLAVSDGCVFGSCQDIIKDELAVYRKTTEELTTVELCLTFSDKTYCTDLNAITPIITDKFEVQFKTVESYTLPRIIAVKNHEIRTGQINDLGVYSKGCGNVQKVNGTSYGNGVPKFDYLCHLASRKEVILRKCFDNDYQACKFLQSPASYRLEEHQGTVTVIDYKKILGSIKMKAMLGDVKYKNYQSNIEINAEGTCAGCIDCFENIHCEFTIHTTVEASCPITTDCVSFHDRILITPEEHKYALKIVCQDKPKVSLKFKICNTNVEASMTIIDSKPILELAPVDQTTYIKEKDERCKTWMCRVRDEGFQVILEPFKNLFGSYIGIFYTGVLSIICLLIVIYIILPICYKLRDTLKQHEDAYKKEMKIR

SEQ ID NO: 1888 - protein, 1444 aa, Artificial Sequence
  derived and/or modified protein sequence (wt) from SORV(NJO-94F)__KX817337.1__GP
MEVLSLIWLLTLCSASPVFQRCFQDGAIVKQNPSKEAVTEVCLKDDVSMIKTETKYVKNTTGTFANNIAMRKWLVADWHDCRPQKSSGGHINVIEVGDDLSLHTESYICSADCVITVDKETAQIRLQTDNTNHFEVAGTTVKSGWFKSTTYITLDQTCEHLKVSCGPKSIQFHACFNQHMSCVRFLHRTILPGSIANSICQNIEIIILVTLSLVIFIFLTIVSKTYICYLLMPIFIPIAFIYGWIYNKSCKKCKLCGLVYHPFTECGTHCVCGARYETSDRMKLHRASGLCPGYKSLRAARVMCKSKGPASILSILTAILILTFVTPISAMVVGESNEIYTLDDLPDDMVQMAERINIYYQILIINYGVTWAFLLLGLVLAYFFKKYQHKFLDYYAMYCEECDMYHEKSGMTYWGDFTNKCRQCTCGQFEDATGLMVHKKSYNCLVKYKAKWIRNILIAYLMIMLVKDSLLFVGATRADFASCVDEKTVTWNCTGPFLNLGRCDKTQKKTGYKDIANQLKGLGVISILDIPMIEKMPDEISGSLKYIDSLETYHEQLTAEYAFLTRYCDYYTQYTDNSGYSQTVWRTYLRSHDFGACVVYPNQHFCRCVKYGDKCNSAKWDFANEMKTFYTGRKVKFNKDLNLALLVLHKAFRGTGTAYIAEAMARKDNGSMAHFALEIRKKFPTNALLAALIDYIVYLQSLAEISTFELEEDWEDFKYKPEPTESTLQPRSHRSDQYNFKNADSNSNVKVCKNVKKVLCVSPRSRAKFENIIACGEHANPSVYMMPNISIYQSNSERSHYCIADSHCLEEYEIVNTELLTALKKSRCWAKEMDDVVLHKQSDGLRSCRIKDTGSCNVLGNDWTIVLCENGNYYYSEIHKDYDKDQDVGHFCLSPRCSTIRYPINRRHIRKCDWQISHSTIDKISVQELADIEQYKKAISQKLQTSLSIFKYVKTKNLPHIKPAYKYITVEGTETIEGIENAFIESEIPALAGTAIGFKINSREGNYLMDVIGYVKSASYSATYTKLYTTGPTIGINTRHDEKCTGPCPVTIDHKDGWLTFSKERTSTWGCEEFGCLAVSDGCVFGSCQDIIKDELAVYRKTTEELTTVELCLTFSDKTYCTNLNAITPIITDKFEVQFKTVESYTLPRIIAVKNHEIKVGQINDLGVYSKGCGNVQKVNGTNYGNGVPKFDYLCHLASRKEVILRKCFDNDYQACKFLQSPASYRLEEHQGTVTVIDYKKILGSIKMKAILGDVKYKNYQSNIEINAEGTCAGCVNCFENIHCEFTIHTTVETSCPIVTDCVSFHDRILITPDEHKYALKIVCQDKPKVSLKFKICNTNIDASMTIVDSKPILELAPVDQTAYIKEKDERCKTWMCRVRDEGFQVILEPFKNLFGSYIGIFYTGILSVICLLIVIYIVLPICFKLRDTLKQHEDAYKKEMKIR

SEQ ID NO: 1889 - protein, 1440 aa, Artificial Sequence
  derived and/or modified protein sequence (wt) from TAHV__AF123485.1__GP
MMFVLFFIALSAASPVYQRCFQDGAIVKQNPSKQAVTEVCLKDDVSMIKTEARYFRNATGTYANNVAIRKWLVSDWHDCRPKKVSGGHINVIEVGDDLTLHTEAYVCNADCTIGVDKETAQVRLQTDTTNHFEIAGTTVKSGWFKSTTYITLDQTCEHLKVSCGPKSIQFHACFNQHMSCVRFLHRTILPGSIASSICQNVEIIILTVLTLLIFILLSILSKTYICYILMPIFIPLAYIYGVIYNKSCKKCKLCGLVYHPFTECGTHCVCGARYETSDRMKLHRASGLCPGYKSLRAARVMCKSKGPASILSIITAVLILTFVTPINAMVAGDTQETFKLEDLPDDMLSMAMKVNMYYIMCMINYAVTWSFILCALLIALLFKKYQHRFLNFYAMYCHECDMYHDRSGLKYNGDFTNKCRQCTCGQYEDAAGLLTHRKTYNCLVQYKSKWLTNFLIVYIILMLIKDSVLIVHADGTDFEKCSGEVDITWNCTGPFLNLGNCEKKQKKESYNNIATQLKGLDAISVLDIPMISKIPEDIAGALRFIEEQRSYHVQLTAEYAMLTRYCDYYTQFTDNSGYSQTTWRVYLRSHDFKACILYPNQHFCRCVKHGDKCSSSNWDFANEMKNYYSGKQSKFDKDLNLALMSLHHAFRGTSSFYIAKLLKEKKNEDLVTYAEKIKGKYPGNALLKAIIDYIKYMEDLTEMNNFKHDEMWDDFIFEVPPTKSPSIRRLESSYDFKTNVNSNPSHICKNIKTVVCLSPKSGVSYDSIIACGEPSQPSIYRKPDSQVFQSNADQTHFCLSDTHCLENYETVGEEIIDAIKKSKCWETEFTEYIQFKQSDGVRSCRMKDSGECTVTTNRWPIILCDNDKFYYSELQKDYDKDQDIGHFCLSPRCNTIRHPINRKHISNCTWQVSHNNIDKIEVHELEDLEQYKKAITQKLQTSLTLFKYSKTKNLPHIKPMYKYITIEGTETAEGLESAYIESEIPALAGTSIGFKITSKSGKHLLDVIGYVKSASYSAVYTKLYTTGPTIGVNTKHDELCTGPCPVNVPHGTGWLTFAKERTSSWGCEEFGCLAISDGCVFGSCQDIIKDEITVYRKETEETTDVELCLTFADKTYCTNLNAITPIITDQFEVQFKTVEAYSLPRIIAVRNHEIMVGQINDIGVYSKGCGNVQKVNNTNYGNGVPKFDYLCHLASRKEVIVRKCFDNDYQACKFLQTPASYRLEEEGGSVTVIDYKKILGTIKMKAILGDVKYKTFADNVDLTVEGVCTGCINCFENIHCELTIHSTVEASCPVVSSCTVFHDRILITPNEHKYAIKVICNEKPGPTLPFKICSAKTDAAMTLADAKPILELAPVDQTTYIKEKDERCKTWMCRVRDEGFQVIFEPFKNLFGSYIGIFYTFIISLMAIFIVIYIVLPICFKLRDTLRQHEDAYKREMKIR

SEQ ID NO: 1890 - protein, 1440 aa, Artificial Sequence
  derived and/or modified protein sequence (wt) from TAHV__AF229129.1__GP
MMFVLFFIALSAASPVYQRCFQDGAIVKQNPSKQAVTEVCLKDDVSMIKTEARYFRNATGTYANNVAIRKWLVSDWHDCRPKKVSGGHINVIEVGDDLTLHTEAYVCNADCTIGVDKETAQVRLQTDTTNHFEIAGTTVKSGWFKSTTYITLDQTCEHLKVSCGPKSIQFHACFNQHMSCVRFLHRTILPGSIASSICQNVEIIILTVLTLLIFILLSILSKTYICYILMPIFIPLAYIYGVIYNKSCKKCKLCGLVYHPFTECGTHCVCGARYETSDRMKLHRASGLCPGYKSLRAARVMCKSKGPASILSIITAVLILTFVTPINAMVAGDTQETFKLEDLPDDMLSMAMKVNMYYIMCMINYAVTWSFILCALLIALLFKKYQHRFLNFYAMYCHECDMYHDRSGLKYNGDFTNKCRQCTCGQYGDAAGLLTHRKTYNCLVQYKSKWLTNFLIGYIILMLIKDSVLLVHADGTDFEKCSGEADITWNCTGPFLSLGNCEKKQKKESYNNIATQLKGLDAISVLDIPMISKIPEDIAGALRFIEEQRSYHVQLTAEYAMLTRYCDYYTQFTDNSGYSQTTWRVYLRSHDFEACILYPNRHFCRCVKHGDKCSSSNWDFANEMKNYYSGKQSKFNKDLNLALMSLHHAFRGTSSFYIAKLLKEKKNEDLVTYAEKIKGKYPGNALLKAIIDYIKYMKGLTEMNNFKHDEMWDDFIFEVPPTKSPSVRRLESSYDFKTNVNSNPSHICKNIKTVVCLSPKSGVSYDSIIACGEPSQPSIYRKPDSQVFQSNADQTHFCLSDTHCLENYETVGEEIIDAIKKSKCWETEFTEYTQLKQSDGVRSCRMKDSGECTVTTNRWPIILCDNDKFYYSELQKDYDKDQDIGHFCLSPRCNTIRHPINRKHISNCTWQVNHNNIDKIEVHELEDLEQYKKAITQKLQTSLTLFKYSKTKNLPHIKPMYKYITIEGTETAEGIESAYIESEIPALAGTSIGFKITSKSGKHLLDVIGYVKSASYSAVYTKLYTTGPTIGVNTKHDELCTGPCPVNVPHGTGWLTFAKERTSSWGCEEFGCLAISDGCVFGSCQDIIKDEITVYRKETEETTDVELCLTFADKTYCTNLNAITPIITDQFEVQFKTVEAYSLPRIIAVRNHEIMVGQINDIGVYSKGCGNVQKVNNTNYGNGAPKFDYLCHLASRKEVIVRKCFDNDYQACKFLQTPASYRLEEEGGSVTVIDYKKILGTIKMKAILGDVKYKTFADNVDLTVEGVCTGCVNCFENIHCESTIHSTVEASCPVISSCTVFHDRILITPNEHKYAIKVICNEKPGPTLPFKICSAKTDAAMTLADAKPILELAPVDQTTYIKEKVERCKTWMCRVRDEGFQVIFEPFKNLFGSYIGIFYTFIISLMAIFIVIYIVLPICFKLRDTLRQHEDAYKREMKIR

SEQ ID NO: 1891 - protein, 1440 aa, Artificial Sequence
  derived and/or modified protein sequence (wt) from TAHV(22595-6)__HM036218.1__GP
MMFVLFFIALSAASPVYQRCFQDGAIVKQNPSKQAVTEVCLKDDVSMIKTEARYFRNATGTYANNVAIRKWLVSDWHDCRPKKVSGGHINVIEVGDDLTLHTEAYVCNADCTIGVDKETAQVRLQTDTTNHFEIAGTTVKSGWFKSTTYITLDQTCEHLKVSCGPKSIQFHACFNQHMSCVRFLHRTILPGSIASSICQNVEIIILTVLTLLIFILLSILSKTYICYILMPIFIPLAYIYGVIYNKSCKKCKLCGLVYHPFTECGTHCVCGARYETSDRMKLHRASGLCPGYKSLRAARVMCKSKGPASILSIITAVLILTFVTPINAMVAGDTQETFKLEDLPDDMLSMAMKVNMYYIMCMINYAVTWSFILCALLIALLFKKYQHRFLNFYAMYCHECDMYHDRSGLKYNGDFTNKCRQCTCGQYEDAAGLLTHRKTYNCLVQYKSKWLTNFLIVYIILMLIKDSVLIVHADGTDFEKCSGEADITWNCTGPFLNLGNCEKKQKKESYNNIATQLKGLDAISVLDIPMISKIPEDIAGALRFIEEQRSYHVQLTAEYAMLTRYCDYYTQFTDNSGYSQTTLRVYLRSHDFKACILYPNQHFCRCVKHGDKCSSSNWDFANEMKNYYSGKQSKFDKDLNLALMSLHHAFRGTSSFYIAKLLKEKKNEDLVTYAEKIKGKYPGNALLKAIIDYIKYMEDLTEMNNFKHDEMWDDFIFEVPPTKSPSIRRLESSYDFKTNVNSNPSHICKNIKTVVCLSPKSGVSYDSIIACGEPSQPSIYRKPDSQVFQSNADQTHFCLSDTHCLENYETVGEEIIDAIKKSECWETEFTEYIQFKQSDGVRSCRMKDSGECTVTTNRWPIILCDNDKFYYSELQKDYDKDQDIGHFCLSPRCNTIRHPINRKHISNCTWQVSHNNIDKIEVHELEDLEQYKKAITQKLQTSLTLFKYSKTKNLPHIKPMYKYITIEGTETAEGIESAYIESEIPALAGTSIGFKITSKSGKHLLDVIGYVKSASYSAVYTKLYTTGPTIGVNTKHDELCTGPCPVNVPHGTGWLTFAKERTSSWGCEEFGCLAISDGCVFGSCQDIIKDEITVYRKETEETTDVELCLTFADKTYCTNLNAITPIITDQFEVQFKTVEAYSLPRIIAVRNHEIMVGQINDIGVYSKGCGNVQKVNNTNYGNGVPKFDYLCHLASRKEVIVRKCFDNDYQACKFLQTPASYRLEEEGGSVTVIDYKKILGTIKMKAILGDVKYKTFADNVDLTVEGVCTGCINCFENIHCELTIHSTVEASCPVVSSCTVFHDRILITPNEHKYAIKVICNEKPGPTLPFKICSAKTDAAMTLADAKPILELAPVDQTTYIKEKDERCKTWMCRVRDEGFQVIFEPFKNLFGSYIGIFYTFIISLMAIFIVIYIVLPICFKLRDTLRQHEDAYKREMKIR

SEQ ID NO: 1892 - protein, 1440 aa, Artificial Sequence
  derived and/or modified protein sequence (wt) from TAHV(92' Bardos)__HM036209.1__GP
MMFVLFFIALSAASPVYQRCFQDGAIVKQNPSKQAVTEVCLKDDVSMIKTEARYFRNATGTYANNVAIRKWLVSDWHDCRPKKVSGGHINVIEVGDDLTLHTEAYVCNADCTIGVDKETAQVRLQTDTTNHFEIAGTTVKSGWFKSTTYITLDQTCEHLKVSCGPKSIQFHACFNQHMSCVRFLHRTILPGSIASSICQNVEIIILTVLTLLIFILLSILSKTYICYILMPIFIPLAYIYGVIYNKSCKKCKLCGLVYHPFTECGTHCVCGARYETSDRMKLHRASGLCPGYKSLRAARVMCKSKGPASILSIITAVLILTFVTPINAMVAGDTQETFKLEDLPDNMLSMAMKVNMYYIMCMINYAVTWSFILCALLIALLFKKYQHRFLNFYAMYCHECDMYHDRSGLKYNEDFTNKCRQCTCGQYEDAAGLLTHRKTYNCLVQYKSKWLTNFLIVYIILMLIKDSVLIVHADGTDFEKCSGEADITWNCTGPFLNLGNCEKKQKKESYNNIATQLKGLDAISVLDISMISKIPEDIAGALRFIEEQRSYHVQLTAEYAMLTRYCDYYTQFTDNSGYSQTTWRVYLRSHDFEACILYPNQHFCRCVKHGDKCSSSNWDFANEMKNFYSGKQSKFDKDLNLALMSLHHAFRGTSSFYIAKLLKEKKNEDLVTYAEKIKGKYPGNALLKAIIDYIKYMEDLTEMNNFKYDEMWDDFIFEVPPTKSPSIRRLESSYDFKTNVNSNPSHICKNIKTVVCLSPKSGVSYDSIIACGEPSQPSIYRKPDSQVFQSNADQTHFCLSDTHCLENYETVGEEIIDAIKKSKCWETEFTEYIQFKQSDGVRSCRMKDSGECTVTTNRWPIILCDNDKFYYSELQKDYDKDQDIGHFCLSPRCNTIRHPINRKHISNCTWQVSHNNIDKIEVHELEDLEQYKKAITQKLQTSLTLFKYSKTKNLPHIKPMYKYITIEGTETAEGIESAYIESEIPALAGTSIGFKITSKSGKHLLDVIGYVKSASYSAVYTKLYTTGPTIGVNTKHDELCTGPCPVNVPHGTGWLTFAKERTSSWGCEEFGCLAISDGCVFGSCQDIIKDEITVYRKETEETTDVELCLTFADKTYCTNLNAITPIITDQFEVQFKTVEAYSLPRIIAVRNHEIMVGQINDIGVYSKGCGNVQKVNNTNYGNGVPKFDYLCHLASRKEVIVRKCFDNDYQACKFLQTPASYRLEEEGGSVTVIDYKKILGTIKMKAILGDVKYKTFADNVDLTVEGVCTGCINCFENIHCELTIHSTVEASCPVVSSCTVFHDRILITPNEHKYAIKVICNEKPGPTLPFKICSAKTDAAMTLADAKPILELAPVDQTTYIKEKDERCKTWMCRVRDEGFQVIFEPFKNLFGSYIGIFYTFIISLMAIFIVIYIVLPICFKLRDTLRQHEDAYKREMKIR

SEQ ID NO: 1893 - protein, 1440 aa, Artificial Sequence
  derived and/or modified protein sequence (wt) from TAHV(92' Bardos)__HM036212.1__GP
MMFVLFFIALSAASPVYQRCFQDGAIVKQNPSKQAVTEVCLKDDVSMIKTEARYFRNATGTYANNVAIRKWLVSDWHDCRPKKVSGGHINVIEVGDDLTLHTEAYVCNADCTIGVDKETAQVRLQTDTTNHFEIAGTTVKSGWFKSTTYITLDQTCEHLKVSCGPKSIQFHACFNQHMSCVRFLHRTILPGSIASSICQNVEIIILTVLTLLIFILLSILSKTYICYILMPIFIPLAYIYGVIYNKSCKKCKLCGLVYHPFTECGTHCVCGARYETSDRMKLHRASGLCPGYKSLRAARVMCKSKGPASILSIITAVLILTFVTPINAMVAGDTQETIKLEDLPDDMLSTAMKVNMYYIMCMINYAVTWSFILCALLIALLFKKYQHRFLNFYAMYCHECDMYHDRSGLKYNEDFTNKCRQCTCGQYEDAAGLLTHRKTYNCLVQYKSKWLTNFLIVYIILMLIKDSVLIVHADGTDFEKCSGEADITWNCTGPFLNLGNCEKKQKKESYNNIATQLKGLDAISVLDISMISKIPEDIAGALRFIEEQRSYHVQLTAEYAMLTRYCDYYTQFTDNSGYSQTTWRVYLRSHDFKACILYPNQHFCRCVKHGDKCSSSNWDSANEMKNFYSGNQSKFDKDLNLALMSLHHAFRGTSSFYIAKLLKEKKNEDLVTYAEKIKGKYPGNALLKAIIDYIKYMEDLTEMNNFKYDEMWDDFIFEVPPTKSPSIRRLESSYDFKTNVNSNPSHICKNIKTVVCLSPKSGVSYDSIIACGEPSQPSIYRKPDSQVFQSNADQTHFCLSDTHCLENYETVGEEIIDAIKKSKCWETEFTEYIQFKQSDGVRSCRMKDSGECTVTTNRWPIILCDNDKFYYSELQKDYDKDQDIGHFCLSPRCNTIRHPINRKHISNCTWQVSHNNIDKIEVHELEDLEQYKKAITQKLQTSLTLFKYSKTKNLPHIKPMYKYITIEGTETAEGIESAYIESEIPALAGTSIGFKITSKSGKHLLDVIGYVKSASYSAVYTKLYTTGPTIGVNTKHDELCTGPCPVNVPHGTGWLTFAKERTSSWGCEEFGCLAISDGCVFGSCQDIIKDEITVYRKETEETTDVELCLTFADKTYCTNLNAITPIITDQFEVQFKTVEAYSLPRIIAVRNHEIMVGQINDIGVYSKGCGNVQKVNNTNYGNGVPKFDYLCHLASRKEVIVRKCFDNDYQACKFLQTPASYRLEEEGGSVTVIDYKKILGTIKMKAILGDVKYKTFADNVDLTVEGVCTGCINCFENIHCELTIHSTVEASCPVVSSCTVFHDRILITPNEHKYAIKVICNEKPGPTLPFKICSAKTDAAMTLADAKPILELAPVDQTTYIKEKDERCKTWMCRVRDEGFQVIFEPFKNLFGSYIGIFYTFIISLMAIFIVIYIVLPICFKLRDTLRQHEDAYKREMKIR

SEQ ID NO: 1894 - protein, 1440 aa, Artificial Sequence
  derived and/or modified protein sequence (wt) from TAHV(Souche D C14019-29)__HM036215.1__GP
MMFVLFFIALSAASPVYQRCFQDGAIVKQNPSKQAVTEVCLKDDVSMIKTEARYFKNATGTYANNVAIRKWLVSDWHDCRPKKVSGGHINVIEVGDDLTLHTEAYVCNADCTIGVDKETAQVRLQTDTTNHFEIAGTTVKSGWFKSTTYITLDQTCEHLKVSCGPKSIQFHACFNQHMSCVRFLHRTILPGSIASSICQNVEIIILTVLTLLIFILLSILSKTYICYILMPIFIPLAYIYGVIYNKSCKKCKLCGLVYHPFTECGTHCVCGARYETSDRMKLHRASGLCPGYKSLRAARVMCKSKGPASILSIITAVLILTFVTPINAMVAGDTQETFKLEDLPDDMLSMAMKVNMYYIMCMINYAVTWSFILCALLIALLFKKYQHRFLNFYAMYCHECDMYHDRSGLKYNGDFTNKCRQCTCGQYEDAAGLLTHRKTYNCLVQYKSKWLTNFLIVYIILMLIEDSVLIVHADGTDFEKCSGEADITWNCTGPFLNLGNCEKKQKKESYNNIATQLKGLDAISVLDIPMISKIPEDIAGALRFIEEQRSYHVQLTAEYAMLTRYCDYYTQFTDNSGYSQTTWRVYLRSHDFEACILYPNRHFCRCVKHGDKCSSSNWDFANEMKNYYSGKQSKFNKDLNLALMSLHHAFRGTSSFYIAKLLKEKKNEDLVTYAEKIKGKYPGNALLKAIIDYIKYMKDLTEMNNFKHDEMWEDFIFEVPPTKSPSVRRLESSYDFKTNVNSNPSHICKNIKTVVCLSPKSGVSYDSIIACGEPSQPSIYRKPDSQVFQSNADQTHFCLSDTHCLENYETVGEEIIDAIKKSKCWETEFTEYIQFKQSDGVRSCRMKDSGECTVATNRWPIILCDNNKFYYSELQEDYDKDQDIGHFCLSPRCNTIRHPINRKHISNCTWQVSHNNIDKIEVHELEDLEQYKKAITQKLQTSLTLFKYSKTKNLPHIKPMYKYITIEGTETAEGIESAYIESEIPALAGTSIGFKITSKSGKHLLDVIGYVKSASYSAVYTKLYTTGPTIGVNTKHDELCTGPCPVNVPHGTGWLTFAKERTSSWGCEEFGCLAISDGCVFGSCQDIIKDEITVYRKETEETTDVELCLTFADKTYCTNLNAITPIITDQFEVQFKTVEAYSLPRIIAVRNHEIMVGQINDIGVYSKGCGNVQKVNNTNYGNGVPKFDYLCHLASRKEVIVRKCFDNDYQACKFLQTPASYRLEEEGGSVTVIDYKKILGTIKMKAILGDVKYKTFADNVDLTVEGVCTGCINCFENIHCELTIHSTVEASCPVVSSCTVFHDRILITPNEHKYAIKVICNEKPGPILPFKICSAKTDAAMTLADAKPILELAPVDQTTYIKEKDERCKTWMCRVRDEGFQVIFEPFKNLFGSYIGIFYTFIISLMAIFIVIYIVLPICFKIRDTLRQHEDAYKREMKIR

SEQ ID NO: 1895 - protein, 1440 aa, Artificial Sequence
  derived and/or modified protein sequence (wt) from TAHV(1014)__GQ386833.1__GP
MMFVLFFIALSAASPVYQRCFQDGAIVKQNPSKQAVTEVCLKDDVSMIKTEARYFRNATGTYANNVAIRKWLVSDWHDCRPKKVSGGHINVIEVGDDLTLHTEAYVCNADCTIGVDKETAQVRLQTDTTNHFEIAGTTVKSGWFKSTTYITLDQTCEHLKVSCGPKSIQFHACFNQHMSCVRFLHRTILPGSIASSICQNVEIIILTVLTLLIFILLSILSKTYICYILMPIFIPLAYIYGVIYNKSCKKCKLCGLVYHPFTECGTHCVCGARYETSDRMKLHRASGLCPGYKSLRAARVMCKSKGPASILSIITAVLILTFVTPINAMVAGDTQETFKLEDLPDDMLSMAMKVNMYYIMCMINYAVTWSFILCALLIALLFKKYQHRFLNFYAMYCHECDMYHDRSGLKYNGDFTNKCRQCTCGKYEDAAGLLTHRKTYNCLVQYKSKWLTNFLIVYIILMLIKDSVLIVHADGTDFEKCSGEADITWNCTGPFLNLGNCEKKQKKESYNNIATQLKGLDAISVLDIPMISKIPEDIAGALRFIEEQRSYHVQLTAEYAMLTRYCDYYTQFTDNSGYSQTTWRVYLRSHDFEACILYPNQHFCRCVKHGDKCSSSNWDFANEMKNYYSGKQSKFDKDLNLALMSLHHAFRGTSSFYIAKLLREKKNEDLVTYVEKIKGKYPGNALLKAIIDYIKYMKGLTEMNNSKHDEMWDDFIFEVPPTKSPSVRRLESSYDFKTNVNSNPSHICKNIKTVVCLSPKSGVSYDSIIACGEPSQPSIYRKPDSQVFQSNADQTHFCLSDTHCLENFETVGEEIIDAIKKSKCWETEFTEYIQFKQSDGVRSCRMKDSGECTVTTNRWPIILCDNDKFYYSELQKDYDKGQDIGHFCLSPRCNTIRHPINRKHISNCTWQVNHNNIDKIEVHELEDLEQYKKAITQKLQTSLTLFKYSKTKNLPHIKPMYKYITIEGTETAEGIESAYIESEIPALAGTSIGFKITSKSGKHLLDVIGYVKSASYSAVYTKLYTTGPTIGVNTKHDELCTGPCPVNVPHGTGWLTFAKERTSSWGCEEFGCLAISDGCVFGSCQDIIKDEITVYRKETEETTDVELCLTFADKTYCTNLNAITPIITDQFEVQFKTVEAYSLPRIIAVRNHEIMVGQINDIGVYSKGCGNVQKVNNTNYGNGVPKFDYLCHLASRKEVIVRKCIDNDYQACKFLQTPASYRLEEEGGSVTVIDYKKILGTIKMKAILGDVKYKTFADNVDLTVEGVCTGCINCFENIHCELTIHSTVEASCPVVSSCTVFHDRILITPNEHKYAIKVICNEKPGPTLPFKICSAKTDAAMTLADAKPILELAPVDQTTYIKEKDERCKTWMCRVRDEGFQVIFEPFKNLFGSYIGIFYTFIISLMAIFIVIYIVLPICFKLRDTLRQHEDAYKREMKIR

SEQ ID NO: 1896 - protein, 1440 aa, Artificial Sequence
  derived and/or modified protein sequence (wt) from TAHV(105)__GQ386829.1__GP
MMFVLFFIALSAASPVYQRCFQDGAIVKQNPSKQAVTEVCLKDDVSMIKTEARYFRNATGTYANNVAIRKWLVSDWHDCRPKKVSGGHINVIEVGDDLTLHTEAYVCNADCTIGVDKETAQVRLQTDTTNHFEIAGTTVKSGWFKSTTYITLDQTCEHLKVSCGPKSIQFHACFNQHMSCVRFLHRTILPGSIASSICQNVEIIILTVLTLLIFILLSILSKTYICYILMPIFIPLAYIYGVIYNKSCKKCKLCGLVYHPFTECGTHCVCGARYETSDRMKLHRASGLCPGYKSLRAARVMCKSKGPASILSIITAVLILTFVTPINAMVAGDTQETFKLEDLPDDMLSMAMKVNMYYIMCMINYAVTWSFILCALLIALLFKKYQHRFLNFYAMYCHECDMYHDRSGLKYNGDFTNKCRQCTCGQYEDAAGLLTHRKTYNCLVQYKSKWLTNFLIVYIILMLIKDSVLIVHADGTDFEKCSGEADITWNCTGPFLNLGNCEKKQKKESYNNIATQLKGLDAISVLDIPMISKIPEDIAGALRFIEEQRSYHVQLTAEYAMLTRYCDYYTQFTDNSGYSQTTWRVYLRSHDFEACILYPNQHFCRCVKHGDKCSSSNWDFANEMKNYYSGKQSKFDKDLNLALMSLHHAFRGTSSFYIAKLLKEKKNEDLVTYAEKIKGKYPGNALLKAIIDYIKYMKDLTEMNNFKHDEMWDDFIFEVPPTKSPSVRRLESSYDFKTNVNSNPSHICKNIKTVVCLSPKSGVSYDSIIACGEPSQPSIYRKPDSQVFQSNADQTHFCLSDTHCLENYETVGEEIIDAIKKSKCWETEFTEYIQFKQSDGVRSCRMKDSGECTVTTNRWPIILCDNDKFYYSELQKDYDKDQDIGHFCLSPRCNTIRHPINRKHISNCTWQVSHNNIDKIEVHELEDLEQYKKAITQKLQTSLTLFKYSKTKNLPHIKPMYKYITIEGTETAEGIESAYIESEIPALAGTSIGFKITSKSGKHLLDVIGYVKSASYSAVYTKLYTTGPTIGVNTKHDELCTGPCPVNVPHGTGWLTFAKERTSSWGCEEFGCLAISDGCVFGSCQDIIKDEITVYRKETEETTDVELCLTFADKTYCTNLNAITPIITDQFEVQFKTVEAYSLPRIIAVRNHEIMVGQINDIGVYSKGCGNVQKVNNTNYGNGVPKFDYLCHLASRKEVIVRKCFDNDYQACKFLQTPASYRLEEEGGSVTVIDYKKILGTIKMKAILGDVKYKTFADNVDLTVEGVCTGCINCFENIHCELTIHSTVEASCPVVSSCTVFHDRILITPNEHKYAIKVICNEKPGPTLPFKICSAKTDAAMTLADAKPILELAPVDQTTYIKEKDERCKTWMCRVRDEGFQVIFEPFKNLFGSYIGIFYTFIISLMAIFIVIYIVLPICFKLRDTLRQHEDAYKREMKIR

SEQ ID NO: 1897 - protein, 1440 aa, Artificial Sequence
  derived and/or modified protein sequence (wt) from TAHV(106)__GQ386830.1__GP
MMFVLFFIALSAASPVYQRCFQDGAIVKQNPSKQAVTEVCLKDDVSMIKTEARYFRNATGTYANNVAIRKWLVSDWHDCRPKKVSGGHINVIEVGDDLTLHTEAYVCNADCTIGVDKETAQVRLQTDTTNHFEIAGTTVKSGWFKSTTYITLDQTCEHLKVSCGPKSIQFHACFNQHMSCVRFLHRTILPGSIASSICQNVEIIILTVLTLLIFILLSILSKTYICYILMPIFIPLAYIYGVIYNKSCKKCKLCGLVYHPFTECGTHCVCGARYETSDRMKLHRASGLCPGYKSLRAARVMCKSKGPASILSIITAVLILTFVTPINAMVAGDTQETFKLEDLPDDMLSMAMKVNMYYIMCMINYAVTWSFILCALLIALLFKKYQHRFLNFYAMYCHECDMYHDRSGLKYNGDFTNKCRQCTCGQYEDAAGLLTHRKTYNCLVQYKSKWLTNFLIVYIILMLIKDSVLIVHADGTDFEKCSGEADITWNCTGPFLNLGNCEKKQKKESYNNIATQLKGLDAISVLDIPMISKIPEDIAGALRFIEEQRSYHVQLTAEYAMLTRYCDYYTQFTDNSGYSQTTWRVYLRSHDFEACILYPNQHFCRCVKHGDKCSSSNWDFANEMKNYYSGKQSKFDKDLNLALMSLHHAFRGTSSFYIAKLLKEKKNEDLVTYAEKIKGKYPGNALLKAIIDYIKYMKGLTEMNNFKHDEMWDDFISEVPPTKSPSVRRLESSYDFKTNVNSNPSHICKNIKTVVCLSPKSGVSYDSIIACGEPSQPSIYRKPDSQVFQSNADQTHFCLSDTHCLENYETVGEEIIDAIKKSKCWETEFTEYIQFKQSDGVRSCRMKDSGECTVTTNRWPIILCDNDKFYYSELQKDYDKDQDIGHFCLSPRCNTIRHPINRKHISNCTWQVSHNNIDKIEVHELEDLEQYKKAITQKLQTSLTLFKYSKTKNLPHIKPMYKYITIEGTETAEGIESAYIESEIPALAGTSIGFKITSKSGKHLLDVIGYVKSASYSAVYTKLYTTGPTIDVNTKHDELCTGPCPVNVPHGTGWLTFAKERTSSWGCEEFGCLAISDGCVFGSCQDIIKDEITVYRKETEETTDVELCLTFADKTYCTNLNAITPIITDQFEVQFKTVEAYSLPRIIAVRNHEIMVGQINDIGVYSKGCGNVQKVNNTNYGNGVPKFDYLCHLASRKEVIVRKCFDNDYQACKFLQTPASYRLEEEGGSVTVIDYKKILGTIKMKAILGDVKYKTFADNVDLTVEGVCTGCINCFENIHCELTIHSTVEASCPVVSSCTVFHDRILITPNEHKYAIKVICNEKPGPTLPFKICSAKTDAAMTLADAKPILELAPVDQTTYIKEKDERCKTWMCRVRDEGFQVIFEPFKNLFGSYIGIFYTFIISLMAIFIVIYIVLPICFKLRDTLRQHEDAYKREMKIR

SEQ ID NO: 1898 - protein, 1440 aa, Artificial Sequence
  derived and/or modified protein sequence (wt) from TAHV(181)__GQ386831.1__GP
MMFVLFFIALSAASPVYQRCFQDGAIVKQNPSKQAVTEVCLKDDVSMIKTEARYFRNATGTYANNVAIRKWLVSDWHDCRPKKVSGGHINVIEVGDDLTLHTEAYVCNADCTIGVDKETAQVRLQTDTTNHFEIAGTTVKSGWFKSTTYITLDQTCEHLKVSCGPKSIQFHACFNQHMSCVRFLHRTILPGSIASSICQNVEIIILTVLTLLIFILLSILSKTYICYILMPIFIPLAYIYGVIYNKSCKKCKLCGLVYHPFTECGTHCVCGARYETSDRMKLHRASGLCPGYKSLRAARVMCKSKGPASILSIITAVLILTFVTPINAMVAGDTQETFKLEDLPDDMLSMAMKVNMYYIMCMINYAVTWSFILCALLIALLFKKYQHRFLNFYAMYCHECDMYHDRSGLKYNGDFTNKCRQCTCGQYGDAAGLLTHRKTYNCLVQYKSKWLTNFLIGYIILMLIKDSVLIVHADGTDFEKCSGEADITWNCTGPFLNLGNCEKKQKKESYNNIATQLKGLDAISVLDIPMISKIPEDIAGALRFIEEQRSYHVQLTAEYAMLTRYCDYYTQFTDNSGYSQTTWRVYLRSHDFEACILYPNRHFCRCVKHGDKCSSSNWDFANEMKNYYSGKQSKFDKDLNLALMSLHHAFRGTSSFYIAKLLKEKKNEDLVTYAEKIKGKYPGNALLKAIIDYIKYMKGLTEMNNFKHDEMWDDFIFEVPPTKSPSVRRLESSYDFKTNVNSNPSHICKNIKTVVCLSPKSGVSYDSIIACGEPSQPSIYRKPDSQVFQSNADQTHFCLSDTHCLENYETVGEEIIDAIKKSKCWETEFTEYIQFKQSDGVRSCRMKDSGECTVTTNRWPIILCDNDKFYYSELQKDYDKDQDIGHFCLSPRCNTIRHPINRKHISNCTWQVNHNNIDKIEVHELEDLEQYKKAITQKLQTSLTLFKYSKTKNLPHIKPMYKYITIEGTETAEGIESAYIESEIPALAGTSIGFKITSKSGKHLLDVIGYVKSASYSAVYTKLYTTGPTIGVNTKHDELCTGPCPVNVPHGTGWLTFAKERTSSWGCEEFGCLAISDGCVFGSCQDIIKDEITVYRKETEETTDVELCLTFADKTYCTNLNAITPIITDQFEVQFKTVEAYSLPRIIAVRNHEIMVGQINDIGVYSKGCGNVQKVNNTNYGNGVPKFDYLCHLASRKEVIVRKCFDNDYQACKFLQTPASYRLEEEGGSVTVIDYKKILGTIKMKAILGDVKYKTFADNVDLTVEGVCTGCINCFENIHCELTIHSTVEASCPVVSSCTVFHDRILITPNEHKYAIKVICNEKPGPTLPFKICSAKTDAAMTLADAKPILELAPVDQTTYIKEKDERCKTWMCRVRDEGFQVIFEPFKNLFGSYIGIFYTFIISLMAIFIVIYIVLPICFKLRDTLRQHEDAYKREMKIR

SEQ ID NO: 1899 - protein, 1440 aa, Artificial Sequence
  derived and/or modified protein sequence (wt) from TAHV(236)__GQ386832.1__GP
MMFVLFFIALSAASPVYQRCFQDGAIVKQNPSKQAVTEVCLKDDVSMIKTEARYFRNATGTYANNVAIRKWLVSDWHDCRPKKVSGGHINVIEVGDDLTLHTEAYVCNADCTIGVDKETAQVRLQTDTTNHFEIAGTTVKSGWFKSTTYITLDQTCEHLKVSCGPKSIQFHACFNQHMSCVRFLHRTILPGSIASSICQNVEIIILTVLTLLIFILLSILSKTYICYILMPIFIPLAYIYGVIYNKSCKKCKLCGLVYHPFTECGTHCVCGARYETSDRMKLHRASGLCPGYKSLRAARVMCKSKGPASILSIITAVLILTFVTPINAMVAGDTQETFKLEDLPDDMLSMAMKVNMYYIMCMINYAITWSFILCALLIALLFKKYQHRFLNFYAMYCHECDMYHDRSGLKYNGDFTNKCRQCTCGQYEDAAGLLTHRKTYNCLVQYKSKWLTNFLIVYIILMLIKDSVLIVHADGTDFEKCSGEADITWNCTGPFLNLGNCEKKQKKESYNNIATQLKGLDAISVLDMPMISKIPEDIAGALRFIEEQRSYHVQLTAEYAMLTRYCDYYTQFTDNSGYSQTTWRVYLRSHDFEACILYPNQHFCRCVKHGDKCSSSNWDFANEMKNYYSGKQSKFDKDLNLALMSLHHAFRGTSSFYIAKLLKEKKNEDLVTYAEKIKGKYPGNALLKAIIDYIKYMKDLTEMNNFKHDEMWDDFIFEVPPTKSPSVRRLESSYDFKTNVNSNPSHICKNIKTVICLSPKSGVSYDSIIACGEPSQPSIYRKPDSQVFQSNADQTHFCLSDTHCLENYETVGEEIIDAIKKSKCWETELTEYIQFKQSDGVRSCRMKDSGECTVTTNRWPIILCDNDKFYYSELQKDYDKDQDIGHFCLSPRCNTIRHPINRKHISNCTWQVSHNNIDKIEVHELEDLEQYKKAITQKLQTSLTLFKYSKTKNLPHIKPMYKYITIEGTETAEGIESAYIESEIPALAGTSIGFKITSKSGKHLLDVIGYVKSASYSAVYTKLYTTGPTIGVNTKHDELCTGPCPVNVPHGTGWLTFAKERTSSWGCEEFGCLAISDGCVFGSCQDIIKDEITVYRKETEETTDVELCLTFADKTYCTNLNAITPIITDQFEVQFKTVEAYSLPRIIAVRNHEIMVGQINDIGVYSKGCGNVQKVNNTNYGNGVPKFDYLCHLASRKEVIVRKCFDNDYQACKFLQTPASYRLEEEGSSVTVIDYKKILGTIKMKAILGDVKYKTFADNVDLTVEGVCTGCINCFENIHCELTIHSTVEASCPVVSSCTVFHDRILITPNEHKYAIKVICNEKPGPTLPFKICSAKTDAAMTLADAKPILELAPVDQTTYIKEKDERCKTWMCRVRDEGFQVIFEPFKNLFGSYIGIFYTFIISLMAIFIVIYIVLPICFKLRDALRQHEDAYKREMKIR

SEQ ID NO: 1900 - protein, 1440 aa, Artificial Sequence
  derived and/or modified protein sequence (wt) from TAHV(29)__GQ386823.1__GP
MMFVLFFIALSAASPVYQRCFQDGAIVKQNPSKQAVTEVCLKDDVSMIKTEARYFRNATGTYANNVAIRKWLVSDWHDCRPKKVSGGHINVIEVGDDLTLHTEAYVCNADCTIGVDKETAQVRLQTDTTNHFEIAGTTVKSGWFKSTTYITLDQTCEHLKVSCGPKSIQFHACFNQHMSCVRFLHRTILPGSIASSICQNVEIIILTVLTLLIFILLSILSKTYICYILMPIFIPLAYIYGVIYNKSCKKCKLCGLVYHPFTECGTHCVCGARYETSDRMKLHRASGLCPGYKSLRAARVMCKSKGPASILSIITAVLILTFVTPINAMVAGDTQETFKLEDLPDDMLSMAMKVNMYYIMCMINYAVTWSFILCALLIALLFKKYQHRFLNFYAMYCHECDMYHDRSGLKYNGDFTNKCRQCTCGQYEDAAGLLTHRKTYNCLVQYKSKWLTNFLIVYIILMLIKDSVLIVHADGTDFEKCSGEADITWNCTGPFLNLGNCEKKQKKESYDNIATQLKGLDAISVLDIPMISKIPEDIAGALRFIEEQRSYHVQLTAEYAMLTRYCDYYTQFTDNSGYSQTTWRVYLRSHDFEACILYPNQHFCRCVKHGDKCSSSNWDFANEMKNYYSGKQSKFDKDLNLALMSLHHAFRGTSSFYIAKLLKEKKNEDLVTYAEKIKGKYPGNALLKAIIDYIKYMKDLTEMNNFKHDEMWDDFIFEVPPTKSPSVRRLESSYDFKTNVNSNPSHICKNIKTVVCLSPKSGVSYDSIIACGEPSQPSIYRKPDSQVFQSNADQTHFCLSDTHCLENYETVGEEIIDAIKKSKCWETEFTEYIQFKQSDGVRSCRMKDSGECTVTTNRWPIILCDNDKFYYSELQKDYDKDQDIGHFCLSPRCNTIRHPINRKHISNCTWQVSHNNIDKIEVHELEDLEQYKKAITQKLQTSLTLFKYSKTKNLPHIKPMYKYITIEGTETAEGIESAYIESEIPALAGTSIGFKITSKSGKHLLDVIGYVKSASYSAVYTKLYTTGPTIGVNTKHDELCTGPCPVNMPHGTGWLTFAKERTSSWGCEEFGCLAISDGCVFGSCQDIIKDEITVYRKETEETTDVELCLTFADKTYCTNLNAITPIITDQFEVQFKTVEAYSLPRIIAVRNHEIMVGQINDIGVYSKGCGNVQKVNNTNYGNGVPKFDYLCHLASRKEVIVRKCFDNDYQACKFLQTPASYRLEEEGGSVTVIDYKKILGTIKMKAILGDVKYKTFADNVDLTVEGVCTGCINCFENIHCELTIHSTVEASCPVVSSCTVFHDRILITPNEHKYAIKVICNEKPGPTLPFKICSAKTDVAMTLADAKPILELAPVDQTTYIKEKDERCKTWMCRVKDEGFQVIFEPFKNLFGSYIGIFYTFIISLMAIFIVIYIVLPICFKLRDTLRQHEDAYKREMKIR

SEQ ID NO: 1901 - protein, 1440 aa, Artificial Sequence
  derived and/or modified protein sequence (wt) from TAHV(4019)__GQ386834.1__GP
MMFVLFFIALSAASPVYQRCFQDGAIVKQNPSKQAVTEVCLKDDVSMIKTEARYFRNATGTYANNVAIRKWLVSDWHDCRPKKVSGGHINVIEVGDDLTLHTEAYVCNADCTIGVDKETAQVRLQTDTTNHFEIAGTTVKSGWFKSTTYITLDQTCEHLKVSCGPKSIQFHACFNQHMSCVRFLHRTILPGSIASSICQNVEIIILTVLTLLIFILLSILSKTYICYILMPIFIPLAYIYGVIYNKSCKKCKLCGLVYHPFTECGTHCVCGARYETSDRMKLHRASGLCPGYKSLRAARVMCKSKGPASILSIITAVLILTFVTPINAMVAGDTQETFKLEDLPDDMLSMAMKVNMYYIMCMINYAVTWSFILCALLIALLFKKYQHRFLNFYAMYCHECDMYHDRSGLKYNGDFTNKCRQCTCGQYEDAAGLLTHRKTYNCLVQYKSKWLTNFLIVYIILMLIKDSVLIVHADGTDFEKCSGEADITWNCTGPFLNLGNCEKKQKKESYNNIATQLKGLDAISVLDIPMISKIPEDIAGALRFIEEQRSYHVQLTAEYAMLTRYCDYYTQFTDNSGYSQTTWRVYLRSHDFEACILYPNRHFCRCVKHGDKCSSSNWDFANEMKNYYSGKQSKFDKDLNLALMSLHHAFRGTSSFYIAKLLKEKKNEDLVTYAEKIKGKYPGNALLKAIIDYIKYMKDLTEMNNFKHDEMWDDSIFEVPPTKSPSVRRLESSYDFKTNVNSNPSHICKNIKTVVCLSPKSGVSYDSIIACGEPSQPSIYRKPDSQVFQSNADQTHFCLSDTHCLENYEAVGEEIIDAIKKSKCWETEFTEYIQFKQSDGVRSCRMKDSGECTVTTNRWPIILCDNDKFYYSELQKDYDKDQDIGHFCLSPRCNTIRHPINRKHISNCTWQVSHNNIDKIEVHELEDLEQYKKAITQKLQTSLTLFKYSKTKNLPHIKPMYKYITIEGTETAEGIESAYIESEIPALAGTSIGFKITSKSGKHLLDVISYVKSASYSAVYTKLYTTGPTIGVNTKHDELCTGPCPVNVPHGTGWITFAKERTSSWGCEEFGCLAISDGCVFGSCQDIIKDEITVYRKETEETTDVELCLTFADKTYCTNLNAITPIITDQFEVQFKTVEAYSLPRIIAVRNHEIMVGQINDIGVYSKGCGNVQKVNNTNYGNGVPKFDYLCHLASRKEVIVRKCFDNDYQACKFLQTPASYRLEEEGGSVTVIDYKKILGTIKMKAILGDVKYKTFADNVDLTVEGVCTGCINCFENIHCELTIHSTVEASCPVVSSCTVFHDRILITPNEHKYAIKVICNEKPGPTLPFKICSAKTDAAMTLADAKPILELAPVDQTTYIKEKDERCKTWMCRVRDEGFQVIFEPFKNLFGSYIGIFYTFIISLMAIFIVIYIVLPICFKLRDTLRQHEDAYKREMKIR

SEQ ID NO: 1902 - protein, 1440 aa, Artificial Sequence
  derived and/or modified protein sequence (wt) from TAHV(4020)__GQ386835.1__GP
MMFVLFFIALSAASPVYQRCFQDGAIVKQNPSKQAVTEVCLKDDVSMIKTEARYFRNATGTYANNVAIRKWLVSDWHDCRPKKVSGGHINVIEVGDDLTLHTEAYVCNADCTIGVDKETAQVRLQTDTTNHFEIAGTTVKSGWFKSTTYITLDQTCEHLKVSCGPKSIQFHACFNQHMSCVRFLHRTILPGSIASSICQNVEIIILTVLTLLIFILLSILSKTYICYILMPIFIPLAYIYGVIYNKSCKKCKLCGLVYHPFTECGTHCVCGARYETSDRMKLHRASGLCPGYKSLRAARVMCKSKGPASILSIITAVLILTFVTPINAMVAGDTQETFKLEDLPDDMLSMAMKVNMYYIMCMINYAVTWSFILCALLIALLFKKYQHRFLNFYAMYCHECDMYHDRSGLKYNGDFTNKCRQCTCGQYEDAAGLLTHRKTYNCLVQYKSKWLTNFLIVYIILMLIKDSVLIVHADGTDFEKCSGEADITWNCTGPFLNLGNCEKKQKKESYNNIATQLKGLDAISVLDIPMISKIPEDIAGALRFIEEQRSYHVQLTAEYAMLTRYCDYYTQFTDNSGYSQTTWRVYLRSHDFEACILYPNQHFCRCVKHGDKCSSSNWDFANEMKNYYSGKQSKFDKDLNLALMSLHHAFRGTSSFYIAKLLKEKKNEDLVTYAEKIKGKYSGNALLKAIIDYIKYMKGLTEMNNFKHDEMWDDFIFEVPPPKSPSVRRLESSYDFKTNVNSNPSHICKNIKTVVCLSPKSGVSYDSIIACGEPSQPSIYRKPDSQVFQSNADQTHFCLSDTHCLENYETVGEEIIDAIKKSKCWETEFTEYIQFKQSDGVRSCRMKDSGECTVTTNRWPIILCDNDKFYYSELQKDYDKDQDIGHFCLSPRCNTIRHPINRKHISNCTWQVSHNNIDKIEVHELEDLEQYKKAITQKLQTSLTLFKYSKTKNLPHIKPMYKYITIEGTETAEGIESAYIESEIPALAGTSIGFKITSKSGKHLLDVIGYVKSASYSAVYTKLYTTGPTIGVNTKHDELCTGPCPVNVPHGTGWLTFAKERTSSWGCEEFGCLAISDGCVFGSCQDIIKDEITVYRKETEETTDVELCLTFADKTYCTNLNAITPIITDQFEVQFKTVEAYSLPRIIAVRNHEIMVGQINDIGVYSKGCGNVQKVNNTNYGNGVPKFDYLCHLASRKEVIVRKCFDNDYQACKFLQTPASYRLEEEGGSVTVIDYKKILGTIKMKAILGDVKYKTFADNVDLTVEGVCTGCINCFENIHCELTIHSTVEASCPVVSSCTVFHDRILITPNEHKYAIKVICNEKPGPTLPFKICSAKTDAAMTLADAKPILELAPVDQTTYIKEKDERCKTWMCRVRDEGFQVIFEPFKNLFGSYIGIFYTFIISLMAIFIVIYIVLPICFKLRDTLRQHEDAYKREMKIR

SEQ ID NO: 1903 - protein, 1440 aa, Artificial Sequence
  derived and/or modified protein sequence (wt) from TAHV(4030)__GQ386836.1__GP
MMFVLFFIALSAASPVYQRCFQDGAIVKQNPSKQAVTEVCLKDDVSMIKTEARYFRNATGTYANNVAIRKWLVSDWHDCRPKKVSGGHINVIEVGDDLTLHTEAYVCNADCTIGVDKETAQVRLQTDTTNHFEIAGTTVKSGWFKSTTYITLDQTCEHLKVSCGPKSIQFHACFNQHMSCVRFLHRTILPGSIASSICQNVEIIILTVLTLLIFILLSILSKTYICYILMPIFIPLAYIYGVIYNKSCKKCKLCGLVYHPFTECGTHCVCGARYETSDRMKLHRASGLCPGYKSLRAARVMCKSKGPASILSIITAVLILTFVTPINAMVAGDTQETFKLEDLPDDMLSMAMKVNMYYIMCMINYAVTWSFILCALLIALLFKKYQHRFLNFYAMYCNECDMYHDRSGLKYNGDFTNKCRQCTCGQYEDAAGLLTHRKTYNCLVQYKSKWLTNFLIVYIILMLIKDSVLIVHADGTDFEKCSGEADITWNCTGPFLNLGNCEKKQKKESYNNIATQLKGLDAISVLDIPMISKIPEDIAGALRFIEEQRSYHVQLTAEYAMLTRYCDYYTQFTDNSGYSQTTWRVYLRSHDFEACILYPNQHFCRCVKHGDKCSSSNWDFANEMKNYYSGKQSKFDKDLNLALMSLHHAFRGTSSFYIAKLLKEKKNEDLITYAEKIKGKYPGNALLKAIIDYIKYMKDLTEMNNFKHDEMWDDFIFEVPPTKSPSVRRLESSYDFKTNVNSNPSHICKNIKTVVCLSPKSGVSYDSIIACGEPSQPSIYRKPDSQVFQSNADQTHFCLSDTHCLENYETVGEEIIDAIKKSKCWETEFTEYIQFKQSDGVRSCRMKDSGECTVTTNRWPIILCDNDKFYYSELQKDYDKDQDIGHFCLSPRCNTIRHPINRKHISNCTWQVSHNNIDKIEVHELEDLEQYKKAITQKLQTSLTLFKYSKTKNLPHIKPMYKYITIEGTETAEGIESAYIESEIPALAGTSIGFKITSKSGKHLLDVIGYVKSASYSAVYTKLYTTGPTIGVNTKHDELCTGPCPVNVPHGTGWLTFAKERTSSWGCEEFGCLAISDGCVFGSCQDIIKDEIIVYRKETEETTDVELCLTFADKTYCTNLNAITPIITDQFEVQFKTVEAYSLPRIIAVRNHEIMVGQINDIGVYSKGCGNVQKVNNTNYGNGVPKFDYLCHLASRKEVIVRKCFDNDYQACKFLQTPASYRLEEEGGSVTVIDYKKILGTIKMKAILGDVKYKTFADNVDLTVEGVCTGCVNCFENIHCELTIHSTVEASCSVVSSCTVFHDRILITPNEHKYAIKVICNEKPGPTLPFKICSAKTDAAMTLADAKPILELAPVDQTTYIKEKDERCKTWMCRVRDEGFQVIFEPFKNLFGSYIGIFYTFIISLMAIFIVIYIVLPICFKLRDTLRQHEDAYKREMKIR

SEQ ID NO: 1904 - protein, 1440 aa, Artificial Sequence
  derived and/or modified protein sequence (wt) from TAHV(4033)__GQ386837.1__GP
MMFVLFFIALSAASPVYQRCFQDGAIVKQNPSKQAVTEVCLKDDVSMIKTEARYFRNATGTYANNVAIRKWLVSDWHDCRPKKVSGGHINVIEVGDDLTLHTEAYVCNADCTIGVDKETAQVRLQTDTTNHFEIAGTTVKSGWFKSTTYITLDQTCEHLKVSCGPKSIQFHACFNQHMSCVRFLHRTILPGSIASSICQNVEIIILTVLTLLIFILLSILSKTYICYILMPIFIPLAYIYGVIYNKSCKKCKLCGLVYHPFTECGTHCVCGARYETSDRMKLHRASGLCPGYKSLRAARVMCKSKGPASILSIITAVLILTFVTPINAMVAGDTQETFKLEDLPDDMLSMAMKVNMYYIMCMINYAVTWSFILCALLIALLFKKYQHGFLNFYAMYCHECDMYHDRSGLKYNGDFTNKCRQCTCGQYEDAAGLLTHRKTYNCLVQYKSKWLTNFLIVYIILMLIKDSVLIVHADGTDFEKCSGEADITWNCTGPFLSLGNCEKKQKKESYNNIATQLKGLDAISVLDIPMISKIPEDIAGALRFIEEQRSYHVQLTAEYAMLTRYCDYYTQFTDNSGYSQTTWRVYLRSHDFEACILYPNQHFCRCVKHGDKCSSSNWDFANEMKNYYSGKQSKFDKDLNLALMSLHHAFRGTSSFYIAKLLKEKKNEDLVTYAEKIKGKYPGNALLKAIIDYIKYMKDLTEMNNFKHDEMWDDFIFEVPPTKSPSVRRLESSYDFKTNVNSNPSHICKNIKTVVCLSPKSGVSYDSIIACGEPSQPSIYRKPDSQVFQSNADQTHFCLSDTHCLENYETVGEEIIDAIKKSKCWETEFTEYIQFKQSDGVRSCRMKDSGECTVTTNRWPIILCDNDKFYYSELQKDYDKDQDIGHFCLSPRCNTIRHPINRKHISNCTWQVSHNNIDKIEVHELEDLEQYKKAITQKLQTSLTLFKYSKTKNLPHIKPMYKYITIEGTETAEGIESAYIESEIPALAGTSIGFKITSKSGKHLLDVIGYVKSASYSAVYTKLYTTGPTIGVNTKHDELCTGPCPVNVPHGTGWLTFAKERTSSWGCEEFGCLAISDGCVFGSCQDIIKDEITVYRKETEETTDVELCLTFADKTYCTNLNAITPIITDQFEVQFKTVEAYSLPRIIAVRNHEIMVGQINDIGVYSKGCGNVQKVNNTNYGNGVPKFDYLCHLASRKEVIVRKCFDNDYQACKFLQTPASYRLEEEGGSVTVIDYKKILGTIKMKAILGDVKYKTFADNVDLTVEGVCTGCINCFENIHCELTIHSTVEASCPVVSSCTVFHDRILITPNEHKYAIKVICNEKPGPTLPFKICSAKTDAAMTLADAKPILELAPVDQTTYIKEKDERCKTWMCRVRDEGFQVIFEPFKNLFGSYIGIFYTFIISLMAIFIVIYIVLPICFKLRDTLRQHEDAYKREMKIR

SEQ ID NO: 1905 - protein, 1440 aa, Artificial Sequence
  derived and/or modified protein sequence (wt) from TAHV(4034)__GQ386838.1__GP
MMFVLFFIALSAASPVYQRCFQDGAIVKQNPSKQAVTEVCLKDDVSMIKTEARYFRNATGTYANNVAIRKWLVSDWHDCRPKKVSGGHINVIEVGDDLTLHTEAYVCNADCTIGVDKETAQVRLQTDTTNHFEIAGTTVKSGWFKSTTYITLDQTCEHLKVSCGPKSIQFHACFNQHMSCVRFLHRTILPGSIASSICQNVEIIILTVLTLLIFILLSILSKTYICYTLMPIFIPLAYIYGVIYNKSCKKCKLCGLVYHPFTECGTHCVCGARYETSDRMKLHRASGLCPGYKSLRAARVMCKSKGPASILSIITAVLILTFVTPINAMVAGDTQETFKLEDLPDDMLSMAMKVNMYYIMCMINYAVTWSFILCALLIALLFKKYQHRFLNFYAMYCHECDMYHDRSGLKYNGDFTNKCRQCTCGQYEDAAGLLTHRKTYNCLVQYKSKWLTNFLIVYIILMLIKDSILIVHADGTDFEKCSGEADITWNCTGPFLNLGNCEKKQKKESYNNIATQLKGLDAISVLDIPMISKIPEDIAGALRFIEEQRSYHVQLTAEYAMLTRCCDYYTQFTDNSGYSQTTWRVYLRSHDFEACILYPNQHFCRCVKHGNKCSSSNWDFANEMKNYYSGKQSKFDKDLNLALMSLHHAFRGTSSFYIAKLLKEKKNEDLVTYAEKIKGKYPGNALLKAIIDYIKYMKDLTEMNNFKHDEMWDDFIFEVPPTKSPSVRRLESSYDFKTNVNSNPSHICKNIKTVVCLSPKSGVSYDSIIACGEPSQPSIYRKPDSQVFQSNTDQTHFCLSDTHCLENYEAVGEEIIDAIKKSKCWETEFTEYIQFKQSDGVRSCRMKDSGECTVTTNRWPIILCDNDKFYYSELQKDYDKDQDIGHFCLSPRCNTIRHPINRKHISNCTWQVNHNNIDKIEVHELEDLEQYKKAITQKLQTSLTLFKYSKTKNLPHIKPMYKYITIEGTETAEGIESAYIESEIPALAGTSIGFKITSKSGKHLLDVIGYVKSASYSAVYTKLYTTGPTIGVNTKHDELCTGPCPVNVPHGTGWLTFAKERTSSWGCEEFGCLAISDGCVFGSCQDIIKDEITVYRKETEETTDVELCLTFADKTYCTNLNAITPIITDQFEVQFKTVEAYSLPRIIAVRNHEIMVGQINDIGVYSKGCGNVQKVNNTNYGNGVPKFDYLCHLASRKEVIVRKCFDNDYQACKFLQIPASYRLEEEGGSVTVIDYKKILGTIKMKAILGDVKYKTFADNVDLTVEGVCTGCINCFENIHCELTIHSTVEASCPVVSSCTVFHDRILITPNEHKYAIKVICNEKPGPTLPFKICSAKTDAAMTLADAKPILELAPVDQTTYIKEKDERCKTWMCRVRDEGFQVIFEPFKNLFGSYIGIFYTFIISLMAIFIVIYIVLPICFKLRDTLRQHEDAYKREMKIR

SEQ ID NO: 1906 - protein, 1440 aa, Artificial Sequence
  derived and/or modified protein sequence (wt) from TAHV(4057)__GQ386839.1__GP
MMFVLFFIALSAASPVYQRCFQDGAIVKQNPSKQAVTEVCLKDDVSMIKTEARYFRNATGTYANNVAIRKWLVSDWHDCRPKKVSGGHINVIEVGDDLTLHTEAYVCNADCTIGVDKETAQVRLQTDTTNHFEIAGTTVKSGWFKSTTYITLDQTCEHLKGSCGPKSIQFHACFNQHMSCVRFLHRTILPGSIASSICQNVEIIILTVLTLLIFILLSILSKTYICYILMPIFIPLAYIYGVIYNKSCKKCKLCGLVYHPFTECGTHCVCGARYETSDRMKLHRASGLCPGYKSLRAARVMCKSKGPASILSIITAVLILTFVTPINAMVAGDTQETFKLEDLPDDMLSMAMKVNMYYIMCIINYAVTWSFILCALLIALLFKKYQHRFLNFYAMYCHECDMYHDRSGLKYNGDFTNKCRQCTCGQYEDAAGLLTHRKTYNCLVQYKSKWLTNFLIVYIILMLIKDSVLIVHADGTDFEKCSGEADITWNCTGPFLNLGNCEKKQKKESYNNIATQLKGLDAISVLDIPMISKIPEDIAGALRFIEEQRSYHVQLTAEYAMLTRYCDYYTQFTDNSGYSQTTWRVYLRSHDFEACILYPNQHFCRCVKHGDKCSSSNWDFANEMKNYYSGKQSKFDKDLNLALMSLHHAFRGTSSFYIAKLLKEKKNGDLVTYAEKIKGKYPGNALLKAIIDYIKYMKDLTEMNNFKHDEMWDDFIFEVPPTKSPSVRRLESSYDFKTNVNSNPSHICKNIKTVVCLSPKSGVSYDSIIACGEPSQPSIYRKPDSQVFQSNADQTHFCLSDTHCLENYETVGEEIIDAIKKSKCWETEFTEYIQFKQSDGVRSCRMKDSGECTVTTNKWPIILCDNDKFYYSELQKDYDKDQDIGHFCLSPRCNTIRHPINRKHISNCTWQVSHNNIDKIEVHELEDLEQYKKAITQKLQTSLTLFKYSKTKNLPHIKPMYKYITIEGTETAEGIESAYIESEIPALAGTSIGFKITSKSGRHLLDVIGYVKSASYSAVYTKLYTTGPTIGVNTKHDELCTGPCPVNVPHGTGWLTFAKERTSSWGCEEFGCLAISDGCVFGSCQDIIKDEITVYRKETEETTDVELCLTFADKTYCTNLNAITPIITDQFEVQFKTVEAYSLPRIIAVRNHEIMVGQINDIGVYSKGCGNVQKVNNTNYGNGVPKFDYLCHLASRKEVIVRKCFDNDYQACKFLQTPASYRLEEEGGSVTVIDYKKILGTIKMKAILGDVKYKTFADNVDLTVEGVCTGCVNCFENIHCESTIHSTVEASCPVVSSCTVFHDRILITPNEHKYAIKVICNEKPGPTLPFKICSAKTDAAMTLADAKPILELAPVDQTTYIKEKDERCKTWMCRVRDEGFQVIFEPFKNLFGSYIGIFYTFIISLMAIFIVIYIVLPICFKLRDTLRQHEDAYKREMKIR

SEQ ID NO: 1907 - protein, 1440 aa, Artificial Sequence
  derived and/or modified protein sequence (wt) from TAHV(4060)__GQ386840.1__GP
MMFVLFFIALSAASPVYQRCFQDGAIVKQNPSKQAVTEVCLKDDVSMIKTEARYFRNATGTYANNVAIRKWLVSDWHDCRPKKVSGGHINVIEVGDDLTLHTEAYVCNADCTIGVDKETAQVRLQTDTTNHFEIAGTTVKSGWFKSTTYITLDQTCEHLKVSCGPKSIQFHACFNQHMSCVRFLHRTILPGSIASSICQNVEIIILTVLTLLIFILLSILSKTYICYILMPIFIPLAYIYGVIYNKSCKKCKLCGLVYHPFTECGTHCVCGARYETSDRMKLHRASGLCPGYKSLRAARVMCKSKGPASILSIITAILILTFVTPINAMVAGDTQETFKLEDLPDDMLSMAMKVNMYYIMCMINYAVTWSFILCALLIALLFKKYQHRFLNFYAMYCHECDMYHDRSGLKYNGDFTNKCRQCTCGQYEDAAGLQTHRKTYNCLVQYKSKWLTNFLIVYIILMLIKDSVLIVHADGTDFEKCSGEADITWNCTGPFLNLGNCEKKQKKESYNNIATQLKGLDAISVLDIPMISKIPEDIAGALRFIEEQRSYHVQLTAEYAMLTRYCDYYTQFTDNSGYSQTTWRVYLRSHDFEACILYPNQHFCRCVKHGDKCSSSNWDFANEMKNYYSGKQSKFDKDLNLALMSLHHAFRGTSSFYIAKLLKEKKNEDLVTYAEKIKGKYPGNALLKAIIDYIKYMKDLTEMNNFKHDEMWDDFIFEVPPTKSPSVRRLESSYDFKTNVNSNPSHICKNIKTVVCLSPKSGVSYDSIIACGEPSQPSIYRKPDSQVFQSNADQTHFCLSDTHCLENYETVGEEIIDAIKKSKCWETEFTEYTQFKQSDGVRSCRMKDSGECTVTTNRWPIILCDNDKFYYSELQKDYDKDQDIGHFCLSPRCNTIRHPINRKHISNCTWQVSHNNIDKIEVHELEDLEQYKKAITQKLQTSLTLFKYSKTKNLPHIKPMYKYITIEGTETAEGIESAYIESEIPALAGTSIGFKITSKSGKHLLDVIGYVKSASYSAVYTKLYTTGPTIGVNTKHDELCTGPCPVNVPHGTGWLTFAKERTSSWGCEEFGCLAISDGCVFGSCQDIIKDEITVYRKETEETTDVELCLTFADKTYCTNLNAITPIITDQFEVQFKTVEAYSLPRIIAVRNHEIMVGQINDIGVYSKGCGNVQKVNNTNYGNGVPKFDYLCHLASRKEVIVRKCFDNDYQACKFLQTPASYRLEEEGGSVTVIDYKKILGTIKMKAILGDVKYKTFADNVDLTVEGVCTGCINCFENIHCELTIHSTVEASCPVVSSCTVFHDRILITPNEHKYAIKVICNEKPGPTLPFKICSAKTDAAMTLADAKPILELAPVDQTTYIKEKDERCKTWMCRVRDEGFQVIFEPFKNLFGSYIGIFYTFIISLIAIFIVIYIVLPICFKLRDTLRQHEDAYKREMKIR

SEQ ID NO: 1908 - protein, 1440 aa, Artificial Sequence
  derived and/or modified protein sequence (wt) from TAHV(5060)__GQ386841.1__GP
MMFVLFFIALSAASPVYQRCFQDGAIVKQNPSKQAVTEVCLKDDVSMIKTEARYFRNATGTYANNVAIRKWLVSDWHDCRPKKVSGGHINVIEVGDDLTLHTEAYVCNADCTIGVDKETAQVRLQTDTTNHFEIAGTTVKSGWFKSTTYITLDQTCEHLKVSCGPKSIQFHACFNQHMSCVRFLHRTILPGSIASSICQNVEIIILTVLTLLIFILLSILSKTYICYILMPIFIPLAYIYGVIYNKSCKKCKLCGLVYHPFTECGTHCVCGARYETSDRMKLHRASGLCPGYKSLRAARVMCKSKGPASILSIITAVLILTFVTPINAMVAGDTQETFKLEDLPDDMLSMAMKVNMYYIMCIINYAVTWSFILCALLIALLFKKYQHRFLNFYAMYCHECDMYHDRSGLKYNGDFTNKCRQCTCGQYEDAAGLLTHRKTYNCLVQYKSKWLTNFLIVYIILMLIKDSVLIVHADGTDFEKCSGEADITWNCTGPFLNLGNCEKKQKKESYNNIATQLKGLDAISVLDIPMISKIPEDIAGALRFIEEQRSYHVQLTAEYAMLTRYCDYYTQFTDNSGYSQTTWRVYLRSHDFEACILYPNQHFCRCVKHGDKCSSSNWDFANEMKNYYSGKQSKFDKDLNLALMSLHHAFRGTSSFYIAKLLKEKKNGDLVTYAEKIKGKYPGNALLKAIIDYIKYMKDLTEMNNFKHDEMWDDFIFEVSPTKSPSVRRLESSYDFKTNVNSNPSHICKNIKTVVCLSPKSGVSYDSIIACGEPSQPSIYRKPDSQVFQSNADQTHFCLSDTHCLENYETVGEEIIDAIKKSKCWETEFTEYIQFKQSDGVRSCRMKDSGECTVTTNKWPIILCDNDKFYYSELQKDYDKDQDIGHFCLSPRCNTIRHPINRKHISNCTWQVSHSNIDKIEVHELEDLEQYKKAITQKLQTSLTLFKYSKTKNLPHIKPIYKYITIEGTETAEGIESAYIESEIPALAGTSIGFKITSKSGKHLLDVIGYVKSASYSAVYTKLYTTGPTIGVNTKHDELCTGPCPVNVPHGTGWLTFAKERTSSWGCEEFGCLAISDGCVFGSCQDIIKDEITVYRKETEETTDVELCLTFADKTYCTNLNAITPIITDQFEVQFKTVEAYSLPRIIAVRNHEIMVGQINDIGVYSKGCGNVQKVNNTNYGNGVPKFDYLCHLASRKEVIVRKCFDNDYQACKFLQTPASYRLEEEGGSVTVIDYKKILGTIKMKAILGDVKYKTFADNVDLTVEGVCTGCINCFENIHCELTIHSTVEASCPVVSSCTVFHDRILITPNEHKYAIKVICNEKPGPTLPFKICSAKTDAAMTLADAKPILELAPVDQTTYIKEKDERCKTWMCRVRDEGFQVIFEPFKNLFGSYIGIFYTFIISLMAIFIVIYIVLPICFKLRDTLRQHEDAYKREMKIR

SEQ ID NO: 1909 - protein, 1440 aa, Artificial Sequence
  derived and/or modified protein sequence (wt) from TAHV(76)__GQ386824.1__GP
MMFVLFFIALSAASPVYQRCFQDGAIVKQNPSKQAVTEVCLKDDVSMIKTEARYFRNATGTYANNVAIRKWLVSDWHDCRPKKVSGGHINVIEVGDDLTLHTEAYVCNADCTIGVDKETAQVRLQTDTTNHFEIAGTTVKSGWFKSTTYITLDQTCEHLKVSCGPKSIQFHACFNQHMSCVRFLHRTILPGSIASSICQNVEIIILTVLTLLIFILLSILSKTYICYILMPIFIPLAYIYGVIYNKSCKKCKLCGLVYHPFTECGTHCVCGARYETSDRMKLHRASGLCPGYKSLRAARVMCKSKGPASILSIITAVLILTFVTPINAMVAGDTQETFKLEDLPDDMLSMAMKVNMYYIMCMINYAVTWSFILCALLIALLFKKYQHRFLNFYAMYCHECDMYHDRSGLKYNGDFTNKCRQCTCGQYGDAAGLLTHRKTYNCLVQYKSKWLTNFLIVYIILMLIKDSVLIVHADGTDFEKCSGEADITWNCTGPFLNLGNCEKKQKKESYNNIATQLKGLDAISVLDIPMISKIPEDIAGALRFIEEQRSYHVQLTAEYAMLTRYCDYYTQFTDNSGYSQTTWRVYLRSHDFEACILYPNQHFCRCVKHGDKCSSSNWDFANEMKNYYSGKQSKFDKDLNLALMSLHHAFRGTSSFYIAKLLKEKKNEDLVTYAEKIKGKYPGNALLKAIIDYIKYMKDLTEMNNFKHDEMWDDFIFEVPPTKSPSVRRLESSYDFKTNVNSNPSHICKNIKTVVCLSPKSGVSYDSIIACGEPSQPSIYRKPDSQVFQSNADQTHFCLSDTHCLENYEAVGEEIIDAIKKSKCWETEFTEYIQFKQSDGVRSCRMKDSGECTVTTNRWPIILCDNDKFYYSELQKDYDKDQDIGHFCLSPRCNTIRHPINRKHISNCTWQVSHNNIDKIEVHELEDLEQYKKAITQKLQTSLTLFKYSKTKNLPHIKPMYKYITIEGTETAEGIESAYIESEIPALAGTSIGFKITSKSGKHLLDVISYVKSASYSAVYTKLYTTGPTIGVNTKHDELCTGPCPVNVPHGTGWITFAKERTSSWGCEEFGCLAISDGCVFGSCQDIIKDEITVYRKETEETTDVELCLTFADKTYCTNLNAITPIITDQFEVQFKTVEAYSLPRIIAVRNHEIMVGQINDIGVYSKGCGNVQKVNNTNYGNGVPKFDYLCHLASRKEVIVRKCFDNDYQACKFLQTPASYRLEEEGGSVTVIDYKKILGTIKMKAILGDVKYKTFADNVDLTVEGVCTGCINCFENIHCELTIHSTVEASCPVVSSCTVFHDRILITPNEHKYAIKVICNEKPGPTLPFKICSAKTDAAMTLADAKPILELAPVDQTTYIKEKDERCKTWMCRVRDEGFQVIFEPFKNLFGSYIGIFYTFIISLMAIFIVIYIVLPICFKLRDTLRQHEDAYKREMKIR

SEQ ID NO: 1910 - protein, 1440 aa, Artificial Sequence
  derived and/or modified protein sequence (wt) from TAHV(83)__GQ386825.1__GP
MMFVLFFIALSAASPVYQRCFQDGAIVKQNPSKQAVTEVCLKDDVSMIKTEARYFRNATGTYANNVAIRKWLVSDWHDCRPKKVSGGHINVIEVGDDLTLHTEAYVCNADCTIGVDKETAQVRLQTDTTNHFEIAGTTVKSGWFKSTTYITLDQTCEHLKVSCGPKSIQFHACFNQHMSCVRFLHRTILPGSIASSICQNVEIIILTVLTLLIFILLSILSKTYICYILMPIFIPLAYIYGVIYNKSCKKCKLCGLVYHPFTECGTHCVCGARYETSDRMKLHRASGLCPGYKSLRAARVMCKSKGPASILSIITAVLILTFVTPINAMVAGDTQETFKLEDLPDDMLSMAMKVNMYYIMCMINYAVTWSFILCALLIALLFKKYQHRFLNFYAMYCHECDMYHDRSGLKYNGDFTNKCRQCTCGQYEDAAGLLTHRKTYNCLVQYKSKWLTNFLIVYIILMLIKDSVLIVHADGTDFEKCSGEADITWNCTGPFLNLGNCEKKQKKESYNNIATQLKGLDAISVLDIPMISKIPEDIAGALRFIEEQRSYHVQLTAEYAMLTRYCDYYTQFTDNSGYSQTTWRVYLRSHDFEVCILYPNQHFCRCVKHGDKCSSSNWDFANEMKNYYSGKQSKFDKDLNLALMSLHHAFRGTSSFYIAKLLKEKKNEDLVTYAEKIKGKYPGNALLKAIIDYIKYMKGLTEMNNFKHDEVWDDFIFEVPPTKSPSVRRLESSYDFKTNVNSNPSHICKNIKTVVCLSPKSGVSYDSIIACGEPSQPSIYRKPDSQVFQSNADQTHFCLSDTHCLENYETVGEEIIDAIKKSKCWETEFTEYIQFKQSDGVRSCRMKDSGECTVTTNRWPIILCDNDKFYYSELQKDYDKDQDIGHFCLSPRCNTIRHPINRKHISNCTWQVSHNNIDKIEVHELEDLEQYKKAITQKLQTSLTLFKYSKTKNLPHIKPMYKYITIEGTETAEGIESAYIESEIPALAGTSIGFKITSKSGKHLLDVIGYVKSASYSAVYTKLYTTGPTIGVNTKHDELCTGPCPVNVPHGTGWLTFAKERTSSWGCEEFGCLAISDGCVFGSCQDIIKDEITVYRKETEETTDVELCLTFADKTYCTNLNAITPIITDQFEVQFKTVEAYSLPRIIAVRNHEIMVGQINDIGVYSKGCGNVQKVNNTNYGNGVPKFDYLCHLASRKEVIVRKCFDNDYQACKFLQTPASYRLEEEGGSVTVIDYKKILGTIKMKAILGDVKYKTFADNVDLTVEGVCTGCINCFENIHCELTIHSTVEASCPVVSSCTVFHDRILITPNEHKYAIKVICNEKPGPTLPFKICSAKTDAAMTLADAKPILELAPVDQTTYIKEKDERCKTWMCRVRDEGFQVIFEPFKNLFGSYIGIFYTFIISLMAIFIVIYIVLPICFKLRDTLRQHEDAYKREMKIR

SEQ ID NO: 1911 - protein, 1440 aa, Artificial Sequence
  derived and/or modified protein sequence (wt) from TAHV(89)__GQ386826.1__GP
MMFVLFFIALSAASPVYQRCFQDGAIVKQNPSKQAVTEVCLKDDVSMIKTEARYFRNATGTYANNVAIRKWLVSDWHDCRPKKVSGGHINVIEVGDDLTLHTEAYVCNADCTIGVDKETAQVRLQTDTTNHFEIAGTTVKSGWFKSTTYITLDQTCEHLKVSCGPKSIQFHACFNQHMSCVRFLHRTILPGSIASSICQNVEIIILTVLTLLIFILLSILSKTYICYILMPIFIPLAYIYGVIYNKSCKKCKLCGLVYHPFTECGTHCVCGARYETSDRMKLHRASGLCPGYKSLRAARVMCKSKGPASILSIITAVLILTFVTPINAMVAGDTQETFKLEDLPDDMLSMAMKVNMYYIMCMINYAVTWSFILCALLIALLFKKYQHRFLNFYAMYCHECDMYHDRSGLKYNGDFTNKCRQCTCGQYEDAAGLLTHRKTYNCLVQYKSKWLTNFLIGYIILMLIKDSVLIVHADGTDFEKCSGEADITWNCTGPFLNLGNCEKKQKKESYNNIATQLKGLDAISVLDIPMISKIPEDIAGALRFIEEQRSYHVQLTAEYAMLTRYCDYYTQFTDNSGYSQTTWRVYLRSHDFEACILYPNQHFCRCVKHGDKCSSSNWDFANEMKNYYSGKQSKFDKDLNLALMSLHHAFRGTSSFYIAKLLKEKKNEDLVTYAEKIKGKYPGNALLKAIIDYIKYMKGLTEMNNFKHDEMWDDFIFGVPPTKSPSVRRLESSYDFKTNVNSNPSHICKNIKTVVCLSPKSGVSYDSIIACGEPSQPSIYRKPDSQVFQSNADQTHFCLSDTHCLENYETVGEEIIDAIKKSKCWETEFTEYIQFKQSDGVRSCRMKDSGECTVTTNRWPIILCDNDKFYYSELQKDYDKDQDIGHFCLSPRCNTIRHPINRKHISNCTWQVNHNNIDKIEVHELEDLEQYKKAITQKLQTSLTLFKYSKTKNLPHIKPMYKYITIEGTETAEGIESAYIESEIPALAGTSIGFKITSKSGKHLLDVIGYVKSASYSAVYTKLYTTGPTIGVNTKHDELCTGPCPVNVPHSTGWLTFAKERTSSWGCEEFGCLAISDGCVFGSCQDIIKDEITVYRKETEETTDVELCLTFADKTYCTNLNAVTPIITDQFEVQFKTVEAYSLPRIIAVRNHEIMVGQINDIGVYSKGCGNVQKVNNTNYGNGVPKFDYLCHLASRKEVIVRKCFDNDYQACKFLQTPASYRLEEEGGSVTVIDYKKILGTIKMKAILGDVKYKTFADNADLTVEGVCTGCINCFENIHCELTIHSTVEASCPVVSSCTVFHDRILITPNEHKYAIKVICNEKPGPTLPFKICSAKTDAAMTLADAKPILELAPVDQTTYIKEKGERCKTWMCRVRDEGFQVIFEPFKNLFGSYIGIFYTFIISLMAIFIVIYIVLPICFKLRDTLRQHEDAYKREMKIR

SEQ ID NO: 1912 - protein, 1440 aa, Artificial Sequence
  derived and/or modified protein sequence (wt) from TAHV(90)__GQ386827.1__GP
MMFVLFFIALSAASPVYQRCFQDGAIVKQNPSKQAVTEVCLKDDVSMIKTEARYFRNATGTYANNVAIRKWLVSDWHDCRPKKVAGGHINVIEVGDDLTLHTEAYVCNADCTIGVDKETAQVRLQTDTTNHFEIAGTTVKSGWFKSTTYITLDQTCEHLKVSCGPKSIQFHACFNQHMSCVRFLHRTILPGSIASSICQNVEIIILTVLTLLIFILLSILSKTYICYILMPIFIPLAYIYGVIYNKSCKKCKLCGLVYHPFTECGTHCVCGARYETSDRMKLHRASGLCPGYKSLRAARVMCKSKGPASILSIITAVLILTFVTPINAMVAGDTQETFKLEDLPDDMLSMAMKVNMYYIMCMINYAVTWSFILCALLIALLFKKYQHRFLNFYAMYCHECDMYHDRSGLKYNGDFTNKCRQCTCGQYEDAAGLLTHRKTYNCLVQYKSKWLTNFLIGYIILMLIKDSVLIVHADGTDFEKCSGEADITWNCTGPFLNLGNCEKKQKKESYNNIATQLKGLDAISVLDIPMISKIPEDIAGALRFIEEQRSYHVQLTAEYAMLTRYCDYYTQFTDNSGYSQTTWRVYLRSHDFEACILYPNQHFCRCVKHGDKCSSSNWDFANEMKNYYSGKQSKFDKDLNLALMSLHHAFRGTSSFYIAKLLKEKKNEDLVTYAEKIKGKYPGNALLKAIIDYIKYMKGLTEMNNFKHDEMWDDFIFEVPPTKSPSVRRLESSYDFKTDVNSNPSHICKNIKTVVCLSPKSGVSYDSIIACGEPSQPSIYRKPDSQVFQSNADQTHFCLSDTHCLENYETVGEEIIDAIKKSKCWETEFTEYIQFKQSDGVRSCRMKDSGECTVTTNRWPIILCDNNKFYYSELQKDYDKDQDIGHFCLSPRCNTIRHPINRKHISNCTWQVNHNNIDKIEVHELEDLEQYKKAITQKLQTSLTLFKYSKTKNLPHIKPMYKYITIEGTETAEGIESAYIESEIPALAGTSIGFKITSKSGKHLLDVIGYVKSASYSAVYTKLYTTGPTIGVNTKHDELCTGPCPVNVPHGTGWLTFAKERTSSWGCEEFGCLAISDGCVFGSCQDIIKDEITVYRKETEETTDVELCLTFADKTYCTNLNAVTPIITDQFEVQFKTVEAYSLPRIIAVRNHEIMVGQINDIGVYSKGCGNVQKVNNTNYGNGVPKFDYLCHLASRKEVIVRKCFDNDYQACKFLQTPASYRLEEEGGSVTVIDYKKILGTIKMKAILGDVKYKTFADNVDLTVEGVCTGCINCFENIHCELTIHSTVEASCPVVSSCTAFHDRILITPNEHKYAIKVICNEKPGPTLPFKICSAKTDAAMTLADAKPILELAPVDQTTYIKEKDERCKTWMCRVRDEGFQVIFEPFKNLFGSYIGIFYTFIISLMAIFIVIYIVLPICFKLRDTLRQHEDAYKREMKIR

SEQ ID NO: 1913 - protein, 1440 aa, Artificial Sequence
  derived and/or modified protein sequence (wt) from TAHV(94)__GQ386828.1__GP
MMFVLFFIALSAASPVYQRCFQDGAIVKQNPSKQAVTEVCLKDDVSMIKTEARYFRNATGTYANNVAIRKWLVSDWHDCRPKKVSGGHINVIEVGDDLTLHTEAYVCNADCTIGVDKETAQVRLQTDTTNHFEIAGTTVKSGWFKSTTYITLDQTCEHLKVSCGPKSIQFHACFNQHMSCVRFLHRTILPGSIASSICQNVEIIILTVLTLLIFILLSILSKTYICYILMPIFIPLAYIYGVIYNKSCKKCKLCGLVYHPFTECGTHCVCGARYETSDRMKLHRASGLCPGYKSLRAARVMCKSKGPASILSIITAVLILTFVTPINAMVAGDTQETFKLEDLPDDMLSMAMKVNMYYIMCMINYAVTWSFILCALLIALLFKKYQHRFLNFYAMYCHECDMYHDRSGLKYNGDFTNKCRQCTCGQYEDAAALLTHRKTYNCLVQYKSKWLTNFLIVYIILMLIKDSVLIVHADGTDFEKCSGEADITWNCTGPFLNLGNCEKKQKKESYNNIATQLKGLDAISVLDIPMISKIPEDIAGALRFIEEQRSYHVQLTAEYAMLTRYCDYYTQFTDNSGYSQTTWRVYLRSHDFEVCILYPNQHFCRCVKHGDKCSSSNWDFANEMKNYYSGKQSKFDKDLNLALMSLHHAFRGTSSFYIAKLLKEKKNEDLVTYAEKIKGKYPGNALLKAIIDYVKYMKDLTEMNNFKHDEMWDDFIFEVPPTKSPSVRRLESSYDFKTNVNSNPSHICKNIKTVVCLSPKSGVSYDSIIACGEPSQPSIYRKPDSQVFQSNADQTHFCLSDTHCLENYETVGEEIIDAIKKSKCWETEFTEYIQFKQSDGVRSCRMKDSGECTVTTNRWPIILCDNDKFYYSELQKDYDKDQDIGHFCLSPRCNTIRHPINRKHISNCTWQVSHNNIDKIEVHELEDLEQYKKAITQKLQTSLTLFKYSKTKNLPHIKPMYKYITIEGTETAEGIESAYIESEIPALAGTSIGFKITSKSGKHLLDVIGYVKSASYSAVYTKLYTTGPTIGVNTKHDELCTGPCPVNVPHGTGWLTFAKERTSSWGCEEFGCLAISDGCVFGSCQDIIKDEITVYRKETEETTDVELCLTFADKTYCTNLNAITPIITDQFEVQFKTVEAYSLPRIIAVRNHEIMVGQINDIGVYSKGCGNVQKVNNTNYGNGVPKFDYLCHLASRKEVIVRKCFDNDYQACKFLQTPASYRLEEEGGSVTVIDYKKILGTIKMKAILGDVKYKTFADNVDLTVEGVCTGCVNCFENIHCESTIHSTVEASCPVISSCTVFHDRILITPNEHKYAIKVICNEKPGPTLPFKICSAKTDAAMTLADAKPILELAPVDQTTYIKEKDERCKTWMCRVRDEGFQVIFEPFKNLFGSYIGIFYTFIISLMAIFIVIYIVLPICFKLRDTLRQHEDAYKREMKIR

SEQ ID NO: 1914 - protein, 1440 aa, Artificial Sequence
  derived and/or modified protein sequence (wt) from TAHV(XJ0625)__EU622819.2__GP
MMFVLFFIALSTASPVYQRCFQDGAIVKQNPSKQAVTEVCLKDDVSMIKTEARYFKNATGTYANNVAIRKWLVSDWHDCRPKKVAGGHINVIEVGDDLTLHTEAYVCNADCTIGVDKETAQVRLQTDTTNHFEIAGTTVKSGWFKSTTYITLDQTCEHLKVSCGPKSVQFHACFNQHMSCVRFLHRTILPGSIASSICQNVEIIILTVLTLLIFILLSILSKTYICYLLMPIFIPLAYVYGVIYNKSCKKCKLCGLVYHPFTECGTHCVCGARYETSDRMKLHRASGLCPGYKSLRAARVMCKSKGPASILSVITAVLILTFVTPINAMVAGDTQETFKLEDLPDDMLSMAMKIQMYYIMCIVNYIVTWSFIVCALIIALIFKKYQHRFLNFYAMYCHECDMYHDRSGLKYNGDFTNKCRQCTCGQYEDAAGLLTHRKTYNCLVQYKSKWLVNFLIIYILLMLVKDSVLIVQAEGTDFEKCSGEINITWNCTGPFLNLGNCEKKQKKEPYSNIATQLKGLDAISILDIPMISRIPEDIAGALRFIEEQNSYHVQLTAEYAMLTRYCDYYTQFSDNSGYSQKTWRVYLRSHDFEACILYPNQHFCRCVKHGDKCSSSNWDFASEMKNYYTGKQLKFNKDLNLALMSFHHAFRGTSSFYVAKLLREKNNEELVNYTEKIKDKYPGNALLKAIIDYIKYMKNLSEMTNFKHDEMWDDFVFNSPPTKSPSVRRSDSAYDFKNNINSNPSHICQNIKTVICLSPKSGVSYDSIIACGEPSQPTIYKKPESRVFQSNADQTHFCLADTHCLENYETVGEEILDAIKKSKCWETDFTEYIQFKQSDGVRSCRMKDSGECTVTTHRWPIILCDNNKFYYSELQKDYDKDQDIGHFCLSPRCNTIRHPINQKHISNCTWQVSHNNIEKIEVHELENLEQYKKAITQKLQTSLTLFKYSKTKNLPHIKPMYKYITIEGTETAEGIESAYIESEIPALAGTSIGFKITSKSGKHLLDVIGYVKSASYSAVYTKLYTTGPTIGVNTKHDELCTGPCPVNVPHGTGWLTFAKERTSSWGCEEFGCLAISDGCVFGSCQDIIKEELAVYRKETEETTDVELCLTFADKTYCTNLNAITPIITDQFEVQFKTVESYSLPRIIAVRNHEIMVGQINDIGVYSKGCGNVQKVNNTNYGNGVPKFDYLCHLASRKEVIVRKCFDNDYQACKFLQTPASYRLEEEGGSVTVIDYKKILGTIKMKAILGDVKYKTFADNVDLTVEGVCTGCINCFENIHCELTIHSTVEASCPVTSSCTVFHDRILITPNEHKYAIKVICAEKPGPSLQFKICNAKTDAAMTLADAKPILELAPVDQTTYIKEKDVRCKTWMCRVRDEGLQVIFEPFKNLFGSYIGIFYTFLITLIAVFVVIYIVLPICFKLRDTLRQHEDAYKREMKIR

SEQ ID NO: 1915 - protein, 1440 aa, Artificial Sequence
  derived and/or modified protein sequence (wt) from TAHV(XJ0708)__HM243138.1__GP
MILVLVFVALSAASPVYQRCFQDGAIVKQSPSKQAVTEVCLKDDVSMIKTEARYFKNATGTYANNVAIRKWLVSDWHDCRPKKISGGHINVIEVGDDLTLHTEAYVCNADCIIGVDKETAQVRLQTDTTNHFEIAGTTVKSGWFKSTTYITLDQTCEHLKVSCGPKSIQFHACFNQHMSCVRFLHRTILPGSIASSICQNVEIIILTVLTLLIFILLSILSKTYICYILMPIFIPLAYVYGVIYNKSCKKCKLCGLVYHPFTECGTHCVCGARYETSDRMKLHRASGLCPGYKSLRAARVMCKSKGPASILSIITAVLILTFVTPINAMIAGETQETFKLEDLPDDMLSMAMKLNMYYLMCIVNYIVTWSFIICALIIALIFKKYQHRFLNFYAMYCHECDMYHDRSGLKYNGDFTNKCRQCTCGQYEDAAGLLTHRKTYNCLVQYKSKWLVNFLIVYILLMLVKDSILIVQAEGTDFDKCSGEAGIIWNCTGPFLNLGNCEKKQKKESYNNIATQLKGLNAISVLDIPMISRIPEDIAGALRFIEDQNSYHVQLTAEYAMLTRYCDYYTQFSDNSGYSQTTWRVYLRSHNFEACILYSNQHFCRCVKHGDKCSSSNWDFANEMKNYYSGKQSKFNKDLNLALMSLHHAFRGTSSFYIAKLLREKKNEELINYVEEIKKKYPGNALLKAVIDYIKYMKNLTEMASFKHDEMWDEFVYESPPTRSPSARRSESEYDFKTNVNSKPTHVCKNIKTVVCLSPKSGVSYDSIIACGEPGQPSVYRKPEQQVFQSNADQTHFCLLDTHCLENYTTVNDEILDAIKKSRCWETEFTEYIQFKQGDGVRSCRMKDSGECAVAANRWPIILCDNNKFYYSELQKDYDKDQDIGHFCLSPRCNTIRHPINQKHISNCTWQVSHNNIEKIEVHELENLEQYKKAITQKLQTSLTLFKYSKTKNLPHIKPMYKYITIEGTETAEGIESAYIESEIPALAGTSIGFKITSKSGKHLLDVIGYVKSASYSSVYTRLYTTGPTIGINTRHDELCTGPCPVNVPHNTGWLTFAKERTSSWGCEEFGCLAISDGCVFGSCQDIIKEELTVYRKETEETTDVELCLTFADKTYCTNLNAITPIITDQFEVQFKTVEAYSLPRIIAVRNHEILVGQINDLGVYSKGCGNVQKVNKTNYGNGVPKFDYLCHLASRKEVIVRKCFDNDYQACKFLQTPASYRLEEEGGTVTVIDYKKILGTIKMKAILGDVKYKTFADNVDLTIEGVCTGCINCFENIHCELTIHSTVEASCPIISSCTVFHDRILITPNEHKYAIKVICNEKPGSSLSFRVCNTKTDAAMTLTDAKPILELAPVDQTAYIKEKDERCKTWMCRVRDEGLQVIFEPFKNLFGSYIGIFYTFILSLIAIFIIIYIVLPICFKLRDTLRQHEDAYKREMKIR

SEQ ID NO: 1916 - protein, 1440 aa, Artificial Sequence
  derived and/or modified protein sequence (wt) from TAHV(XJ0710)__HM243141.1__GP
MMFVLFFIALSAASPVYQRCFQDGAIVKQNPSKQAVTEVCLKDDVSMIKTEARYFKNATGTYANNVAIRKWLVSDWHDCRPKKVAGGHINVIEVGDDLTLHTEAYVCNADCTIGVDKETAQVRLQTDTTNHFEIAGTTVKSGWFKSTTYITLDQTCEHLKVSCGPKSVQFHACFNQHMSCVRFLHRTILPGSIASSICQNVEIIILTVLTLLIFILLSILSKTYICYLLMPIFIPLAYVYGVIYNKSCKKCKLCGLVYHPFTECGTHCVCGARYETSDRMKLHRASGLCPGYKSLRAARVMCKSKGPASILSIITAVLILTFVTPINAMVAGDTQETFKLEDLPDDMLSMAMKIQMYYIMCIVNYIVTWSFIVCALIIALIFKKYQHRFLNFYAMYCHECDMYHDRSGLKYNGDFTNKCRQCTCGQYEDAAGLLTHRKTYNCLVQYKSKWLVNFLIIYILLMLVKDSVLIVQAEGIDFEKCSGEINITWNCTGPFLNLGNCEKKQKKEPYSNIATQLKGLDAISILDIPMISRIPEDIAGALRFIEEQNSYHVQLTAEYAMLTRYCDYYTQFSDNSGYSQTTWRVYLRSHDFEACILYPNQHFCRCVKHGDKCSSSNWDFASKMKNYYTGKQLKFNKDLNLALMSFHHAFRGTSSFYVAKLLREKNNDELVNYTEKIKNKYPGNALLKAIIDYIKYMKSLSEMTNFKHDEMWDDFVFNSPPTKSPSVRRSDSAYDFKNNINSNPSHICKNIKTVVCLSPKSGVSYDSIIACGEPSQPTIYKKPESRVFQSNADQTHFCLADTHCLENYETVGEEILDAIKKSKCWETDFTEYIQFKQSDGVRSCRMKDSGECTVTTNRWPIILCDNNKFYYSELQKDYDKDQDIGHFCLSPRCNTIRHPINQKHISNCTWQVSHNNIEKIEVHELENLEQYKKAITQKLQTSLTLFKYSKTKNLPHIKPMYKYITIEGTETAEGIESAYIESEIPALAGTSIGFKITSKSGKHLLDVIGYVKSASYSAVYTKLYTTGPTIGVNTKHDELCTGPCPVNVPHGTGWLTFAKERTSSWGCEEFGCLAISDGCVFGSCQDIIKEELAVYRKETEEATDVELCLTFADKTYCTNLNAITPIITDQFEVQFKTVESYSLPRIIAVRNHEIMVGQINDIGVYSKGCGNVQKVNNTNYGNGVPKFDYLCHLASRKEVIVRKCFDNDYQACKFLQTPASYRLEEEGGSVTVIDYKKILGTIKMKAILGDVKYKTFADNVDLTVEGVCTGCINCFENIHCELTIHSTVEASCPVTSSCTVFHDRILITPNEHKYAIKVICAEKPGPSLQFKICNAKTDAAMTLADAKPILELAPVDQTTYIKEKDERCKTWMCRVRDEGLQVIFEPFKNLFGSYIGIFYTFLITLIAVFIVIYIVLPICFKLRDTLRQHEDAYKREMKIR

SEQ ID NO: 1917 - protein, 1441 aa, Artificial Sequence
  derived and/or modified protein sequence (wt) from TVTV__AF123491.1__GP
MIVFALLTIVAASPVYKRCFQDGAIVRQEYSKNAVTEVCLKDDVSMIKTEAEYFKNSTGVFSKNIAYRKWLVSDWNECRPQKSANGHINVIEVQPDLSLQTNSYVCAATCVISIDKETAQVRLQTDTTNHFEISGTTVKSGWFKSTTYLTLDQTCEHLKISCGSKSVQLHACFNQHMSCVRFLHRTILPGKHRKSICQNIEIIILTSLSLFIFLFLTIISKTYICYVLIPIFIPIAYVYGFIYNKSCKKCKLCGLVYHPFTECGSHCVCGAKYDTSDRMKMHRSSGLCPGYKSLRAARSMCKSKGPAPILSLLSAVLILTFVTPITAISLKDEEKETYKLPELPDDKVNLETKIDLYFQMCLINYATTWALIFCVLITACLFKKLQHKFLDYYAVYCHECDMYHEKTSLKYNGDFSNKCRQCTCEQYEDATGLLTHRKSYNRLVQYKAKWTLNFLITYAILVIIKDSVMIVGASNTDVKDCLDQEEITWNCTGPFLNMGRCTRPQKKENYGNIATQLKGLDVLSALDMPAVGKIPEDIAGALSYIESKKTYHEQLTLEFAMLTRYCDFYKQYADNSGYSQTTWRAYIRSHDFGVCIMYPNQHFCRCVKMGEKCTSSNWDFANQMANYYNGKQNRFNKDLNLALYTMHHAFRGSTSYLISKVLHEKKYDQLTNLLTQLKTKYPGNALLKALIGYQIYLKSLSEMSSFTPDELWDDLQYVPAPTFKPNLGRSGDNEYKFDKSRIVDPQTTCTSLKGVNCLSPRSRASVSDIIACGQATQPALFYVPNDKIHQSNTDQNQYCIGDSHCLTKFTPITEELLAAVKKSKCQAFDLDNIVKTSTSTGVRSCLVKKFGNCNTTNQVWPITICSDDQYYYTDTKQSYDSYQDIGHFCLSPRCSTIRYPVNPKHLSACTWTEEYTPVDKISVTNIEEIEQYKKALLQKLQTGLNIFKYRKTSNLPHIKSMYKYITVQGTGTAEGVENAYIESEMPALAGSSSGFKVLSKEGNHLFDVVAYIKSASYSSVYNKLYSTGPTLGINVKHDEKCTGPCPANIPHKTGWLTFARERTSTWGREEYGCLAISDGCVFGSCQDIIKPEMTVYRKQTDEIVTVELCLTFVDKTYCTELNAVTPIISDLFEVQFKTVESYSLPKIVAIKNHQIFVGQINVIGTNSKGCGNVQVFNGTNYGSGTPRFDYLCHLASRREVIMRKCFDNDYQACKFLQQPSSFRLEEEGETVTIIDYKKILGTIKMKAIFGDVKYRTFSEKVDINAEGVCAGCINCFERINCEFTIHSTVETSCPLVADCQLFHDRLLITPNEHKYAIKAICKDKPSNTLRFSICNTKVEATVTIIDAKPILELAPVDQTAYIKEKDERCKTWLCRVKDEGVAVLLEPFKNLFGSYIGIFYGIILVVLAILVCIYIVLPVCFKIKDTLKKHEDAYKREMKIR

SEQ ID NO: 1918 - protein, 1444 aa, Artificial Sequence
  derived and/or modified protein sequence (wt) from TVTV(AR42)__KX891322.1__GP
MRNMIVFALLTIVAASPVYKRCFQDGAIVRQEYSKNAVTEVCLKDDVSMIKTEAEYFKNSTGVFSKNIAYRKWLVSDWNECRPQKSANGHINVIEVQPDLSLQTNSYVCAATCVISIDKETAQVRLQTDTTNHFEISGTTVKSGWFKSTTYLTLDQTCEHLKISCGSKSVQLHACFNQHMSCVRFLHRTILPGNIANSICQNIEIIILTSLSLFIFLFLTIISKTYICYVLIPIFIPIAYVYGFIYNKSCKKCKLCGLVYHPFTECGSHCVCGAKYDTSDRMKMHRSSGLCPGYKSLRAARSMCKSKGPASILSLLSAVLILTFVTPITAISLKDEEKETYKLSELPDDMVNLENKIDLYFQMCLINYATTWALIFCALITACLFKKLQHKFLDYYAVYCHECDMYHERRGLKYNGDFSNKCRQCTCGQYEDATGLLTHRKSYNCLVQYKAKWMLNFLITYAILVIIKDSVMIVGASDTDVKDCLDQEEITWNCTGPFLNMGSCTRPQKKENYGNIATQLKGLDVLSALDMPAVGKIPEDIAGALSYIESKKTYHEQLTLEFAMLTRYCDFYKQYADNSGYSQTTWRAYIRSHDFGVCIMYPNQHFCRCVKMGEKCTSSNWDFANQMANYYNGKQNRFNKDLNLALYTMHHAFRGSTSYLISKVLHEKKYDQLTNLLTQLKTKYPGNALLKALIDYQIYLKSLSEMSSFTPDELWDDLQYVPAPTFKPNLGRSEDNEYKFDKSRIVDPQTTCTSLKGVNCLSPRSRASVSDIIACGQATQPALFYVPNDKIHQSNTDQNQYCIGDSHCLTKFTPITEELLAAVKKSKCQAFDLDDIVKTSPSTGVRSCLVKKFGNCNTTNQVWPITICSDDQYYYTDTKQSYDSNQDIGHFCLSPRCSTIRYPVNPKHLSACTWTEEYTPVDKISVTNIEEIEQYKKALLQKLQTGLNIFKYKKTSNLPHIKPMYKYITVQGTETAEGVENAYIESEMPALAGSSSGFKVLSKEGNHLFDVVAYIKSASYSSVYNKLYSTGPTLGINVKHDEKCTGPCPANIPHKTGWLTFARERTSTWGCEEYGCLAISDGCVFGSCQDIIKPEMTVYRKQTDEIVTVELCLTFVDKTYCTELNAVTPIISDLFEVQFKTVESYSLPKIVAIKNHQIFVGQINDIGTYSKGCGNVQVFNGTNYGSGTPRFDYLCHLASRKEVIMRKCFDNDYQACKFLQQPSSFRLEEEGETVTIIDYKKILGTIKMKAIFGDVKYKTFSEKVDINAEGVCAGCINCFESINCEFTIHSTVETSCPLVADCQLFHDRLLITPNEHKYAIKAICKDKPSNTLRFSICNTKVEATVTIIDAKPILELAPVDQTAYIKEKDERCKTWLCRVKDEGVAVLLEPFKNLFGSYIGIFYGIILVVLAILVCIYIVLPVCFKIRDTLKKHEDAYKREMKIR

SEQ ID NO: 1919 - protein, 1444 aa, Artificial Sequence
  derived and/or modified protein sequence (wt) from TVTV(Eklund)__KR149248.1__GP
MRNMIVFALLTIVAASPVYKRCFQDGAIVRQEYSKNAVTEVCLKDDVSMIKTEAEYFKNSTGVFSKNIAYRKWLVSDWNECRPQKSANGHINVIEVQPDLSLQTNSYVCAATCVISIDKETAQVRLQTDTTNHFEISGTTVKSGWFKSTTYLTLDQTCEHLKISCGSKSVQLHACFNQHMSCVRFLHRTILPGNIANSICQNIEIIILTSLSLFIFLFLTIISKTYICYVLIPIFIPIAYVYGFIYNKSCKKCKLCGLVYHPFTECGSHCVCGAKYDTSDRMKMHRSSGLCPGYKSLRAARSMCKSKGPASILSLLSAVLILTFVTPITAISLKDEEKETYKLSELPDDMVNLETKIDLYFQMCLINYATTWALIFCALITACLFKKLQHKFLDYYAVYCHECDMYHERRGLKYNGDFSNKCRQCTCGQYEDATGLLTHRKSYNCLVQYKAKWMLNFLITYAILVIIKDSVMIVGASNTDVKDCLDQEEITWNCTGPFLNMGRCTRPQKKENYGNIATQLKGLDVLSALDMPAVGKIPEDIAGALSYIESKKTYHEQLTLEFAMLTRYCDFYKQYADNSGYSQTTWRAYIRSHDFGVCIMYPNQHFCRCVKMGEKCTSSNWDFANQMANYYNGKQNRFNKDLNLALYTMHHAFRGSTSYLISKVLHEKKYDQLTNLLTQLKTKYPGNALLKALIDYQIYLKSLSEMSSFTPDELWDDLQYVPAPTFKPNLGRSEDNEYKFDKSRIVDPQTTCTSLKGVNCLSPRSRASVSDIIACGQATQPALFYVPNDKIHQSNTDQNQYCIGDSHCLTKFTPITEELLAAVKKSKCQAFDLDNIVKTSPSTGVRSCLVKKFGNCNTTNQVWPITICSDDQYYYTDTKQSYDSYQDIGHFCLSPRCSTIRYPVNPKHLSACTWTEEYTPVDKISVTNIEEIEQYKKALLQKLQTGLNIFKYRKTSNLPHIKPMYKYITVQGTETAEGVENAYIESEMPALAGSSSGFKVLSKEGNHLFDVVAYIKSASYSSVYNKLYSTGPTLGINVKHDEKCTGPCPANIPHKTGWLTFARERTSTWGCEEYGCLAISDGCVFGSCQDIIKPEMTVYRKQTDEIVTVELCLTFVDKTYCTELNAVTPIISDLFEVQFKTVESYSLPKIVAIKNHQIFVGQINDIGTYSKGCGNVQVFNGTNYGSGTPRFDYLCHLASRKEVIMRKCFDNDYQACKFLQQPSSFRLEEEGETVTIIDYKKILGTIKMKAIFGDVKYKTFSEKVDINAEGVCAGCINCFESINCEFTIHSTVETSCPLVADCQLFHDRLLITPNEHKYAIKAICKDKPSNTLRFSICNTKVEATVTIIDAKPILELAPVDQTAYIKEKDERCKTWLCRVKDEGVAVLLEPFKNLFGSYIGIFYGIILVVLAILVCIYIVLPVCFKIKDTLKKHEDAYKREMKIR

SEQ ID NO: 1920 - protein, 1444 aa, Artificial Sequence
  derived and/or modified protein sequence (wt) from JCV(3324-04)__HM007357.1__GP
MEVLNLIWLLTLCLASPVFQRCFQDGAIVKQNPSKEAVTEVCLKDDVSMIKTEAKYVKNTTGTFANNIAMRKWLVADWHDCRPQKSSGGHINVIEVGDDLSLHTESYICSADCVITVDKETAQIRLQTDNTNHFEVAGTTVKSGWFKSTTYITLDQTCEHLKVSCGPKSIQFHACFNQHMSCVRFLHRTILPGSIANSICQNIEIIILVTLSLVIFIFLTIVSKTYICYLLMPIFIPIAFIYGWIYNKSCKKCKLCGLVYHPFTECGTHCVCGARYETSDRMKLHRASGLCPGYKSLRAARVMCKSKGPASVLSIMTAVLILTFVTPISAMVIGESSEIYTLEDLPDDMVQMAERINIYYQIIIINYGITWAFLLLGLLLAYFFRKYQHRFLDFYAMYCEECDMYHEKAGLTHWGDFTNKCRQCTCGQYEDITGLMVHKKSYNCLVKYKAKWIRDILITYLVIILVKDSLLFVGATGTDFATCIDEKTVTWNCTGPFLNLGRCDKSQKKTNYADIANQLKGLGVISVLDIPMIKKMPDEISGSLKYIDNLETYHEQLTAEYAFLTRYCDYYTQYTDNSGYSQTVWRTYLRSHDFGACVVYPNQHFCRCVKYGDKCNSAKWDFANEMKTFYTGQKAKFNKDLNLALLVLHKAFRGTGTAYIAEAMARKDNGSMAHFALEVRKKFPTNALLAALIDYIVYLQSLAEISTFELDEDWEDFKYKPEPTESTIQARSHRDDQYNFKNAASGSNVKVCKNIQKVLCISPRSRAKFENIIACGEHANPSVYMMPNVSIYQSSSERSHYCIADSHCLEEYEVVETELLNALKKSKCWVKEMDDVILHKQSDGLRSCRMKDTGNCNVQENDWNIVLCENGNYYYSEIHKDYDKDQDVGHFCLSPRCNTIRYPISKRHIRSCNWQISHSTIDKIAVQELADIEQYKKAISQKLQTSLSIFKYIKTKNLPHIKPAYKYITVEGVETVEGIENAFIESEIPALAGTAIGFKINSREGNYLMDVIGYVKSASYSATYTKLYTTGPTIGINTRHDEKCTGPCPAVIDHKDGWLTFSKERTSTWGCEEFGCLAVSDGCVFGSCQDIIKDELAVYRKTTEELTTVELCLTFSDKTYCTNLNAITPIITDKFEVQFKTVEAYTLPRIIAVKNHEIKVGQINDLGVYSKGCGNVQKVNGTNYGNGAPRFDYLCHLASRKEVILRKCFDNDYQACKFLQSPSSYRLEEHQGTVTVIDYKKILGTIKMKAILGDVKYKNFQSNIEINAEGTCAGCINCFENIHCEFTIHTTVETSCPIVTDCVSFHDRILITPDEHKYALKVVCQDKPKVSLKFKICNTNIDASMTIVDSKPILELAPVDQTAYIREKDERCKTWMCRVRDEGFQVILEPFKNLFGSYIGIFYTGILSIICLLIVIYIILPICFKLRDTLRQHEDAYKKEMKIR

SEQ ID NO: 1921 - protein, 1444 aa, Artificial Sequence
  derived and/or modified protein sequence (wt) from JCV(61V2235)__U88058.1__GP
MEVLNLIWLLALCSASPVFQRCFQDGAIVKQNPSKEAVTEVCLKDDVSMIKTEAKYVKNTTGTFANNIAMRKWLVADWHDCRPQKSSGGHINVIEVGDDLSLHTESYICSADCVITVDKETAQIRLQTDNTNHFEVAGTTVKSGWFKSTTYITLDQTCEHLKVSCGPKSIQFHACFNQHMSCVRFLHRTILPGSIANSICQNIEIIILVTLSLVIFIFLSIVSKTYVCYLLMPIFTPIAFIYGWVYNKSCKKCKLCGLVYHPFTECGTHCVCGARYENSDRMKLHRASGLCPGYKSLRAARVMCKSKGPASILSIMTAILILTFVTPISAMVIGESSELYTLDDLPNDMVQMAERVNIYYQITIINYGVTWAFFCLGLILAYFFKKYQHKFLDFYAMYCEECDMYHEKSGLTHWGDFTNKCRQCTCGQFEDVAGLMIHKKSYNCLVKYKAKWIRDILIIYLAMILIKDSLLFVGASGTDFAACIDEKVVTWNCTGPFLNLGRCDKSQKKASYAGIADQLKGLGVISVLDIPMIKNMPDEISGSLKYIDSLETYHEQLTAEYAFLTRYCDYYTQYTDKSGYSQTVWRTYLRSHDFGACVVYPNQHFCRCVKYGDKCNSAKWDFANEMKTFYTGQKVKFNKDLNLALLVLHKAFRGTGTAYVAEAMAREDNGSMAHFALEIRKKFPTNALLAALIDYIVYLQSLGEIATFELDEDWEDFKYKPEPTESTPQVRSHRNDQYNFKNAESNSDTKVCKNVQKVLCISPRSKAKFENIIACGEHANPSVYMMPNVSIYQSNSERSHYCIAGSHCLEKYEVVETELLNALKKSKCWAKEMDDIILHKQSDGLRSCRIKDTGNCNVQENDWTIVLCENGNYYYSEVHKDYDKDQDVGHFCLSPRCTTIRYPISKRHIKKCEWQISHSTIDKISVQELADIEQYKKAISQKLQTSLSIFKYVRTKNLPHIKPAYKYITVEGVETIEGIENAFIESEIPALAGTAIGFKINSREGNYLMDVIGYVKSASYSAVYTKLYTTGPTIGINTKHDEKCTGPCPAIIDHKDGWLTFSKERTSTWGCEEFGCLAVSDGCVFGSCQDIIKDELAVYRKTTEELTTVELCLTFSDKTYCTNLNAITPIITDKFEVQFKTVESYTLPRVIAIKNHEIKVGQINDLGVYSKGCGNVQKVNGTNYGNGSPRFDYLCHLASRKEVILRKCFDNDYQACKFLQSPSSYRLEEHQGTVTVIDYKKILGTIKMKAILGDVKYKNYQNNIEISAEGTCAGCIDCFENIHCEFTIHTTVEASCPITTECVSFHDRILITPDEHKYALKIVCHDKPKVSLKFKICNTHVDAAMTIVDSKPILELAPVDQTTYIREKDERCKTWMCRVRDEGFQVILEPFKNLFGSYIGIFYTGILSIICLLIVVYIILPICFKLRDTLRQHEDAYKKEMKIR

SEQ ID NO: 1922 - protein, 1444 aa, Artificial Sequence
  derived and/or modified protein sequence (wt) from JCV(61V2235)__HM007351.1__GP
MEVLNLIWLLALCSASPVFQRCFQDGAIVKQNPSKEAVTEVCLKDDVSMIKTEAKYVKNTTGTFANNIAMRKWLVADWHDCRPQKSSGGHINVIEVGDDLSLHTESYICSADCVITVDKETAQIRLQTDNTNHFEVAGTTVKSGWFKSTTYITLDQTCEHLKVSCGPKSIQFHACFNQHMSCVRFLHRTILPGSIANSICQNIEIIILVTLSLVIFIFLSIVSKTYVCYLLMPIFIPIAFIYGWVYNKSCKKCKLCGLVYHPFTECGTHCVCGARYETSDRMKLHRASGLCPGYKSLRAARVMCKSKGPASILSIMTAILILTFVTPISAMVIGESSEVYTLDDLPNDMVQMAERVNIYYQIIIINYGVTWAFLLLGLILAYFFKKYQHKFLDFYAMYCEECDMYHEKSGLTHWGDFTNKCRQCTCGQFEDVAGLMIHKKSYNCLVKYKAKWIRDILIIYLAMILIKDSLLFVGASGTDFAACIDEKVVTWNCTGPFLNLGRCDKSQKKASYAGIADQLKGLGVISVLDIPMIKNMPDEISGSLKYIDSLETYHEQLTAEYAFLTRYCDYYTQYTDNSGYSQTVWRTYLRSHDFGACVVYPNQHFCRCVKYGDKCNSAKWDFANEMKTFYTGQKVKFNKDLNLALLVLHKAFRGTGTAYVAEAMARKDNGSMAHFALEIRKKFPTNALLAALIDYIVYLQSLGEIATFELDEDWEDFKYKPEPTESTPQVRSHRNDQYNFKNAESNSDTKVCKNVQKVLCISPRSKAKFENIIACGEHANPSVYMMPNVSIYQSNSERSHYCIADSHCLEKYEVVETELLNALKKSKCWAKEMDDIILHKQSDGLRSCRIKDTGNCNVQENDWTIVLCENGNYYYSEVHKDYDKDQDVGHFCLSPRCTTIRYPISKRHIKKCEWQISHSTIDKISVQELADIEQYKKAISQKLQTSLSIFKYVRTKNLPHIKPAYKYITVEGVETIEGIENAFIESEIPALAGTAIGFKINSREGNYLMDVIGYVKSASYSAVYTKLYTTGPTIGINTKHDEKCTGPCPAIIDHKDGWLTFSKERTSTWGCEEFGCLAVSDGCVFGSCQDIIKDELAVYRKTTEELTTVELCLTFSDKTYCTNLNAITPIITDKFEVQFKTVESYTLPRVIAIKNHEIKVGQINDLGVYSKGCGNVQKVNGTNYGNGSPRFDYLCHLASRKEVILRKCFDNDYQACKFLQSPSSYRLEEHQGTVTVIDYKKILGTIKMKAILGDVKYKNYQNNIEINAEGTCAGCIDCFENIHCEFTIHTTVEASCPITTECVSFHDRILITPDEHKYALKIVCHDKPKVSLKFKICNTNVDAAMTIVDSKPILELAPVDQTTYIREKDERCKTWMCRVRDEGFQVILEPFKNLFGSYIGIFYTGILSIICLLIVVYIILPICFKLRDTLRQHEDAYKKEMKIR

SEQ ID NO: 1923 - protein, 1444 aa, Artificial Sequence
  derived and/or modified protein sequence (wt) from JCV(61V2235)__KX817316.1__GP
MEVLNLIWLLALCSASPVFQRCFQDGAIVKQNPSKEAVTEVCLKDDVSMIKTEAKYVKNTTGTFANNIAMRKWLVADWHDCRPQKSSGGHINVIEVGDDLSLHTESYICSADCVITVDKETAQIRLQTDNTNHFEVAGTTVKSGWFKSTTYITLDQTCEHLKVSCGPKSIQFHACFNQHMSCVRFLHRTILPGSIANSICQNIEIIILVTLSLVIFIFLSIVSKTYVCYLLMPIFIPIAFIYGWVYNKSCKKCKLCGLVYHPFTECGTHCVCGARYETSDRMKLHRASGLCPGYKSLRAARVMCKSKGPASILSIMTAILILTFVTPISAMVIGESSEVYTLDDLPNDMVQMAERVNIYYQIIIINYGVTWAFLLLGLILAYFFKKYQHKFLDFYAMYCEECDMYHEKSGLTHWGDFTNKCRQCTCGQFEDVAGLMIHKKSYNCLVKYKAKWIRDILIIYLAMILIKDSLLFVGASGTDFAACIDEKVVTWNCTGPFLNLGRCDKSHKKASYAGIADQLKGLGVISVLDIPMIKNMPDEISGSLKYIDSLETYHEQLTAEYAFLTRYCDYYTQYTDNSGYSQTVWRTYLRSHDFGACVVYPNQHFCRCVKYGDKCNSAKWDFANEMKTFYTGQKVKFNKDLNLALLVLHKAFRGTGTAYVAEAMARKDNGSMAHFALEIRKKFPTNALLAALIDYIVYLQSLGEIATFELDEDWEGFKYKPEPTESTPQVRSHRNDQYNFKNAESNSDTKVCKNVQKVLCISPRSKAKFKNIIACGEHANPSVYMMPNVSIYQSNSERSHYCIADSHCLEKYEVVETELLNALKKSKCWAKEMDDIILHKQSDGLRSCRIKDTGNCNVQENDWTIVLCENGNYYYSEVHKDYDKDQDVGHFCLSPRCTTIRYPISKRHIKKCEWQISHSTIDKISVQELADIEQYKKAISQKLQTSLSIFKYVRTKNLPHIKPAYKYITVEGVETIEGIENAFIESEIPALAGTAIGFKINSREGNYLMDVIGYVKSASYSAVYTKLYTTGPTIGINTKHDEKCTGPCPAIIDHKDGWLTFSKERTSTWGCEEFGCLAVSDGCVFGSCQDIIKDELAVYRKTTEELTTVELCLTFSDKTYCTNLNAITPIITDKFEVQFKTVESYTLPRVIAIKNHEIKVGQINDLGVYSKGCGNVQKVNGTNYGNGSPRFDYLCHLASRKEVILRKCFDNDYQACKFLQSPSSYRLEEHQGTVTVIDYKKILGTIKMKAILGDVKYKNYQNNIEINAEGTCAGCIDCFENIHCEFTIHTTVEASCPITTECVSFHDRILITPDEHKYALKIVCHDKPKVSLKFKICNTNVDAAMTIVDSKPILELAPVDQTTYIREKDERCKTWMCRVRDEGFQVILEPFKNLFGSYIGIFYTGILSIICLLIVVYIILPICFKLRDTLRQHEDAYKKEMKIR

SEQ ID NO: 1924 - protein, 1444 aa, Artificial Sequence
  derived and/or modified protein sequence (wt) from JCV(3573-03)__HM007354.1__GP
MEVLSLIWLLTLCSASPVFQRCFQDGAIVKQNPSKEAVTEVCLKDDVSMIKTEAKYVKNTTGTFANNIAMRKWLVADWHDCRPQKSSGGHINVIEVGDDLSLHTESYICSADCVITVDKETAQIRLQTDNTNHFEVAGTTVKSGWFKSTTYITLDQTCEHLKVSCGPKSIQFHACFNQHMSCVRFLHRTILPSSIANSICQNIEIIILVTLSLTIFIFLTIVSKTYICYLLMPVFIPIAFVYGWIYNKSCKKCKLCGLVYHPFTECGTHCVCGARYETSDRMKLHRASGLCPGYKSLRAARVMCKSKGPASILSIMTAVLILTFVTPISAMMIGESSEVYTLDDLPDDMVQMAERVNIYYQIIIINYGVTWAFLLLGLVLAYFFKKYQHKFLDFYAMYCNECDMYHEKAGLTHWGDFTNRCRQCTCGQYEDVTGLIVHKKSYNCLVKYKAKWIRDILITYLIIILVKDSLLFVGATGTDFAACIDEKTVTWNCTGPFLNLGRCDKSQKKTSYNDIANQLKGLGVISVLDIPMIKRMPDEISGSLKYIDNLETYHEQLTAEYAFLTRYCDYYTQYTDNSGYSQTVWRTYLRSHDFGACVVYPNQHFCRCVKYGDKCNSAKWDFANEMKTFYTGQKIKFNKDLNLALLVLHKAFRGTGTAYIAEAMARKDNGSMAHFALEVRKKFPTNALLAALIDYIVYLQSLAEISTFELDEDWEDFKYKPEPTESPSQARSHRSDQYNFKNAESNSNVKVCKNIQKVLCISPRSRAKFENIIACGEHANPSVYMMPNVSIYQSNSERSHYCIADSHCLEDYEIVETELLSALKKSKCWAKEMDDIVLHKQSDGLRSCRMKDTGNCDVQENDWTIVLCENGNYYYSEIHKDYDKDQDVGHFCLSPRCSTIRYPINKRHIKRCNWQISHSTIDKISVQELADIEQYKKAISQKLQTSLSIFKYVKTKNLPHIKPAYKYITVEGIETVEGIENAFIESEIPALAGTAIGFKINSREGNYLMDVIGYVKSASYSATYTKLYTTGPTIGINTRHDEKCTGPCPAVIDHKDGWLTFSKERTSTWGCEEFGCLAVSDGCVFGSCQDIIKDELAVYRKTTEELTTVELCLTFSDKTYCTNLNAITPIITDKFEVQFKTVESYTLPRVIAVKNHEIKVGQINDLGVYSKGCGNVQKVNGTNYGNGMPKFDYLCHLASRKEVILRKCFDNDYQACKFLQSPSSYRLEEHQGTVTIIDYKKILGTIKMKAILGDVKYKNYQSNIEINAEGTCAGCINCFENIHCEFTIHTTVEASCPIVTDCVSFHDRILITPDEHKYALKVVCQDKPKVSLKFKICNTNIDASMTIVDSKPILELAPVDQTAYIKEKDERCKTWMCRVRDEGFQVILEPFKNLFGSYIGIFYTGILSVICLLIVIYIILPICFKLRDTLRQHEDAYKKEMKIR

SEQ ID NO: 1925 - protein, 1444 aa, Artificial Sequence
  derived and/or modified protein sequence (wt) from KEYV(KEYV/Ochlerotatus atlanticus/USA/KEYVLK01/2005)__KT630289.1__GP
MMIWILLTVVTVTIANPVYQRCFQDGAIVKQNPSKEAVTEVCLKDDVSMIKTEAKYVKNLTGTFSNNVAMRKWLVADWHDCRPQKRAGGHINVIEVGDDLSLHTESYICSADCVISVDKETAQIRLQTDTTNHFEVAGTTVKSGWFKSTTYITLDQTCEHLKVSCGPKSIQFHACFNQHMSCVRFLHRTILPGSIANSICQNIEIIILVTLTLLIFILLSILSKTYICYILMPIFIPIAYIYGWVYNKSCKKCKLCGLVYHPFTECGTHCVCGARYETSDRMKLHRASGLCPGYKSLRAARVMCKSKGPASILSILTAVLILTFITPMNAMVLGSSEEVYKLEDLPDDMLNMAEKIDIYYLSIVLNYSTTWGLLILLLIVSCLFKKYQHVFLNYYAMYCHECDMYHEKKNLVYNGDFSNKCRQCTCGQYEDATGLIVHQKSYNCLIKYKAKWFINILIIYTILVLLKDSVLMAAAEGPDFNTCIEQRSISLNCTGPFINLGGCEKPQKRASYQSIAEQLKAINAISILDMPMISKIPDDISGALRHIENLKTYHEQLTAEFAMLTRYCDYYTQFSDNSGYSQTSWRTYLRSHDFEVCIAYPNQHFCRCVKNGEKCTSANWDFANEMKNYYTGKQIRFDKDLNLALTTLHTAFRGTSTYYMSDILAETKANSLRDYALALKSKYPGNALLKAILDFIMYLQSLNEATKFKLSSDWEDFKYNSELEARALMPRARSSGDYNFSNAESTNKVKICKNIQRVMCLSPRSKATVEDIIACGEHEHPSVYMVPNTTIYQSNIERSHYCIADSHCLEEYELVQNELLTALKKSTCWTGELENVIPHKQSDGIRSCRTKNTGRCNVKGEDWTVILCENDKYYYSELNKDYDKDQDIGHVCLSPRCNSIRYPISPRHITNCKWENPAGTISRIETHSLADIEQYKKAISQKLQNSLTIFKYEKTKNLPHIKPIYKYITIEGTETVEGVENAFIEAEIPALAGTSIGFKVNSRDGDHLMDIIAYIKVASYSSTYTKLYTTGPTIGINTKHDEKCTGNCPARLEHKVGWLTFAKERTSTWGCEEFGCLAVSDGCVFGSCQDIIKEELSVYRKDTEEVSNVELCLTFADKTYCTSLNAITPIITEKFEVQFKTVESYSLPRIVGIRNHEIRIGQINDLGSYSKGCGNVQRVNGTNYGSGQPKFDYLCHLASRKEVIVRKCFDNDYQACKFLQTPSSYRLEEHEGTVTIIDYKKILGTIKMKAILGDVRYKNYASAIDINAEGVCAGCINCFENIHCEFTIHTTIEASCPIESDCVSFHDRILVTPNEHKYALKLICEDKPGSTLKFKICNTKIDAAMTLVDAKPILELAPVDQTAYIREKDERCKTWMCRVRDEGIKVLLEPFKNLFGSYIGIVYSIILIIIAAIIIIYIILPICFKLRDTLKKHEDAYRKEMKIR

SEQ ID NO: 1926 - protein, 1443 aa, Artificial Sequence
  derived and/or modified protein sequence (wt) from KEYV(KEYV/Ochlerotatus atlanticus/USA/KEYVLK01/2005)__KT630289.1__GP
MIWILLTVVTVTIANPVYQRCFQDGAIVKQNPSKEAVTEVCLKDDVSMIKTEAKYVKNLTGTFSNNVAMRKWLVADWHDCRPQKRAGGHINVIEVGDDLSLHTESYICSADCVISVDKETAQIRLQTDTTNHFEVAGTTVKSGWFKSTTYITLDQTCEHLKVSCGPKSIQFHACFNQHMSCVRFLHRTILPGSIANSICQNIEIIILVTLTLLIFILLSILSKTYICYILMPIFIPIAYIYGWVYNKSCKKCKLCGLVYHPFTECGTHCVCGARYETSDRMKLHRASGLCPGYKSLRAARVMCKSKGPASILSILTAVLILTFITPMNAMVLGSSEEVYKLEDLPDDMLNMAEKIDIYYLSIVLNYSTTWGLLILLLIVSCLFKKYQHVFLNYYAMYCHECDMYHEKKNLVYNGDFSNKCRQCTCGQYEDATGLIVHQKSYNCLIKYKAKWFINILIIYTILVLLKDSVLMAAAEGPDFNTCIEQRSISLNCTGPFINLGGCEKPQKRASYQSIAEQLKAINAISILDMPMISKIPDDISGALRHIENLKTYHEQLTAEFAMLTRYCDYYTQFSDNSGYSQTSWRTYLRSHDFEVCIAYPNQHFCRCVKNGEKCTSANWDFANEMKNYYTGKQIRFDKDLNLALTTLHTAFRGTSTYYMSDILAETKANSLRDYALALKSKYPGNALLKAILDFIMYLQSLNEATKFKLSSDWEDFKYNSELEARALMPRARSSGDYNFSNAESTNKVKICKNIQRVMCLSPRSKATVEDIIACGEHEHPSVYMVPNTTIYQSNIERSHYCIADSHCLEEYELVQNELLTALKKSTCWTGELENVIPHKQSDGIRSCRTKNTGRCNVKGEDWTVILCENDKYYYSELNKDYDKDQDIGHVCLSPRCNSIRYPISPRHITNCKWENPAGTISRIETHSLADIEQYKKAISQKLQNSLTIFKYEKTKNLPHIKPIYKYITIEGTETVEGVENAFIEAEIPALAGTSIGFKVNSRDGDHLMDIIAYIKVASYSSTYTKLYTTGPTIGINTKHDEKCTGNCPARLEHKVGWLTFAKERTSTWGCEEFGCLAVSDGCVFGSCQDIIKEELSVYRKDTEEVSNVELCLTFADKTYCTSLNAITPIITEKFEVQFKTVESYSLPRIVGIRNHEIRIGQINDLGSYSKGCGNVQRVNGTNYGSGQPKFDYLCHLASRKEVIVRKCFDNDYQACKFLQTPSSYRLEEHEGTVTIIDYKKILGTIKMKAILGDVRYKNYASAIDINAEGVCAGCINCFENIHCEFTIHTTIEASCPIESDCVSFHDRILVTPNEHKYALKLICEDKPGSTLKFKICNTKIDAAMTLVDAKPILELAPVDQTAYIREKDERCKTWMCRVRDEGIKVLLEPFKNLFGSYIGIVYSIILIIIAAIIIIYIILPICFKLRDTLKKHEDAYRKEMKIR

SEQ ID NO: 1927 - protein, 1443 aa, Artificial Sequence
  derived and/or modified protein sequence (wt) from KEYV(KEYV/Ochlerotatus atlanticus/USA/KEYVLK02/2005)__KT630292.1__GP
MIWILLTVVTATIANPVYQRCFQDGAIVKQNPSKEAVTEVCLKDDVSMIKTEAKYVKNLTGTFSNNVAMRKWLVADWHDCRPQKRAGGHINVIEVGDDLSLHTESYICSADCVISVDKETAQIRLQTDTTNHFEVAGTTVKSGWFKSTTYITLDQTCEHLKVSCGPKSIQFHACFNQHMSCVRFLHRTILPGSIANSICQNIEIIILVTLTLLIFILLSILSKTYICYILMPIFIPIAYIYGWVYNKSCKKCKLCGLVYHPFTECGTHCVCGARYETSDRMKLHRASGLCPGYKSLRAARVMCKSKGPASILSILTAVLILTFITPMNAMVLGSSEEVYKLEDLPDDMLNMAEKIDIYYLSIVLNYSTTWGLLILLLIVSCLFKKYQHVFLNYYAMYCHECDMYHEKKNLVYNGDFSNKCRQCTCGQYEDATGLIVHQKSYNCLIKYKAKWFINILIIYTILVLLKDSVLMAAAEGPDFNTCIEQRSISLNCTGPFINLGGCEKPQKRASYQSIAEQLKAINAISILDMPMISKIPDDISGALRHIENLKTYHEQLTAEFAMLTRYCDYYTQFSDNSGYSQTSWRTYLRSHDFEVCIAYPNQHFCRCVKNGEKCTSANWDFANEMKNYYTGKQIRFDKDLNLALTTLHTAFRGTSTYYMSDILAETKANSLRDYALALKSKYPGNALLKAILDFIMYLQSLNEATKFKLSSDWEDFKYNSEPEARALMPRARSSGDYNFSNAESTNKAKVCKNIQRVMCLSPRSKATVEDIIACGEHEHPSVYMVPNTTVYQSNIERSHYCIADSHCLEEYELVQNELLTALKKSTCWTGELENVIPHKQSDGTRSCRTKNTGRCNVKGEDWTVILCENDKYYYSELNKDYDKDQDIGHVCLSPRCNSIRYPISPRHITNCKWENPAGTISRIETHSLADIEQYKKAISQKLQNSLTIFKYEKTKNLPHIKPIYKYITIEGTETVEGVENAFIEAEIPALAGTSIGFKVNSRDGDHLMDIIAYIKVASYSSTYTKLYTTGPTIGINTKHDEKCTGNCPARLEHKVGWLTFAKERTSTWGCEEFGCLAVSDGCVFGSCQDIIKEELSVYRKDTEEVTNVELCLTFADKTYCTSLNAITPIITEKFEVQFKTVESYSLPRIVGIRNHEIRIGQINDLGSYSKGCGNVQRVNDTNYGSGQPKFDYLCHLASRKEVIVRKCFDNDYQACKFLQTPSSYRLEEHEGTVTIIDYKKILGTIKMKAILGDVRYKNYASAIDINAEGVCAGCINCFENIHCEFTIHTTIEASCPIESDCVSFHDRMLVTPNEHKYALKLICEDKPGSTLKFKICNTKIDAAMTLVDAKPILELAPVDQTAYIREKDERCKTWMCRVRDEGIKVLLEPFKNLFGSYIGIVYSIILIIIAAIIIIYVILPICFKLRDTLKKHEDAYRKEMKIR

SEQ ID NO: 1928 - protein, 1443 aa, Artificial Sequence
  derived and/or modified protein sequence (wt) from KEYV(C14031-33)__AF123489.1__GP
MIWILLTVVTVTIANPVYQRCFQDGAIVKQNPSKEAVTEVCLKDDVSMIKTEAKYVKNLTGTFSNNVAMRKWLVADWHDCRPQKRAGGHINVIEVGDDLSLHTESYICSADCVISVDKETAQIRLQTDTTNHFEVAGTTVKSGWFKSTTYITLDQTCERLKVSCGPKSIQFHACFNQHMSCVRFLHRTILLGSIANSICQNIEIIILVTLTLLIFILLSILSKTYICYILMPISIPIAYIYGWVYNKSCKKCKLCGLVYHPFTECGTHCVCGARYETSDRMKLHRASGLCPGYKSLRAARVMCKSKGPASILSILTAVLILTFITPMNAMVLGSSEEVYKLEDLPDDMLNMAEKIDIYYLSIVLNYSTTWGLLILLLIVSCLFKKYHLVFLNYYALYCHECDMYHEKKNLVYNGDFSNKCLQCTCGQYEDATGLIVHQKSYNCLINYKAKWFINILIIYTILVLLKDSVLMAAAERPDFNTCIEQRSISLNCTGPFINLGGCKKPQKRASYQSIAEQLKAINAISILDMPMISKIPDDISGALRHIENLKTYHEQLTAEFAMLTRYCDYYTQFSDNSGYSQTSWRTYLRSHDFEVCIAYPNQHFCRCVKNGEKCTSANWDFANEMKNYYTGKQIRFDKDLNLALTTLHTAFRGTSTYYMSDILAETKANSLRDYALALKSKYPGNALLKAILDFIMYLQPLNEATKFKLSSDWEDFKYNSEPEARALMPRARSSGDYNFSNAESTNKVKVCKNIQRVMCLSPRSKATVEDIIACGEHEHPSVYMVPNTTIYQSNIERSHYCIADSHCLEEYELVQNELLTALKKSTCWTGELENVIPHKQSDGIRSCRTKNTGRCNVKGEDWTVILCENDKYYYSELNKDYDKDQDIGHVCLSPRCNSIRYPISPRHITNCKWENPAGTISRIETHSLADIEQYKKAISQKLQNSLTIFKYEKTKNLPHIKPIYKYITIEGTETVEGVENAFIEAEIPALAGTSIGFKVNSRDGDHLMDIIAYIKVASYSSTYTKLYTTGPTIGINTKHDEKCTGNCPARLEHKVGWLTFAKERTSTWGCEEFGCLAVSDGCVFGSCQDIIKEELSVYRKDTEEVTNVELCLTFADKTYCTSLNAITPIITEKFEVQFKTVESYSLPRIVGIRNHEIRIGQINDLGSYSKGCGNVQRVNGTNYGSGQPKFDYLCHLASRKEVIVRKCFDNDYQACKFLQTPSSYRLEEHEGTVTIIDYKKILGTIKMKAILGDVRYKNYASAIDINAEGVCAGCINCFENIHCEFTIHTTIEASCPIESDCVSFHDRMLVTPNEHKYALKLICEDKPGSALKFKICNTKIDAAMTLVDAKPILELAPVDQTAYIREKDERCKTWMCRVRDEGIKVLLEPFKNLFGSYIGIVYSIILIIIAAIIIIYIILPICFKLRDTLKKHEDAYRKEMKIR

SEQ ID NO: 1929 - protein, 1441 aa, Artificial Sequence
  derived and/or modified protein sequence (wt) from LACV(Human/78)__NC_004109.1__GP
MICILVLITVAAASPVYQRCFQDGAIVKQNPSKEAVTEVCLKDDVSMIKTEARYVRNATGVFSNNVAIRKWLVSDWHDCRPKKIVGGHINVIEVGDDLSLHTESYVCSADCTIGVDKETAQVRLQTDTTNHFEIAGTTVKSGWFKSTTYITLDQTCEHLKVSCGPKSVQFHACFNQHMSCVRFLHRTILPGSIANSICQNIEIIILVTLTLLIFILLSILSKTYICYLLMPIFIPIAYIYGIIYNKSCKKCKLCGLVYHPFTECGTHCVCGARYDTSDRMKLHRASGLCPGYKSLRAARVMCKSKGPASILSIITAVLVLTFVTPINSMVLGESKETFELEDLPDDMLEMASRINSYYLTCILNYAVSWGLVIIGLLIGLLFKKYQHRFLNVYAMYCEECDMYHDKSGLKRHGDFTNKCRQCTCGQYEDAAGLMAHRKTYNCLVQYKAKWMMNFLIIYIFLILIKDSAIVVQAAGTDFTTCLETESINWNCTGPFLNLGNCQKQQKKEPYTNIATQLKGLKAISVLDVPIITGIPDDIAGALRYIEEKEDFHVQLTIEYAMLSKYCDYYTQFSDNSGYSQTTWRVYLRSHDFEACILYPNQHFCRCVKNGEKCSSSNWDFANEMKDYYSGKQTKFDKDLNLALTALHHAFRGTSSAYIATMLSKKSNDDLIAYTNKIKTKFPGNALLKAIIDYIAYMKSLPGMANFKYDEFWDELLYKPNPAKASNLARGKESSYNFKLAISSKSIKTCKNVKDVACLSPRSGAIYASIIACGEPNGPSVYRKPSGGVFQSSTDRSIYCLLDSHCLEEFEAIGQEELDAVKKSKCWEIEYPDVKLIQEGDGTKSCRMKDSGNCNVATNRWPVIQCENDKFYYSELQKDYDKAQDIGHYCLSPGCTTVRYPINPKHISNCNWQVSRSSIAKIDVHNIEDIEQYKKAITQKLQTSLSLFKYAKTKNLPHIKPIYKYITIEGTETAEGIESAYIESEVPALAGTSIGFKINSKEGKHLLDVIAYVKSASYSSVYTKLYSTGPTSGINTKHDELCTGPCPANINHQVGWLTFARERTSSWGCEEFGCLAVSDGCVFGSCQDIIKEELSVYRKETEEVTDVELCLTFSDKTYCTNLNPVTPIITDLFEVQFKTVETYSLPRIVAVQNHEIKIGQINDLGVYSKGCGNVQKVNGTIYGNGVPRFDYLCHLASRKEVIVRKCFDNDYQACKFLQSPASYRLEEDSGTVTIIDYKKILGTIKMKAILGDVKYKTFADSVDITAEGSCTGCINCFENIHCELTLHTTIEASCPIKSSCTVFHDRILVTPNEHKYALKMVCTEKPGNTLTIKVCNTKVEASMALVDAKPIIELAPVDQTAYIREKDERCKTWMCRVRDEGLQVILEPFKNLFGSYIGIFYTFIISIVVLLVIIYVLLPICFKLRDTLRKHEDAYKREMKIR

SEQ ID NO: 1930 - protein, 1441 aa, Artificial Sequence
  derived and/or modified protein sequence (wt) from LACV__KP271111.1__GP
MIRILVLIAVTAASPVYQRCFQDGAIVKQNPSKEAVTEVCLKDDVSMIKTEARYVRNATGVFSNNVAIRKWLVSDWHDCRPKKIIGGHINVIEVGDDLSLHTESYVCSADCSIGVDKETAQVRLQTDTTNHFEIAGTTVKSGWFKSTTYITLDQTCEHLKVSCGPKSVQFHACFNQHMSCVRFLHRTILPGSIANSICQNIEIIILVTLTLLIFILLSILSKTYICYLLMPIFIPIAYMYGIIYNKSCKKCKLCGLVYHPFTECGTHCVCGARYDTSDRMKLHRASGLCPGYKSLRAARVMCKSKGPASILSIITAVLVLTFVTPINSMVLGESKETFELEELPDDMLEMASRINSYYFTCILNYAVSWGLVIIGLLTGLLFKKYQHRFLNVYAMYCEECDMYHDKSGLKRHGDFTNKCRQCTCGQYEDAAGLMAHRKTYNCLVQYKAKWMMNFLIIYIFLILIKDSAIVVQAAGTDFTTCLETESINWNCTGPFLNLGNCQKQQKKEPYTNIATQLKGLKAISVLDIPIITGIPDDIAGALRYIEEREDFHVQLTIEYAMLSKYCDYYTQFSDNSGYSQTTWRVYLRSHDFEACILYPNQHFCRCVKNGEKCSSSNWDFANEMKDYYSGKQTKFDKDLNLALTALHHAFRGTSSAYIATMLSKKSNDDLIAYTNKIKAKFPGNALLKAIIDYIAYMKSLPGMANFKYDEFWDELLYKPNPAKASNLARGKESSYNFKLAISSKSIKTCKNVKDVACLSPRSGAIYASIIACGEPNGPSVYRKPSGGVFQSSTDRSIYCLLDSHCLEEFEAINQEELDAVKKSKCWEIEYSDVKPLQEGDGTKSCRMKDSGNCNVATNRWPVIQCENDKFYYSELQKDYDKTQDIGHYCLSPGCTTVRYPINPKHISNCNWQVSRSSIAKIDVHNIEDIEQYKKAITQKLQTSLSLFKYAKTKNLPHIKPIYKYITIEGTETAEGIESAYIESEVPALAGTSIGFKINSKEGKHLLDVIAYVKSASYSSVYAKLYSTGPTSGINTKHDELCTGPCPANINHQVGWLTFAKERTSSWGCEEFGCLAVSDGCVFGSCQDIIKEELSVYRKETEEVTDVELCLTFSDKTYCTNLNPVTPIITDLFEVQFKTVETYSLPRIVAVQNHEIKIGQINDLGVYSKGCGNVQKINGTVYGNGVPRFDYLCHLASRKEVIVRKCFDNDYQACKFLQSPASYRLEEDSGTVTIIDYKKILGTIKMKAILGDVKYKTFADSVDITAEGSCTGCINCFENIHCELTLHTTIEASCPIKSSCTVFHDRILVTPNEHKYALKMVCTEKPGNTLTIKVCNTKIEASMALVDAKPIIELAPVDQTAYIREKDERCKTWMCRVRDEGLQVILEPFKNLFGSYIGIFYTFIISIVALLVIVYVLLPICFKLRDTLRKHEDAYKREMKIR

SEQ ID NO: 1931 - protein, 1441 aa, Artificial Sequence
  derived and/or modified protein sequence (wt) from LACV__M87664.1__GP
MICILVLITVATASPVLQRCFQDGAIVKQNPSKEAFTEVCLKDDVSMIKTEARYVRNATGVFSNNVAIRKWLVSAWHDCRPKKIVGGHINVIEVGDDLSLHTESYVCSADCTIGVDKETAQVRLQTDTTNHFEIAGTTVKSGWFRSTTYITLDQTCEHLKVSCGPKSVQFHACFNQHMSCVRFLHRTILPRSIANSICQNIEIIILVTLTLLIFILLSILSKTYICYLLMPIFIPIAYIYGTIYNKSCKKCKLCGLAHHPFTECGTHCVCGARYDTSDRMKLHRASGLCPGYKSLRAARVMCKSKGPASILSIITAVLVLTFVTPINSMVLGESKETFELEDLPDDMLEMASRINSYYPTCILNYAVSWGLVIIGLLIGLLFKKYQHRFLNVYAMYCEECDMYHDKSGVKRHGDFTNKCRQCTCGQYEDAAGLMAHRKTYNCLVQYKAKWMMNFLIIYIFLILIKDSAIVVQAAGTDFTTCLETESINWNCTGPFLNLGNCQKQQKKEPYTNIATQLKGLKAISVLDIPIITGIPDDIAGALRYIEEKEDFHVQLTIEYAMLSKYCDYYTQFSDNSGYSQTTWRVYLRSHDFEACILYPNQHFCRCVKNGEKCSSSNRDFANEMKDYYSGKQTKFDKDLNLALTALHSQVMHCSSAYIATMLSKKSNDDLIAYTNKIKTKFPGNALLKAIIDYIAYMKSLPGMANFKYDEFWDELLYKPNPAKASNLARGKESSYNFKLAISSKSIKTCKNVKDVACLSPRSGAIYASIIACGEPNGPSVYRKPSGGVFQSSTDRSIYCLLDSHCLEEFEAISQEELDAVKKSKCWEIEYPDVKLIQEGDGTKSCRMKDSGNCNVATNRWPVTQCENDKFYYSDLQKDYDKTQDIGHYCLSPGCTTVRYPINPKHISNCNWQVSRSSIAEIDVHNIEDIEQYKKAITQKLQTSLSLFKYAKTKNLPHIKPIYKYITMKGTETAEGIESAYIESEVPALAGTSIGFKINSKEGKHLLDVIAYVKSASYSSVYTKLYSTGPTSGINTKHDELCTGPCPANINHQVGWLTFARERTSSWGCEEFGCLAVSDGCVFGSCQDIIKEELSVYRKETEEVTNVELCLTFSDKTYCTNLNPVTPIITDLFEVQFKTVETYSLPRIVAVQNHEIKIGQINDLGVYSKGCGNVQKVNGTIYGNGVPRFDYLCHLASRKEVIVRKCFDNDYQACKFLQSPASYRLEEDSGTVTIIDYKKILGTIKMKAILGDVKYKTFADSVDITAEGSCTGCINCFENIHCELTLHTTIEASCPIKSSCTVFHDRILVTPNEHKYALKMVCTEKPGNTLTIKVCNTKIEASMALVDAKPIIELAPVDQTAYIREKDERCKTWMCRVRDEGLQVILEPFKNLFGSYIGIFYTFIISIVALLVIIYVLLPICFKLRDTLRKHEDAYKREMKIR

SEQ ID NO: 1932 - protein, 1441 aa, Artificial Sequence
  derived and/or modified protein sequence (wt) from LACV__KP271105.1__GP
MIRILVLIAVTAASPVYQRCFQDGAIVKQNPSKEAVTEVCLKDDVSMIKTEARYVRNATGVFSNNVAIRKWLVSDWHDCRPKKIIGGHINVIEVGDDLSLHTESYVCSADCSIGVDKETAQVRLQTDTTNHFEIAGTTVKSGWFKSTTYITLDQTCEHLKVSCGPKSVQFHACFNQHMSCVRFLHRTILPGSIANSICQNIEIIILVTLTLLIFILLSILSKTYICYLLMPIFIPIAYMYGIIYNKSCKKCKLCGLVYHPFTECGTHCVCGARYDTSDRMKLHRASGLCPGYKSLRAARVMCKSKGPASILSIITAVLVLTFVTPINSMVLGESKETFELEELPDDMLEMASRINSYYFTCILNYAVSWGLVIIGLLTGLLFKKYQHRFLNVYAMYCEECDMYHDKSGLKRHGDFTNKCRQCTCGQYEDAAGLMAHRKTYNCLVQYKAKWMMNFLIIYIFLILIKDSAIVVQAAGTDFTTCLETESINWNCTGPFLNLGNCQKQQKKEPYTNIATQLKGLKAISVLDIPIITGIPDDIAGALRYIEEREDFHVQLTIEYAMLSKYCDYYTQFSDNSGYSQTTWRVYLRSHDFEACILYPNQHFCRCVKNGEKCSSSNWDFANEMKDYYSGKQTKFDKDLNLALTALHHAFRGTSSAYIATMLSKKSNDDLIAYTNKIKAKFPGNALLKAIIDYIAYMKSLPGMANFKYDEFWDELLYKPNPAKASNLARGKESSYNFKLAISSKSIKTCKNVKDVACLSPRSGAIYASIIACGEPSGPSVYRKPSGGVFQSSTDRSIYCLLDSHCLEEFEAINQEELDAVKKSKCWEIEYSDVKPLQEGDGTKSCKMKDSGNCNVATNRWPVIQCENDKFYYSELQKDYDKTQDIGHYCLSPGCTTVRYPINPKHISNCNWQVSRSSIAKIDVHNIEDIEQYKKAITQKLQTSLSLFKYAKTKNLPHIKPIYKYITIEGTETAEGIESAYIESEVPALAGTSIGFKINSKEGKHLLDVIAYVKSASYSSVYAKLYSTGPTSGINTKHDELCTGPCPANINHQVGWLTFAKERTSSWGCEEFGCLAVSDGCVFGSCQDIIKEELSVYRKETEEVTDVELCLTFSDKTYCTNLNPVTPIITDLFEVQFKTVETYSLPRIVAVQNHEIKIGQINDLGVYSKGCGNVQKVNGTVYGNGVPRFDYLCHLASRKEVIVRKCFDNDYQACKFLQSPASYRLEEDSGTVTIIDYKKILGTIKMKAILGDVKYKTFADSVDITAEGSCTGCINCFENIHCELTLHTTIEASCPIKSSCTVFHDRILVTPNEHKYALKMVCTEKPGNTLTIKVCNTKIEASMALVDAKPIIELAPVDQTAYIREKDERCKTWMCRVRDEGLQVILEPFKNLFGSYIGIFYTFIISIVALLVIVYVLLPICFKLRDTLRKHEDAYKREMKIR

SEQ ID NO: 1933 - protein, 1441 aa, Artificial Sequence
  derived and/or modified protein sequence (wt) from LACV(74-32813)__D10370.1__GP
MIRMLVLIVVTAASPVYQRCFQDGAIVKQNPSKEAVTEVCLKDDVSMIKTEARYVKNATGVFSNNVAIRKWLVSDWHDCRPKKIVGGHINVIEVGDDLSLHTESYVCSADCTIGVDKETAQVRLQTDTTNHFEIAGTTVKSGWFKSTTYITLDQTCEHLKVSCAPKSVQFHACFNQHMSCVRFLHRTILPGSIANSICQNIEIIILVTLTLLIFILLSILSKTYICYLLMPIFIPIAYMYGVIYNKSCKKCKLCGLVYHPFTECGTHCVCGARYDTSDRMKLHRASGLCPGYKSLRAARVMCKSKGPASILSIITAVLVLTFVTPINSMVLGESKETFELEELPDDMLEMALRINSYYFTCILNYAVSWGLIIAGLLVGLIFKKYQHRFLNIYAMYCEECNMYHDKSGLKRHGDFTNKCRQCTCGQYEDATGLITHRKTYNCLVQYKAKWMMNFLIIYIFLILIKDSAIVGQATGTDFTTCLETESINWNCTGPFLNLGNCQKQQKKEPYTNIATQLKGLKAISVLDIPIITSIPDDIAGALRYIEEKEDFHVQLTTEYAMLSKYCDYYTQFSDNSGYSQTTWRVYLRSHDFEACILYPNQHFCKCVKNGEKCSSSNWDFANGMKNYYSGKQAKFDKDLNLALTALHHAFRGTSSAYIAAMLSKKSNDDLIAYTNKIKAKFPGNALLKAIIDYIAYMKGLPEMANFKYDEFWDELLYKPNPAKASNLARGKESSYNFKLAISSKSIKTCKNVKDVACLSPRSGAIYSSIIACGEPNGPSVYRKPSGGVFQSSTDRSIYCLLDSHCLEEFEAISQEELDAVKKSKCWEIEYPDVRPLQESDGAKSCRMKDSGNCNVATNRWPVMQCENDKFYYSELQKDYDKTQDIGHYCLSPGCTTIRYPINPKHISNCNWQVSRSSIAKIDVHNVEDIEQYKKAITQKLQTSLSLFKYAKTKNLPHIRPIYKYITMKETETAEGIESAYIESEVPALAGTSVGFKINSKEGKHLLDVIAYVKSASYSSVYAKLYSTGPTSGINTKHDELCTGPCPANINHQVGWLTFARERTSSWGCEEFGCLAVSDGCVFGSCQDIIKEELSVYRKETEEVTNVELCLTFSDKTYCTNLNPVTPIITDLFEVQFKTVETYSLPRIVAVQNHEIKIGQINDLGVYSKGCGNVQKVNGTVYGNGVPRFDYLCHLASRKEVIVRKCFDNDYQACKFLQSPASYRLEEDSGTVTIIDYKKILGTIKMKAILGDVKYKTFADSVDITAEGSCAGCINCFQNIHCELTLHTTIEASCPIKSSCTVFHDRILVTPNEHKYALKIVCTEKPGNTLTIKVCNTRIEASMALVDAKPIIELAPVDQTAYIREKDERCKTWMCRVRDEGLQVILEPFKNLFGSYIGIFYTFIISIIALLVIIYVLLPICFKLRDTLRKHDDAYKREMKIR

SEQ ID NO: 1934 - protein, 1441 aa, Artificial Sequence
  derived and/or modified protein sequence (wt) from LACV(Craig County/VA/2009)__KP226848.1__GP
MIRILVLIAVTAASPVYQRCFQDGAIVKQNPSKEAVTEVCLKDDVSMIKTEARYVRNATGVFSNNVAIRKWLVSDWHDCRPKKIIGGHINVIEVGDDLSLHTESYVCSADCTIGVDKETAQVRLQTDTTNHFEIAGTTVKSGWFKSTTYITLDQTCEHLKVSCGPKSVQFHACFNQHMSCVRFLHRTILPGSIANSICQNIEIIILVTLTLLIFILLSILSKTYICYLLMPVFIPIACIYGIIYNKSCKKCKLCGLVYHPFTECGTHCVCGARYDTSDRMKLHRASGLCPGYKSLRAARVMCKSKGPASILSIITAVLVLTFVTPINSMVLGESKETFELEELPDDMLEMASRINSYYFTCILNYAVSWGLVIIGLLIGLLFKKYQHRFLNIYAMYCEECDMYHDKSGLKRHGDFTNKCRQCTCGQYEDAAGLMAHRKTYNCLVQYKAKWIMNFLIIYIFLILIKDSAIVVQAAGTDFTTCLETESINWNCTGPFLNLGNCQKQQKKEPYTNIATQLKGLKAISVLDIPIITGIPDDIAGALRYIEEREDFHVQLTIEYAMLSKYCDYYTQFSDNSGYSQTTWRVYLRSHDFEACILYPNQHFCRCVKNGEKCSSSNWDFANGMKDYYSGKQAKFDKDLNLALTALHHAFRGTSSAYIATMLSKKSNDDLITYTNKIKTKFPGNALLKAIIDYIAYMKSLPGMANFKYDEFWDELLYKPNPAKASNLARGKESSYNFKLAISSKSIKTCKNVKDVACLSPRSGAIYASIIACGEPNGPSVYRKPSGGVFQSSTDRSIYCLLDSHCLEEFEAISQEELDAVKKSKCWEIEYPDVKPLQESDGTKSCRMKDSGNCNVATNRWPIIQCENDKFYYSELQKDYDKTQDIGHYCLSPGCTTVRYPINPKHISNCNWQVSRSSIAKIDVHNIEDIEQYKKAITQKLQTSLSLFKYAKTKNLPHIKPIYKYITIEGTETAEGIESAYIESEVPALAGASIGFKINSKEGKHLLDVIAYVKSASYSSVYAKLYSTGPTSGINTKHDELCTGPCPANINHQVGWLTFARERTSSWGCEEFGCLAVSDGCVFGSCQDIIKEELSVYRKETEEVTDVELCLTFSDKTYCTNLNPVTPIITDLFEVQFKTVETYSLPRIVAVQNHEIKIGQINDLGVYSKGCGNVQKVNGTVYGNGVPRFDYLCHLASRKEVIVRKCFDNDYQACKFLQSPASYRLEEDSGTVTIIDYKKILGTIKMKAILGDVKYKTFADSVDITAEGSCTGCINCFENIHCELTLHTTIEASCPIKSSCTVFHDRILVTPNEHKYALKMVCTEKPGNTLTIKVCNTKIEASMALVDAKPIIELAPVDQTAYIREKDERCKTWMCRVRDEGLQVILEPFKNLFGSYIGIFYTFIISIVAILVIIYVLLPICFKLRDTLRKHEDAYKREMKIR

SEQ ID NO: 1935 - protein, 1441 aa, Artificial Sequence
  derived and/or modified protein sequence (wt) from LACV(Dallas/TX/2009)__GU591165.1__GP
MIRILVLIVVTAASPVYQRCFQDGAIVKQNPSKEAVTEVCLKDDVSMIKTEARYVKNATGVFSNNVAIRKWLVSDWHDCRPKKIVGGHINVIEVGDDLSLHTESYVCSADCTIGVDKETAQVRLQTDTTNHFEIAGTTVKSGWFKSTTYITLDQTCEHLKVSCGPKSVQFHACFNQHMSCVRFLHRTILPGSIANSICQNIEIIILVTLTLLIFILLSILSKTYICYLLMPIFIPMAYMYGVIYNKSCKKCKLCGLVYHPFTECGTHCVCGARYDTSDRMKLHRASGLCPGYKSLRAARVMCKSKGPASILSIITAVLVLTFVTPINSMVLGESKETFELEELPDDMLEMALRINSYYFTCILNYAVSWGLIIAGLLVGLIFKKYQHRFLNIYAMYCEECDMYHDKSGLKRHGDFTSKCRQCTCGQYEDATGLITHRKTYNCLVQYKAKWMMNFLIIYIFLILIKDSAIVVQATGTDFTTCLETESINWNCTGPFLNLGNCQKQQKKEPYTNIATQLKGLKAISVLDIPIITGIPDDIAGALRYIEEKEDFHVQLTTEYAMLSKYCDYYTQFSDNSGYSQTTWRVYLRSHDFEACILYPNQHFCRCVKNGEKCSSSNWDFANEMKNYYSGKQAKFDKDLNLALTALHHAFRGTSSAYIATMLSKKSNDDLVAYTNKIKAKFPGNALLKAIIDYIAYMKGLPDMANFKYDEFWDELLYKPNPAKASNLARGKESSYNFKLAVSSKSIRTCKNVKDVACLSPRSGAIYSSIIACGEPNGPSVYRKPSGGVFQSSTDRSIYCLLDSHCLEEFEAISQEELDAVKKSKCWEIEYPDIRPLQESDGSKSCRMKDSGNCNVATNRWPVMQCENDKFYYSELQKDYDKTQDIGHYCLSPGCTTIRYPINPKHISNCNWQVSRSSIAKIDVHNVEDIEQYKKAITQKLQTSLSLFKYAKTKNLPHIKPIYKYITIEGTETAEGIESAYIESEVPALAGTSIGFKINSKEGKHLLDVIAYVKSASYSSVYAKLYSTGPTSGINTKHDELCTGPCPANINHQVGWLTFARERTSSWGCEEFGCLAVSDGCVFGSCQDIIKEELSVYRKDTEEVTNVELCLTFSDKTYCTNLNPVTPIITDLFEVQFKTVETYSLPRIVAVQNHEIKIGQINDLGVYSKGCGNVQKVNGTVYGNGVPRFDYLCHLASRKEVIVRKCFDNDYQACKFLQSPASYRLEEDSGTVTIIDYKKILGTIKMKAILGDVKYKTFADSVDITAEGSCAGCINCFENIHCELTLHTTIEASCPIKSSCTVFHDRILVTPNEHKYALKMVCTEKPGNTLTIKVCNTRIEVSMALVDAKPIIELAPVDQTAYIREKDERCKTWMCRVRDEGLQVILEPFKNLFGSYIGIFYTFIISIIALLVIIYVLLPICFKLRDTLRKHDDAYKREMKIR

SEQ ID NO: 1936 - protein, 1441 aa, Artificial Sequence
  derived and/or modified protein sequence (wt) from LACV(Fort Bend County/TX/2009)__GU591168.1__GP
MIRMLVLIVVTAASPVYQRCFQDGAIVKQNPSKEAVTEVCLKDDVSMIKTEARYVKNATGVFSNNVAIRKWLVSDWHDCRPKKIVGGHINVIEVGDDLSLHTESYVCSADCTIGVDKETAQVRLQTDTTNHFEIAGTTVKSGWFKSTTYITLDQTCEHLKVSCGPKSVQFHACFNQHMSCVRFLHRTILPGSIANSICQNIEIIILVTLTLLIFILLSILSRTYICYLLMPIFIPIAYMYGVIYNKSCKKCKLCGLVYHPFTECGTHCVCGARYDTSDRMKLHRASGLCPGYKSLRAARVMCKSKGPASILSIITAVLVLTFVTPINSMVLGESKETFELEELPDDMLEMALRINSYYFTCILNYAVSWGLIIAGLLVGLIFKKYQHRFLNIYAMYCEECDMYHDKSGLKRHGDFTNKCRQCTCGQYEDAAGLMAHRKTYNCLVQYKAKWMMNFLIIYIFLILIKDSAIVVQATGTDFTTCLETESINWNCTGPFLNLGNCQKQQKKEPYTNIATQLKGLKAISVLDIPIITGIPDDIAGALRYIEEKEDFHIQLTTEYAMLSKYCDYYTQFSDNSGYSQTTWRVYLRSHDFEACILYPNQHFCRCVKNGEKCSSSNWDFANEMKNYYSGKQAKFDKDLNLALTALHHAFRGTSSAYIATMLSKKSNDDLIAYTNKIKAKFPGNALLKAIIDYIAYMKGLPDMANFKYDEFWDELLYKPNPAKASNLARGKESSYNFKLAISSKSIKTCKNVKDVACLSPRSGAIYSSIIACGEPNGPSVYRKPSGGVFQSSTDRSIYCLLDSHCLEEFEAISQEELDAVKKSKCWEIEYPDVRPLQESDGAKSCRMKDSGNCNVATNRWPVMQCENDKFYYSELQKDYDKTQDIGHYCLSPGCTTIRYPINPKHISNCNWQVSRSSIAKIDVHNVEDIEQYKKAITQKLQTSLSLFKYAKTKNLPHIKPIYKYITIEGTETAEGIESAYIESEVPALAGTSIGFKINSKEGKHLLDVIAYVKSASYSSVYAKLYSTGPTSGINTKHDELCTGPCPANINHQVGWLTFARERTSSWGCEEFGCLAVSDGCVFGSCQDIIKEELSVYRKETEEVTNVELCLTFSDKTYCTSLNPVTPIITDLFEVQFKTVETYSLPRIVAVQNHEIKIGQINDLGVYSKGCGNVQKVNGTVYGNGVPRFDYLCHLASRKEVIVRKCFDNDYQACKFLQSPASYRLEEDSGTVTIIDYKKILGTIKMKAILGDVKYKTFADSVDITAEGSCAGCINCFENIHCELTLHTTIEASCPIKSSCTVFHDRILVTPNEHKYALKMVCTEKPGNTLTIKVCNTRIEASMALVDAKPIIELAPVDQTAYIREKDERCKTWMCRVRDEGLQVILEPFKNLFGSYIGIFYTFIISIIALLVIIYVLLPICFKLRDTLRKHDDAYKREMKIR

SEQ ID NO: 1937 - protein, 1441 aa, Artificial Sequence
  derived and/or modified protein sequence (wt) from LACV(LAC22988-89)__U18980.1__GP
MICILVLITVAAASPVYQRCFQDGAIVKQNPSKEAVTEVCLKDDVSMIKTEARYVRNATGVFSNNVAIRKWLVSDWHDCRPKKIVGGHINVIEVGDDLSLHTESYVCSADCTIGVDKETAQVRLQTDTTNHFEIAGTTVKSGWFKSTTYITLDQTCEHLKVSCGPKSVQFHACFNQHMSCVRFLHRTILPGSIANSICQNIEIIILVTLTLLIFILLSILSKTYICYLLMPIFIPIAYIYGIIYNKSCKKCKLCGLVYHPFTECGTHCVCGARYDTSDRMKLHRASGLCPGYKSLRAARVMCKSKGPASILSIITAVLVLTFVTPINSMVLGESKETFELEDLPDDMLEMASRINSYYLTCILNYAVSWGLVIIGLLIGLLFKKYQHRFLNVYAMYCEECDMYHDKSGLKRHGDFTNKCRQCTCGQYEDAAGLMAHRKTYNCLVQYKAKWMMNFLIIYIFLILIKDSAIVVQAAGTDFTTCLETESINWNCTGPFLNLGNCQKQQKKEPYTNIATQLKGLKAISVLDVPIITGIPDDIAGALRYIEEKEDFHVQLTIEYAMLSKYCDYYTQFSDNSGYSQTTWRVYLRSHNFEACILYPNQHFCRCVKNGEKCSSSNWDFANEMKDYYSGKQTKFDKDLNLALTALHHAFRGTSSAYIATMLSKKSNDDLIAYTNKIKTKFPGNALLKAIIDYIAYMKSLPGMANFKYDEFWDELLYKPNPAKASNLARGKESSYNFKLAISSKSIKICKNVKDVACLSPRSGAIYASIIACGEPNGPSVYRKPSGGVFQSSTDRSIYCLLDSHCLEEFEAIGQEELDAVKKSKCWEIEYPDVKLIQEGDGTKSCRMKDSGNCNVATNRWPVIQCENDKFYYSELQKDYDKAQDIGHYCLSPGCTTVRYPINPKHISNCNWQVSRSSIAKIDVHNIEDIEQYKKAITQKLQTSLSLFKYAKTKNLPHIKPIYKYITIEGTETAEGIESAYIESEVPALAGTSIGFKINSKEGKHLLDVIAYVKSASYSSVYTKLYSTGPTSGINTKHDELCTGPCPANINHQVGWLTFARERTSSWGCEEFGCLAVSDGCVFGSCQDIIKEELSVYRKETEEVTDVELCLTFSDKTYCTNLNPVTPIITDLFEVQFKTVETYSLPRIVAVQNHEIKIGQINDLGVYSKGCGNVQKVNGTIYGNGVPRFDYLCHLASRKEVIVRKCFDNDYQACKFLQSPASYRLEEDSGTVTIIDYKKILGTIKMKAILGDVKYKTFADSVDITAEGSCTGCINCFENIHCELTLHTTIEASCPIKSSCTVFHDRILVTPNEHKYALKMVCTEKPGNTLTIKVCNTKVEASMALVDAKPIIELAPVDQTAYIREKDERCKTWMCRVRDEGLQVILEPFKNLFGSYIGIFYTFIISIVVLLVIIYVLLPICFKLRDTLRKHEDAYKREMKIR

SEQ ID NO: 1938 - protein, 1441 aa, Artificial Sequence
  derived and/or modified protein sequence (wt) from LACV(LAC30928-31)__U18979.1__GP
MICILVLITVAAASPVYQRCFQDGAIVKQNPSKEAVTEVCLKDDVSMIKTEARYVRNATGVFSNNVAIRKWLVSDWHDCRPKKIVGGHINVIEVGDDLSLHTESYVCSADCTIGVDKETAQVRLQTDTTNHFEIAGTTVKSGWFKSTTYITLDQTCEHLKVSCGPKSVQFHACFNQHMSCVRFLHRTILPGSIANSICQNIEIIILVTLTLLIFILLSILSKTYICYLLMPIFIPIAYIYGTIYNKSCKKCKLCGLVYHPFTECGTHCVCGARYDTSDRMKLHRASGLCPGYKSLRAARVMCKSKGPASILSIITAVLVLTFVTPINSMVLGESKETFELEDLPDDMLEMASRINSYYLTCILNYAVSWGLVIIGLLIGLLFKKYQHRFLNVYAMYCEECDMYHDKSGLKRHGDFTNKCRQCTCGQYEDAAGLMAHRKTYNCLVQYKAKWMMNFLIIYIFLILIKDSAIVVQAAGTDFTTCLETESINWNCTGPFLNLGNCQKQQKKEPYTNIATQLKGLKAISVLDVPIITGIPDDIAGALRYIEEKEDFHVQLTIEYAMLSKYCDYYTQFSDNSGYSQTTWRVYLRSHDFEACILYPNQHFCRCVKNGEKCSSSNRDFANEMKDYYSGKQTKFDKDLNLALTALHHAFRGTSSAYIATMLSKKSNDDLIAYTNKIKTKFPGNALLKAIIDYIAYMKSLPGMANFKYDEFWDELLYKPNPAKASNLARGKESSYNFKLAISSKSIKICKNVKDVACLSPRSGAIYASIIACGEPNGPSVYRKPSGGVFQSSTDPSIYCLLDSHCLEEFEAIGQEELDAVKKSKCWEIEYPDVKLIQEGDGTKSCRMKDSGNCNVATNRWPVIQCENDKFYYSELQKDYDKTQDIGHYCLSPGCTTVRYPINPKHISNCNWQVSRSSIAKIDVHNIEDIEQYKKAITQKLQTSLSLFKYAKTKNLPHIKPIYKYITIEGTETAEGIESAYIESEVPALAGTSIGFKINSKEGKHLLDVIAYVKSASYSSVYTKLYSTGPTSGINTKHDELCTGPCPANINHQVGWLTFARERTSSWGCEEFGCLAVSDGCVFGSCQDIIKEELSVYRKETEEVTDVELCLTFSDKTYCTNLNPVTPIITDLFEVQFKTVETYSLPRIVAVQNHEIKIGQINDLGVYSKGCGNVQKVNGTIYGNGVPRFDYLCHLASRKEVIVRKCFDNDYQACKFLQSPASYRLEEDSGTVTIIDYKKILGTIKMKAILGDVKYKTFADSVDITAEGSCTGCINCFENIHCELTLHTTIEASCPIKSSCTVFHDRILVTPNEHKYALKMVCTEKPGNTLTIKVCNTKIEASMALVDAKPIIELAPVDQTAYIREKDERCKTWMCRVRDEGLQVILEPFKNLFGSYIGIFYTFIISIVALLVIIYVLLPICFKLRDTLRKHEDAYKREMKIR

SEQ ID NO: 1939 - protein, 1441 aa, Artificial Sequence
  derived and/or modified protein sequence (wt) from LACV(LAC76-40)__U70206.1__GP
MICILVLITVAAASPVYQRCFQDGAIVKQNPSKEAVTEVCLKDDVSMIKTEARYVRNATGVFSNNVAIRKWLVSDWHDCRPKKIVGGHINVIEVGDDLSLHTESYVCSADCTIGVDKETAQVRLQTDTTNHFEIAGTTVKSGWFKSTTYITLDQTCEHLKVSCGPKSVQFHACFNQHMSCVRFLHRTILPGSIANSICQNIEIIILVTLTLLIFILLSILSKTYICYLLMPIFIPIAYIYGIIYNKSCKKCKLCGLVYHPFTECGTHCVCGARYDTSDRMKLHRASGLCPGYKSLRAARVMCKSKGPASILSIITAVLVLTFVTPINSMVLGESKETFELEDLPDDMLEMASRINSYYLTCILNYAVSWGLVIIGLLIGLLFKKYQHRFLNVYAMYCEECDMYHDKSGLKRHGDFTNKCRQCTCGQYEDAAGLMAHRKTYNCLVQYKAKWMMNFLIIYIFLILIKDSAIVVQAAGTDFTTCLETESINWNCTGPFLNLGNCQKQQKKEPYTNIATQLKGLKAISVLDVPIITGIPDDIAGALRYIEEKEDFHVQLTIEYAMLSKYCDYYTQFSDNSGYSQTTWRVYLRSHDFEACILYPNQHFCRCVKNGEKCSSSNWDFANEMKDYYSGKQTKFDKDLNLALTALHHAFRGTSSAYIATMLSKKSNDDLIAYTNKIKTKFPGNALLKAIIDYIAYMKSLPGMANFKYDEFWDELLYKPNPAKASNLARGKESSYNFKLAISSKSIKTCKDVKDVACLSPRSGAIYASIIACGEPNGPSVYRKPSGGVFQSSTDRSIYCLLDSHCLEEFEAIGQEELDAVKKSKCWEIEYPDVKLIQEGDGTKSCRMKDSGNCNVATNRWPVIQCENDKFYYSELQKDYDKTQDIGHYCLSPGCTTVRYPINPKHISNCNWQVSRSSIAKIDVHNIEDIEQYKKAITQKLQTSLSLFKYAKTKNLPHIKPIYKYITIEGTETAEGIESAYIESEVPALAGTSIGFKINSKEGKHLLDVIAYVKSASYSSVYAKLYSTGPTSGINTKHDELCTGPCPANINHQVGWLTFARERTSSWGCEEFGCLAVSDGCVFGSCQDIIKEELSVYRKETEEVTDVELCLTFSDKTYCTNLNPVTPIITDLFEVQFKTVETYSLPRIVAVQNHEIKIGQINDLGVYSKGCGNVQKVNGTIYGNGVPRFDYLCHLASRKEVIVRKCFDNDYQACKFLQSPASYRLEEDSGTVTIIDYKKILGTIKMKAILGDVKYKTFADSVDITAEGSCTGCINCFENIHCELTLHTTIEASCPIKSSCTVFHDRILVTPNEHKYALKMVCTEKPGNTLTIKVCNTKIEASMALVDAKPIIELAPVDQTAYIREKDERCKTWMCRVRDEGLQVILEPFKNLFGSYIGIFYTFIISIVALLVIIYVLLPICFKLRDTLRKHEDAYKREMKIR

SEQ ID NO: 1940 - protein, 1441 aa, Artificial Sequence
  derived and/or modified protein sequence (wt) from LACV(LAC79-283)__U70207.1__GP
MIRILVLIAVTAASPVYQRCFQDGAIVKQNPSKEAVTEVCLKDDVSMIKTEARYIRNATGVFSNNVAIRKWLVSDWHDCRPKRIIGGHINVIEVGDDLSLHTESYVCSADCTIGVDKETAQVRLQTDTTNHFEIAGTTVKSGWFKSTTYITLDQTCEHLKVSCGPKSVQFHACFNQHMSCVRFLHRTILPGSIANSICQNIEIIILVTLTLLIFILLSILSKTYICYLLMPIFIPIAYIYGIIYNKSCKKCKLCGLVYHPFTECGTHCVCGARYDTSDRMKLHRASGLCPGYKSLRAARVMCKSKGPASILSIITAVLVLTFVTPINSMVLGESKETFELEELPDDMLGMASRINSYYFTCILNYAVSWGLVIIGLLTGLLFKKYQHRFLNVYAMYCEECDMYHDKSGLKRHGDFTNKCRQCTCGQYEDATGLMAHRKTYNCLVQYKAKWMMNFLVIYIFLILIKDSAIVVQAAGTDFTTCLETESINWNCTGPFLNLGNCQKQQKKEPYTNIATQLKGLKAISVLDIPIITGIPDDIAGALRYIEEREDFHVQLTIEYAMLSKYCDYYTQFSDNSGYSQTTWRVYLRSHDFEACILYPNQHFCRCVKNGEKCSSSNWDFANEMKDFYSGKQTKFDKDLNLALTALHHAFRGTSSAYIATMLSKKSNDDLIAYTNKIKTKFPGNALLKAIIDYIAYMKSLPGMANFKHDEFWDELLYKPNPAKASNLARGKESSYNFKLAISSKSIKTCKNVKDVACLSPRSGAIYASIIACGEPNGPSVYRKPSGGVFQSSTDRSIYCLLDSHCLEEFEAISQEELDAVKKSKCWEIEYPDVKPLQEGDGTKSCRMKDSGNCNVATNRWPVIQCENDKFYYSELQKDYDKTQDIGHYCLSPGCTTVRYPINPKHISNCNWQVSRSSIAKIDVHNIEDIEQYKKAITQKLQTSLSLFKYAKTKNLPHIKPIYKYITIEGTETAEGIESAYIESEVPALAGTSIGFKINSKEGKHLLDVIAYVKSASYSSVYAKLYSTGPTSGINTKHDELCTGPCPANINHQVGWLTFARERTSSWGCEEFGCLAVSDGCVFGSCQDIIKEELSVYRKETEEVTDVELCLTFSDKTYCTNLNPVTPIITDLFEVQFNTVETYSLPRIVAVQNHEIKIGQINDLGVYSKGCGNVQKVNGTVYGNGVPRFDYLCHLASRKEVIVRKCFDNDYQACKFLQSPASYRLEEDSGTVTIIDYKKILGTIKMKAILGDVKYKTFADSVDITAEGSCTGCINCFENIHCELTLHTTIEASCPIKSSCTVFHDRILVTPNEPQYALKMVCTERPGNTLTIKVCNTKIEASMALVDAKPIIELAPVDQTAYIREKDERCKTWMCRVRDEGLQVILEPFKNLFGSYIGIFYTFIISMVALLVIIYVLLPICFKLRDTLRKHEDAYKREMKIR

SEQ ID NO: 1941 - protein, 1441 aa, Artificial Sequence
  derived and/or modified protein sequence (wt) from LACV(LAC81-4)__U70208.1__GP
MIRILVLIAVTAASPVYQRCFQDGAIVKQNPSKEAVTEVCLKDDVSMIKTEARYIRNATGVFSNNVAIRKWLVSDWHDCRPKKIIGGHINVIEVGDDLSLHTESYVCSADCTIGVDKETAQVRLQTDTTNHFEIAGTTVKSGWFKSTTYITLDQTCEHLKVSCGPKSVQFHACFNQHMSCVRFLHRTILPGSIANSICQNIEIIILVTLTLLIFILLSILSKTYICYLLMPIFIPIAYVYGIIYNKSCKKCKLCGLVYHPFTECGTHCVCGARYDTSDRMKLHRASGLCPGYKSLRAARVMCKSKGPASILSIITAVLVLTFVTPINSMVLGESKETFELEELPDDMLGMASRINSYYFTCILNYAVSWGLVIIGLLTGLLFKKYQHRFLNVYAMYCEECDMYHDKSGLKRHGDFTNKCRQCTCGQYEDATGLMAHRKTYNCLVQYKAKWMMNFLVIYIFLILIKDSAIVVQAAGTDFTTCLETESINWNCTGPFLNLGNCQKQQKKEPYTNIATQLKGLKAISVLDIPIITGIPDDIAGALRYIEEREDFHVQLTIEYAMLSKYCDYYTQFSDNSGYSQTTWRVYLRSHDFEACILYPNQHFCRCVKNGEKCSSSNWDFANEMKDFYSGKQTKFDKDLNLALTALHHAFRGTSSAYIATMLSKKSNDDLIAYTNKIKTKFPGNALLKAIIDYIAYMKSLPGMANFKHDEFWDELLYKPNPAKASNLARGKESSYNFKLAISSKSIKTCKNVKDVACLSPRSGAIYASIIACGEPNGPSVYRKPSGGVFQSSTDRSIYCLLDSHCLEEFEAISQEELDAVKKSKCWEIEYPDVKPLQEGDGTKSCRMKDSGNCNVATNRWPVIQCENDKFYYSELQKDYDKTQDIGHYCLSPGCTTVRYPINPKHISNCNWQVSRSSIAKIDVHNIEDIEQYKKAITQKLQTSLSLFKYAKTKNLPHIKPIYKYITIEGTETAEGIESAYIESEVPALAGTSIGFKINSKEGKHLLDVIAYVKSASYSSVYAKLYSTGPTSGINTKHDELCTGPCPANINHQVGWLTFARERTSSWGCEEFGCLAVSDGCVFGSCQDIIKEELSVYRKETEEVTDVELCLTFSDKTYCTNLNPVTPIITDLFEVQFKTVETYSLPRIVAVQNHEIKIGQINDLGVYSKGCGNVQKVNGTVYGNGVPRFDYLCHLASRKEVIVRKCFDNDYQACKFLQSPASYRLEEDSGTVTIIDYKKILGTIKMKAILGDVKYKTFADSVDITAEGSCTGCINCFENIHCELTLHTTIEASCPIKSSCTVFHDRILVTPNEPQYALKMVCTERPGNTLTIKVCNTKIEASMALVDAKPIIELAPVDQTAYIREKDERCKTWMCRVRDEGLQVILEPFKNLFGSYIGIFYTFIISMVALLVIIYVLLPICFKLRDTLRKHEDAYKREMKIR

SEQ ID NO: 1942 - protein, 1441 aa, Artificial Sequence
  derived and/or modified protein sequence (wt) from LACV(LACR56869)__U70205.1__GP
MICILVLITVAAASPVYQRCFQDGAIVKQNPSKEAVTEVCLKDDVSMIKTEARYVRNATGVFSNNVAIRKWLVSDWHDCRPKKIVGGHINVIEVGDDLSLHTESYVCSADCTIGVDKETAQVRLQTDTTNHFEIAGTTVKSGWFKSTTYITLDQTCEHLKVSCGPKSVQFHACFNQHMSCVRFLHRTILPGSIANSICQNIEIIILVTLTLLIFILLSILSKTYICYLLMPIFIPIAYIYGIIYNKSCKKCKLCGLVYHPFTECGTHCVCGARYDTSDRMKLHRASGLCPGYKSLRAARVMCKSKGPASILSIITAVLVLTFVTPINSMVLGESKETFELEDLPDDMLEMASRINSYYLTCILNYAVSWGLVIIGLLIGLLFKKYQHRFLNIYAMYCEECDMYHDKSGLKRHGDFTNKCRQCTCGQYEDAAGLMAHRKTYNCLVQYKAKWMMNFLIIYIFLILIKDSAIVVQAAGTDFTTCLETESINWNCTGPFLNLGNCQKQQKKEPYTNIATQLKGLKAISVLDVPIITGIPDDIAGALRYIEEKEDFHVQLTIEYAMLSKYCDYYTQFSDNSGYSQTTWRVYLRSHDFEACILYPNQHFCRCVKNGEKCSSSNWDFANEMKDYYSGKQTKFDKDLNLALTALHHAFRGTSSAYMATMLSKKSNDDLIAYTNKIKTKFPGNALLKAIIDYIAYMKSLPGMANFKYDEFWDELLYKPNPAKASNLARGKESSYNFKLAISSKSIKTCKNVKDVACLSPRSGAIYASIIACGEPNGPSVYRKPSGGVFQSSTDRSIYCLLDSHCLEEFEAIGQEELDAVKKSKCWEIEYPDVKLIQEGDGTKSCRMKDSGNCNVATNRWPVIQCENDKFYYSELQKDYDKTQDIGHYCLSPGCTTVRYPINPKHISNCNWQVSRSSIAKIDVHNIEDIEQYKKAITQKLQTSLSLFKYAKTKNLPHIKPIYKYITIEGTETAEGIESAYIESEVPALAGTSIGFKINSKEGKHLLDVIAYVKSASYSSVYTKLYSTGPTSGINTKHDELCTGPCPANINHQDGWLTFARERTSSWGCEEFGCLAVSDGCVFGSCQDIIKEELSVYRKETEEVTDVELCLTFSDKTYCTNLNPVTPIITDLFEVQFKTVETYSLPRIVAVQNHEIKIGQINDLGVYSKGCGNVQKVNGTIYGNGVPRFDYLCHLASRKEVIVRKCFDNDYQACKFLQSPASYRLEEDSGTVTIIDYKKILGTIKMKAILGDVKYKTFADSVDITAEGSCTGCINCFENIHCELTLHTTIEASCPIKSSCTVFHDRILVTPNEHKYALKMVCTEKPGNTLTIEVCNTKIEASMALVDAKPIIELAPVDQTTYIREKDERCKTWMCRVRDEGLQVILEPFKNLFGSYIGIFYTFIISIVALLVIIYVLLPICFKLRDTLRKHEDAYKREMKIR

SEQ ID NO: 1943 - protein, 1441 aa, Artificial Sequence
  derived and/or modified protein sequence (wt) from LACV(NAT_Crawford_WI_2007)__GU596383.1__GP
MIRILVLIAVTAASPVYQRCFQDGAIVKQNPSKEAVTEVCLKDDVSMIKTEARYVRNATGVFSNNVAIRKWLVSDWHDCRPKKIIGGHINVIEVGDDLSLHTESYVCSADCTIGVDKETAQVRLQTDTTNHFEIAGTTVKSGWFKSTTYITLDQTCEHLKVSCGPKSVQFHACFNQHMSCVRFLHRTILPGSIANSICQNIEIIILVTLTLLIFILLSILSKTYICYLLMPIFIPIAYVYGIIYNKSCKKCKLCGLVYHPFTECGTHCVCGARYDTSDRMKLHRASGLCPGYKSLRAARVMCKSKGPASILSIITAVLVLTFVTPINSMVLGESKETFELEELPDDMLEMASRINSYYFTCILNYAVSWGLVIIGLLTGLLFKKYQHRFLNVYAMYCEECDMYHDKSGLKRHGDFTNKCRQCTCGQYEDATGLMAHRKTYNCLVQYKAKWMMNFLIIYIFLILIKDSAIVVQAAGTDFTTCLETESINWNCTGPFLNLGNCQKQQKKEPYTNIATQLKGLKAISVLDIPIITGIPDDIAGALRYIEEREDFHVQLTIEYAMLSKYCDYYTQFSDNSGYSQATWRVYLRSHDFEACILYPNQHFCRCVKNGEKCSSSNWDFANEMKDFYSGKQTKFDKDLNLALTALHHAFRGTSSAYIATMLSKKSNDDLIAYTNKIKTKFPGNALLKAIIDYIAYMKSLPGMANFKYDEFWDELLYKPNPAKASNLARGKESSYNFKLAISSKSIKTCKNVKDVACLSPRSGAIYASIIACGEPNGPSVYRKPSGGVFQSSTDRSIYCLLDSHCLEEFEAISQEELDAVKKSKCWEIEYPDVKPLQESDGTKSCRMKDSGNCNVATNRWPVIQCENDKFYYSELQKDYDKTQDIGHYCLSPGCTTVRYPINPKHISNCNWQVSRSSIAKIDVHNIEDIEQYKKAITQKLQTSLSLFKYAKTKNLPHIKPIYKYITIEGTETAEGIESAYIESEVPALAGTSIGFKINSKEGKHLLDVIAYVKSASYSSVYAKLYSTGPTSGINTKHDELCTGPCPANINHQVGWLTFARERTSSWGCEEFGCLAVSDGCVFGSCQDIIKEELSVYRKETEEVTDVELCLTFSDKTYCTNLNPVTPIITDLFEVQFKTVETYSLPRIVAVQNHEIKIGQINDLGVYSKGCGNVQKVNGTVYGNGVPRFDYLCHLASRKEVIVRKCFDNDYQACKFLQSPASYRLEEDSGTVTIIDYKKILGTIKMKAILGDVKYKTFADSVDITAEGSCTGCINCFENIHCELTLHTTIEASCPIKSSCTVFHDRILVTPNEHKYALKMVCTERPGNTLTIKVCNTKIEASMALVDAKPIIELAPVDQTAYIREKDERCKTWMCRVRDEGLQVILEPFKNLFGSYIGIFYTFIISIVALLVIIYVLLPICFKLRDTLRKHEDAYKREMKIR

SEQ ID NO: 1944 - protein, 1441 aa, Artificial Sequence
  derived and/or modified protein sequence (wt) from LACV(77)__DQ196119.1__GP
MICILVLITVAAASPVYQRCFQDGAIVKQNPSKEAVTEVCLKDDVSMIKTEARYVRNATGVFSNNVAIRKWLVSDWHDCRPKKIVGGHINVIEVGDDLSLHTESYVCSADCTIGVDKETAQVRLQTDTTNHFEIAGTTVKSGWFESTTYITLDQTCEHLKVSCGPKSVQFHACFNQHMSCVRFLHRTILPGSIANSICQNIEIIILVTLTLLIFILLSILSKTYICYLLMPIFIPIAYIYGTIYNKSCKKCKLCGLVYHPFTECGTHCICGARYDTSDRMKLHRASGLCPGYKSLRAARVMCKSKGPASILSIITAVLVLTFVTPINSMVLGESKETFELEDLPDDMLEMASRINSYYLTCILNYAVSWGLVIIGLLIGLLFKKYQHRFLNVYAMYCEECDMYHDKSGLKRHGDFTNKCRQCTCGQYEDAAGLMAHRKTYNCLVQYKAKWMMNFLIIYIFLILIKDSAIVVQAAGTDFTTCLETESINWNCTGPFLNLGNCQKQQKKEPYTNIATQLKGLKAISVLDVPIITGIPDDIAGALRYIEEKEDFHVQLTIEYAMLSKYCDYYTQFSDNSGYSQTTWRVYLRSHDFEACILYPNQHFCRCVKNGEKCSSSNRDFANEMKDYYSGKQTKFDKDLNLALTALHHAFRGTSSAYIATMLSKKSNDDLIAYTNKIKTKFPGNALLKAIIDYIAYMKSLPGMANFKYDEFWDELLYKPNPAKASNLARGKESSYNFKLAISSKSIKTCKNVKDVACLSPRSGAIYASIIACGEPNGPSVYRKPSGGVFQSSTDQSIYCLLDSHCLEEFEAIGQEELDAVKKSKCWEIEYPDVKLIQEGDGTKSCRMKDSGNCNVATNRWPVIQCENDKFYYSELQKDYDKTQDIGHYCLSPGCTTVRYPINPKHISNCNWQVSRSSIAKIDVHNIEDIEQYKKAITQKLQTSLSLFKYAKTKNLPHIKPIYKYITIEGTETAEGIESAYIESEVPALAGTSIGFKINSKEGKHLLDVIAYVKSASYSSVYTKLYSTGPTSGINTKHDELCTGPCPANINHQVGWLTFARERTSSWGCEEFGCLAVSDGCVFGSCQDIIKEELSVYRKETEEVTDVELCLTFSDKTYCTNLNPVTPIITDLFEVQFKTVEAYSLPRIVAVQNHEIKIGQINDLGVYSKGCGNVQKVNGTIYGNGVPRFDYLCHLASRKEVIVRKCFDNDYQACKFLQSPASYRLEEDSGTVTIIDYKKILGTIKMKAILGDVKYKTFADSVDITAEGSCTGCINCFENIHCELTLHTTIEASCPIKSSCTVFHDRILVTPNEHKYALKMVCTEKPGNTLTIKVCNTKIEASMALVDAKPIIELAPVDQTAYIREKDERCKTWMCRVRDEGLQVILEPFKNLFGSYIGIFYTFIISIVALLVIIYVLLPICFKLRDTLRKHEDAYKREMKIR

SEQ ID NO: 1945 - protein, 1441 aa, Artificial Sequence
  derived and/or modified protein sequence (wt) from LACV(LACV/00/NC-M (NC00-283))__GU206112.1__GP
MIRILVLIAVTAASPVYQRCFQDGAIVKQNPSKEAVTEVCLKDDVSMIKTEARYVRNATGVFSNNVAIRKWLVSDWHDCRPKKIIGGHINVIEVGDDLSLHTESYVCSADCTIGVDKETAQVRLQTDTTNHFEIAGTTVKSGWFKSTTYITLDQTCEHLKVSCGPKSVQFHACFNQHMSCVRFLHRTILPGSIANSICQNIEIIILVTLTLLIFILLSILSKTYICYLLMPIFIPIAYMYGIIYNKSCKKCKLCGLVYHPFTECGTHCVCGARYDTSDRMKLHRASGLCPGYKSLRAARVMCKSKGPASILSIITAVLVLTFVTPINSMVLGESKETFELEELPDDMLEMASRINSYYFTCILNYAVSWGLVIIGLLTGLLFKKYQHRFLNVYAMYCEECDMYHDKSGLKRHGDFTNKCRQCTCGQYEDAAGLMAHRKTYNCLVQYKAKWMMNFLIIYIFLILIKDSAIVVQAAGTDFTTCLETESINWNCTGPFLNLGNCQKQQKKEPYTNIATQLKGLKAISVLDIPIITGIPDDIAGALKYIEEREDFHVQLTIEYAMLSKYCDYYTQFSDNSGYSQTTWRVYLRSHDFEACILYPNQHFCRCVKNGEKCSSSNWDFANEMKDYYSGKQTKFDKDLNLALTALHHAFRGTSSAYIATMLSKKSNDDLIAYTNKIKTKFPGNALLKAIIDYIAYMKSLPGMTNFKYDKFWDELLYKPNPAKASNLARGKESSYNFKLAISSKSIKTCKNVKDVACLSPRSGAIYASIIACGEPNGPSVYRKPSGGVFQSSTDRSIYCLLDSHCLEEFEAINQEELDAVKKSKCWEIEYSDVKPLQEGDGTKSCRMKDSGNCNVATNRWPVIQCENDKFYYSELQKDYDKTQDIGHYCLSPGCTTVRYPINPKHISNCNWQVSRSSIAKIDVHNIEDIEQYKKAITQKLQTSLSLFKYAKTKNLPHIKPIYKYITIEGTETAEGIESAYIESEVPALAGTSIGFKINSKEGKHLLDVIAYVKSASYSSVYAKLYSTGPTSGINTKHDELCTGPCPANINHQVGWLTFAKERTSSWGCEEFGCLAVSDGCVFGSCQDIIKEELSVYRKETEEVTDVELCLTFSDKTYCTNLNPVTPIITDLFEVQFKTVETYSLPRIVAVQNHEIKIGQINDLGVYSKGCGNVQKVNGTVYGNGVPRFDYLCHLASRKEVIVRKCFDNDYQACKFLQSPASYRLEEDSGTVTIIDYKKILGTIKMKAILGDVKYKTFADNVDITAEGSCTGCINCFENIHCELTLHTTIEASCPIKSSCTVFHDRILVTPSEHKYALKMVCTEKPGNTLTIKVCNTKIEASMALVDAKPIIELAPVDQTAYIREKDERCKTWMCRVRDEGLQVILEPFKNLFGSYIGIFYTFIISIMALLVIIYVLLPICFKLRDTLRKHEDAYKREMKIR

SEQ ID NO: 1946 - protein, 1441 aa, Artificial Sequence
  derived and/or modified protein sequence (wt) from LACV(LACV/00/WV-M (WV00-3178))__GU206148.1__GP
MIRILVLIAITAASPVYQRCFQDGAIVKQNPSKEAVTEVCLKDDVSMIKTEARYVRNATGVFSNNVAIRKWLVSDWHDCRPKKIIGGHINVIEVGDDLSLHTESYVCSSDCTIGVDKETAQVRLQTDTTNHFEIAGTTVKSGWFKSTTYITLDQTCEHLKVSCGPKSVQFHACFNQHMSCVRFLHRTILPGSIANSICQNIEIIILVTLTLLIFILLSILSKTYICYLLMPIFIPIAYIYGIIYNKSCKKCKLCGLVYHPFTECGTHCVCGARYDTSDRMKLHRASGLCPGYKSLRAARVMCKSKGPASILSIITAVLVLTFVTPINSMVLGESKETFELEELPDDMLEMASRINSYYLTCILNYAVSWGLVIIGLLTGLLFKKYQHRFLNTYAMYCEECDMYHDKSGLKRHGDFTNKCRQCTCGQYEDAAGLMTHRKTYNCLVQYKAKWMMNFLIIYIFLILIKDSAIIVQAAGTDFTTCLETESINWNCTGPFLNLGNCQKQQKKEPYTNIATQLKGLKAISVLDIPIITGIPDDIAGALRYIEEREDFHVQLTTEYAMLSRYCDYYTQFSDNSRYSQTTWRVYLRSHDFEACILYPNQHFCRCVKNGEKCSSSNWDFANEMKDYYSGKQTKFDKDLNLALTALHHAFRGTSSAYIATMLSKKSNDDLITYTNKIKTKFPGNALLKAIIDYIAYMKSLPGMANFKYDEFWDELLYKPNPAKTSNLARGKESTYNFKLAISSKSIKTCKNVKDVACLSPRSGAIYASIIACGEPNGPSVYRKPSGGVFQSSTDRSIYCLLDSHCLEEFEAISQEELDAVKKSKCWETEYPEVKPLQESDGTKSCRMKDSGNCNVATNRWPVIQCENDKFYYSELQKDYDKTQDIGHYCLSPGCTTVRYPINPKHISNCNWQVSRSSIAKIDVHNIEDIEQYKKAITQKLQTSLSLFKYAKTKNLPHIKPIYKYITIEGTETAEGIESAYIESEVPALAGTSIGFKINSKEGKHLLDVIAYVKSASYSSVYAKLYSTGPTSGINTKHDELCTGPCPANINHQIGWLTFAKERTSSWGCEEFGCLAVSDGCVFGSCQDIIKEELSVYRKETEEVTDVELCLTFSDKTYCTNLNPVTPIITDLFEVQFKTVETYSLPRIVAVQNHEIKIGQINDLGVYSKGCGNVQKVNGTVYGNGVPRFDYLCHLASRKEVIVRKCFDNDYQACKFLQSPASYRLEEDSGTVTIIDYKKILGTIKMKAILGDVKYKTFAESVDITAEGSCTGCINCFENIHCELTLHTTIEASCPIKSSCTVFHDRILVTPNEHKYALKMVCTERPGNTLTIKVCNTKIEASMTLVDAKPIIELAPVDQTAYIREKDERCKTWMCRVRDEGLQVILEPFKNLFGSYIGIFYTFIISIVALLVIIYVLLPICFKLRDTLRKHEDAYKREMKIR

SEQ ID NO: 1947 - protein, 1441 aa, Artificial Sequence
  derived and/or modified protein sequence (wt) from LACV(LACV/03/NY-M (41030016))__GU206130.1__GP
MIYILVLIAVTAASPVYQRCFQDGAIVKQNPSKEAVTEVCLKDDVSMIKTEARYIRNATGVFSNNVAIRKWLVSDWHDCRPKKIVGGHINVIEVGDDLSLHTESYVCSADCTIGVDKETAQVRLQTDTTNHFEIAGTTVKSGWFKSTTYITLDQTCEHLKVSCGPKSIQFHACFNQHMSCVRFLHRTILPGSIANSICQNIEIIILVTLTLLIFILLSILSKTYICYLLMPVFIPIAYVYGIIYNKSCKKCKLCGLVYHPFTECGTHCVCGARYDTSDRMKLHRASGLCPGYKSLRAARVMCKSKGPASILSIITAVLVLTFVTPINSMVLGESKEVFELEELPDDMLEMALRINFYYFTCILNYAVSWSLVIIGLLTGLLFKRYQHKFLNIYAMYCEECDMYHDKSGLKRHGDFTNKCRQCTCGQYEDATGLMTHRKTYNCLVQYKAKWIMNFLIIYIFLVLIKDSAIIVQAAGTDFSSCLETESINWNCTGPFLNLGNCQKQQKKEPYTNIAAQLKGLRAISVLDIPMITEIPDDIASALRYIEEREAFHVQLTAEYAMLTRYCDYYTQFSDNSGYSQTTWRVYLRSHDFEACIMYPNQHFCRCVKNGEKCSSSNWDFANEMKDYYSGKQAKFDKDLNLALTALHHAFRGTSSAYIAAMLSKKSNDDLITYTNKIKTKFPGNALLKAIIDYIAYMKGLPGMASFKHDEFWDELLYKPTPTKAPNLARGRESSYNFKLAISSKSIKTCKNVKDVACLSPRSGAIYASIIACGEPNGPSVYRKPSNGVFQSSTDQSMYCLLDSHCLEEFEAISQEELDAVKKSKCWEIEYPDIKPLQESDGTKSCRMKDSGNCNVATNRWPVIQCENDKFYYSELQKDYDKTQDIGHYCLSPGCTTVRYPINPKHISNCNWQVSRSSIAKIDVHNIEDIEQYKKAITQKLQTSLSLFKYAKTKNLPHIKPIYKYITIEGTETAEGIESAYIESEVPALAGTSIGFKINSKEGKHLLDVIAYVKSASYSSVYTKLYSTGPTSGINTKHDELCTGPCPANINHQVGWLTFAKERTSSWGCEEFGCLAVSDGCVFGSCQDIIKEELSVYRKETEEVTDVELCLTFSDKTYCTNLNPVTPIITDLFEVQFKTVETYSLPRIVAVQNHEIKIGQINDLGVYSKGCGNVQKVNGTVYGNGVPRFDYLCHLASRKEVIVRKCFDNDYQACKFLQSPASYRLEEDSGTVTVIDYKKILGTIKMKAILGDVKYKTFADNVDITAEGSCTGCINCFENIHCELTLHTTIEASCPIKSSCTVFHDRILVTPNEHKYALKVVCTEKPGNTLTIKVCNTKIEASMALVDAKPIIELAPVDQTAYIREKDERCKTWMCRVRDEGLQVILEPFKNLFGSYIGIFYTFIISIVALLVIIYILLPICFKLRDTLRKHEDAYKREMKIR

SEQ ID NO: 1948 - protein, 1441 aa, Artificial Sequence
  derived and/or modified protein sequence (wt) from LACV(LACV/06/NY(1)-M (06MS2900303))__GU206118.1__GP
MIYILVLIAVTAASPVYQRCFQDGAIVKQNPSKEAVTEVCLKDDVSMIKTEARYIRNATGVFSNNVAIRKWLVSDWHDCRPKKIVGGHINVIEVGDDLSLHTESYVCSADCTIGVDKETAQVRLQTDTTNHFEIAGTTVKSGWFKSTTYITLDQTCEHLKVSCGPKSIQFHACFNQHMSCVRFLHRTILPGSIANSICQNIEIIILVTLALLIFILLSILSKTYICYLLMPVFIPIAYVYGVIYNKSCKKCKLCGLVYHPFTECGTHCVCGARYDTSDRMKLHRASGLCPGYKSLRAARVMCKSKGPASILSIITAVLVLTFVTPINSMVLGESKEVFELEELPDDMLEMALRINFYYFTCILNYAVSWSLVIIGLLTGLLFKRYQHKFLNIYAMYCEECDMYHDKSGLKRHGDFTNKCRQCTCGQYEDATGLMTHRKTYNCLVQYKAKWIMNFLIIYIFLVLIKDSAIIVQAAGTDFSSCLETESINWNCTGPFLNLGNCQKQQKKEPYANIAAQLKGLKAISVLDIPMITEIPDDIASALRYIEEREAFHVQLTAEYAMLTRYCDYYTQFSDNSGYSQTTWRVYLRSHDFEACIMYPNQHFCRCVKNGEKCSSSNWDFANGMKDYYSGKQAKFDKDLNLALTALHHAFRGTSSAYIATMLSKKSNDDLIAYTNKIKTKFPGNALLKAIIDYIAYMKGLPGMANFKHDEFWDELLYKPTPTKAPNLARGRESSYNFKLAISSKSIKTCKNVKDVACLSPRSGAIYASIIACGEPNGPSVYRKPLNGVFQSSTDQSMYCLLDSHCLEEFEAISQEELDAVKKSKCWEIEYSDIKPLQESDGTKSCRMKDSGNCNVATNRWPVIQCENDKFYYSELQKDYDKTQDIGHYCLSPGCTTVRYPINPKHISNCNWQVSRSSIAKIDVHNIEDIEQYKKAITQKLQTSLSLFKYAKTKNLPHIKPIYKYITIEGTETAEGIESAYIESEVPALAGTSIGFKINSKEGKHLLDVIAYVKSASYSSVYTKLYSTGPTSGINTKHDELCTGPCPANINHQVGWLTFAKERTSSWGCEEFGCLAVSDGCVFGSCQDIIKEELSVYRKETEEVTDVELCLTFSDKTYCTNLNPVTPIITDLFEVQFKTVETYSLPRIVAVQNHEIKIGQINDLGVYSKGCGNVQKVNGTVYGNGVPRFDYLCHLASRKEVIVRKCFDNDYQACKFLQSPASYRLEEDSGTVTVIDYKKILGTIKMKAILGDVKYKTFADNVDITAEGSCTGCINCFENIHCELTLHTTIEASCPIKSSCTVFHDRILVTPNEHKYALKVVCTEKPGNTLTIKVCNTKIEASMALVDAKPIIELAPVDQTAYIREKDERCKTWMCRVRDEGLQVILEPFKNLFGSYIGIFYTFIISIVTLLVIIYILLPICFKVRDTLRKHEDAYKREMKIR

SEQ ID NO: 1949 - protein, 1441 aa, Artificial Sequence
  derived and/or modified protein sequence (wt) from LACV(LACV/06/NY(2)-M (06MS350140))__GU206109.1__GP
MIYILVLIAVTAASPVYQRCFQDGAIVKQNPSKEAVTEVCLKDDVSMIKTEARYIRNATGVFSNNVAIRKWLVSDWHDCRPKKIVGGHINVIEVGDDLSLHTESYVCSADCTIGVDKETAQVRLQTDTTNHFEIAGTTVKSGWFKSTTYITLDQTCEHLKVSCGPKSIQFHACFNQHMSCVRFLHRTILPGSIANSICQNIEIIILVTLALLIFILLSILSKTYICYLLMPVFIPIAYVYGVIYNKSCKKCKLCGLVYHPFTECGTHCVCGARYDTSDRMKLHRASGLCPGYKSLRAARVMCKSKGPASILSIITAVLVLTFVTPINSMVLGESKEVFELEELPDDMLEMALRINFYYFTCILNYAVSWSLVIIGLLTGLLFKRYQHKFLNIYAMYCEECDMYHDKSGLKRHGDFTNKCRQCTCGQYEDATGLMTHRKTYNCLVQYKAKWIMNFLIIYIFLVLIKDSAIIVQAAGTDFSSCLETESINWNCTGPFLNLGNCQKQQKKEPYANIAAQLKGLKAISVLDIPMITEIPDDIASALRYIEEREAFHVQLTAEYAMLTRYCDYYTQFSDNSGYSQTTWRVYLRSHDFEACIMYPNQHFCRCVKNGEKCSSSNWDFANEMKDYYSGKQAKFDKDLNLALTALHHAFRGTSSAYIATMLSKKSNDDLIAYTNKIKTKFPGNALLKAIIDYIAYMKGLPGMANFKHDEFWDELLYKPTPTKAPNLARGRESSYNFKLAISSKSIKTCKNVKDVACLSPRSGAIYASIIACGEPNGPSVYRKPLNGVFQSSTDQSMYCLLDSHCLEEFEAISQEELDAVKKSKCWEIEYPDIKPLQESDGTKSCRMKDSGNCNVATNRWPVIQCENDKFYYSELQKDYDKTQDIGHYCLSPGCTTVRYPINPKHISNCNWQVSRSSIAKIDVHNIEDIEQYKKAITQKLQTSLSLFKYAKTKNLPHIKPIYKYITIEGTETAEGIESAYIESEVPALAGTSIGFKINSKEGKHLLDVIAYVKSASYSSVYTKLYSTGPTSGINTKHDELCTGPCPANINHQVGWLTFAKERTSSWGCEEFGCLAVSDGCVFGSCQDIIKEELSVYRKETEEVTDVELCLTFSDKTYCTNLNPVTPIITDLFEVQFKTVETYSLPRIVAVQNHEIKIGQINDLGVYSKGCGNVQKVNGTVYGNGVPRFDYLCHLASRKEVIVRKCFDNDYQACKFLQSPASYRLEEDSGTVTVIDYKKILGTIKMKAILGDVKYKTFADNVDITAEGSCTGCINCFENIHCELTLHTTIEASCPIKSSCTVFHDRILVTPNEHKYALKVVCTEKPGNTLTIKVCNTKIEASMALVDAKPIIELAPVDQTAYIREKDERCKTWMCRVRDEGLQVILEPFKNLFGSYIGIFYTFIISIVTLLVIIYILLPICFKLRDTLRKHEDAYKREMKIR

SEQ ID NO: 1950 - protein, 1441 aa, Artificial Sequence
  derived and/or modified protein sequence (wt) from LACV(LACV/06/NY(3)-M (06MS270036))__GU206121.1__GP
MIYILVLIAVTAASPVYQRCFQDGAIVKQNPSKEAVTEVCLKDDVSMIKTEARYIRNATGVFSNNVAIRKWLVSDWHDCRPKKIVGGHINVIEVGDDLSLHTESYVCSADCTIGVDKETAQVRLQTDTTNHFEIAGTTVKSGWFKSTTYITLDQTCEHLKVSCGPKSIQFHACFNQHMSCVRFLHRTILPGSIANSICQNIEIIILVTLALLIFILLSILSKTYICYLLMPVFIPIAYVYGVIYNKSCKKCKLCGLVYHPFTECGTHCVCGARYDTSDRMKLHRASGLCPGYKSLRAARVMCKSKGPASILSIITAVLVLTFVTPINSMVLGESKEVFELEELPDDMLEMALRINFYYFTCILNYAVSWSLVIIGLLTGLLFKRYQHKFLNIYAMYCEECDMYHDKSGLKRHGDFTNKCRQCTCGQYEDATGLMTHRKTYNCLVQYKAKWIMNFLIIYIFLVLIKDSAIIVQAAGTDFSSCLETESINWNCTGPFLNLGNCQKQQKKEPYANIAAQLKGLKAISVLDIPMITEIPDDIASALRYIEEREAFHVQLTAEYAMLTRYCDYYTQFSDNSGYSQTTWRVYLRSHDFEACIMYPNQHFCRCVKNGEKCSSSNWDFANGMKDYYSGKQAKFDKDLNLALTALHHAFRGTSSAYIATMLSKKSNDDLIAYTNKIKTKFPGNALLKAIIDYIAYMKGLPGMANFKHDEFWDELLYKPTPTKAPNLARGRESSYNFKLAISSKSIKTCKNVKDVACLSPRSGAIYASIIACGEPNGPSVYRKPLNGVFQSSTDQSMYCLLDSHCLEEFEAISQEELDAVKKSKCWEIEYSDIKPLQESDGTKSCRMKDSGNCNVATNRWPVIQCENDKFYYSELQKDYDKTQDIGHYCLSPGCTTVRYPINPKHISNCNWQVSRSSIAKIDVHNIEDIEQYKKAITQKLQTSLSLFKYAKTKNLPHIKPIYKYITIEGTETAEGIESAYIESEVPALAGTSIGFKINSKEGKHLLDVIAYVKSASYSSVYTKLYSTGPTSGINTKHDELCTGPCPANINHQVGWLTFAKERTSSWGCEEFGCLAVSDGCVFGSCQDIIKEELSVYRKETEEVTDVELCLTFSDKTYCTNLNPVTPIITDLFEVQFKTVETYSLPRIVAVQNHEIKIGQINDLGVYSKGCGNVQKVNGTVYGNGVPRFDYLCHLASRKEVIVRKCFDNDYQACKFLQSPASYRLEEDSGTVTVIDYKKILGTIKMKAILGDVKYKTFADNVDITAEGSCTGCINCFENIHCELTLHTTIEASCPIKSSCTVFHDRILVTPNEHKYALKVVCTEKPGNTLTIKVCNTKIEASMALVDAKPIIELAPVDQTAYIREKDERCKTWMCRVRDEGLQVILEPFKNLFGSYIGIFYTFIISIVTLLVIIYILLPICFKLRDTLRKHEDAYKREMKIR

SEQ ID NO: 1951 - protein, 1441 aa, Artificial Sequence
  derived and/or modified protein sequence (wt) from LACV(LACV/65/OH-M (W17258))__GU206124.1__GP
MIRILVLIAVTAANPVYQRCFQDGAIVKQNPSKEAVTEVCLKDDVSMIKTEARYIRNATGVFSNNVAIRKWLVSDWHDCRPKKIIGGHINVIEVGDDLSLHTESYVCSADCTIGVDKETAQVRLQTDTTNHFEIAGTTVKSGWFKSTTYITLDQTCEHLKVSCGPKSVQFHACFNQHMSCVRFLHRTVLPGSIANSICQNIEIIILVTLTLLIFILLSILSKTYICYLLMPIFIPIAYVYGIIYNKSCKKCKLCGLVYHPFTECGTHCVCGARYDTSDRMKLHRASGLCPGYKSLRAARVMCKSKGPASILSIITAVLVLTFVTPINSMVLGESKETFELEELPDDMLEMASRIDSYYFTCILNYAVSWGLVIIGLLTGLLFKKYQHRFLNVYAMYCEECDMYHDKSGLKRHGDFTNKCRQCTCGQYEDATGLMAHRKTYNCLVQYKAKWMMNFLIIYIFLILIKDSAIVVQAAGTDFTTCLETENINWNCTGPFLNLGNCQKQQKKEPYTNIATQLKGLKAISVLDIPIITGIPDDIAGALRYIEEKEDFHVQLTIEYAMLSKYCDYYTQFSDNSGYSQTTWRVYLRSHDFEACILYPNQHFCRCVKNGEKCSSSNWDFANEMKDFYSGKQTKFDKDLNLALTALHHAFRGTSSAYIATMLSKKSNDDLIAYTNKIKTKFPGNALLKAIIDYIAYMKSLPGMANFKYDEFWDELLYKPNPAKASNLARGKESSYNFKLAISSKSIKTCKNVKDVACLSPRSGAIYASIIACGEPNGPSVYRKPSGGVFQSSTDRSIYCLLDSHCLEEFEAISQEELDAVKKSKCWEIEYPDVKPLQEGDGTKSCRMKDSGNCNVATNRWPVIQCENDKFYYSELQKDYDKTQDIGHYCLSPGCTTVRYPINPKHISNCNWQVSRSSIAKIDVHNIEDIEQYKKAITQKLQTSLSLFKYAKTKNLPHIKPIYKYITIEGTETAEGIESAYIESEVPALAGTSIGFKINSKEGKHLLDVIAYVKSASYSSVYAKLYSTGPTSGINTKHDELCTGPCPANINHQVGWLTFARERTSSWGCEEFGCLAVSDGCVFGSCQDIIKEELSVYRKETEEVTDVELCLTFSDKTYCTNLNPVTPIITDLFEVQFKTVETYSLPRIVAVQNHEIKIGQINDLGVYSKGCGNVQKVNGTVYGNGVPRFDYLCHLASRKEVIVRKCFDNDYQACKFLQSPASYRLEEDSGTVTIIDYKKILGTIKMKAILGDVKYKTFADSVDITAEGSCTGCINCFENIHCELTLHTTIEASCPIKSSCTVFHDRILVTPNEHKYALKMVCTEKPGNTLTIKVCNTKIEASMALVDAKPIIELAPVDQTAYIREKDERCKTWMCRVRDEGLQVILEPFKNLFGSYIGIFYTFIISIVALLVIIYVLLPICFKLRDTLRKHEDAYKREMKIR

SEQ ID NO: 1952 - protein, 1441 aa, Artificial Sequence
  derived and/or modified protein sequence (wt) from LACV(LACV/67/NY-M (67-8109))__GU206115.1__GP
MICILVLITVAAASPVYQRCFQDGAIVKQNPSKEAVTEVCLKDDVSMIKTEARYVRNATGVFSNNVAIRKWLVSDWHDCRPKKIVGGHINVIEVGDDLSLHTESYVCSADCTIGVDKETAQVRLQTDTTNHFEIAGTTVKSGWFKSTTYITLDQTCEHLKVSCGPKSVQFHACFNQHMSCVRFLHRTILPGSIANSICQNIEIIILVTLTLLIFILLSILSKTYICYLLMPIFIPIAYIYGTIYNKSCKKCKLCGLVYHPFTECGTHCVCGARYDTSDRMKLHRASGLCPGYKSLRAARVMCKSKGPASILSIITAVLVLTFVTPINSMVLGESKETFELEDLPDDMLEMASRINSYYLTCILNYAVSWGLVIIGLLIGLLFKKYQHRFLNVYAMYCEECDMYHDKSGLKRHGDFTNKCRQCTCGQYEDAAGLMAHRKTYNCLVQYKAKWMMNFLIIYIFLILIKDSAIVVQAAGTDFTTCLETESINWNCTGPFLNLGNCQKQQKKEPYTNIATQLKGLKAISVLDVPIITGIPDDIAGALRYIEEKEDFHVQLTIEYAMLSKYCDYYTQFSDNSGYSQTTWRVYLRSHDFEACILYPNQHFCRCVKNGEKCSSSNRDFANEMKDYYSGKQTKFDKDLNLALTALHHAFRGTSSAYIATMLSKKSNDDLIAYTNKIKTKFPGNALLKAIIDYIAYMKSLPGMANFKYDEFWDELLYKPNPAKASNLARGKESSYNFKLAISSKSIKTCKNVKDVACLSPRSGAIYASIIACGEPNGPSVYRKPSGGVFQSSTDQSIYCLLDSHCLEEFEAIGQEELDAVKKSKCWEIEYPDVKLIQEGDGTKSCRMKDSGNCNVATNRWPVIQCENDKFYYSELQKDYDKTQDIGHYCLSPGCTTVRYPINPKHISNCNWQVSRSSIAKIDVHNIEDIEQYKKAITQKLQTSLSLFKYAKTKNLPHIKPIYKYITIEGTETAEGIESAYIESEVPALAGTSIGFKINSKEGKHLLDVIAYVKSASYSSVYTKLYSTGPTSGINTKHDELCTGPCPANINHQVGWLTFARERTSSWGCEEFGCLAVSDGCVFGSCQDIIKEELSVYRKETEEVTDVELCLTFSDKTYCTNLNPVTPIITDLFEVQFKTVETYSLPRIVAVQNHEIKIGQINDLGVYSKGCGNVQKVNGTIYGNGVPRFDYLCHLASRKEVIVRKCFDNDYQACKFLQSPASYRLEEDSGTVTIIDYKKILGTIKMKAILGDVKYKTFADSVDITAEGSCTGCINCFENIHCELTLHTTIEASCPIKSSCTVFHDRILVTPNEHKYALKMVCTEKPGNTLTIKVCNTKIEASMALVDAKPIIELAPVDQTAYIREKDERCKTWMCRVRDEGLQVILEPFKNLFGSYIGIFYTFIISIVALLVIIYVLLPICFKLRDTLRKHEDAYKREMKIR

SEQ ID NO: 1953 - protein, 1441 aa, Artificial Sequence
  derived and/or modified protein sequence (wt) from LACV(LACV/74/NY-M (74-32813))__GU206142.1__GP
MIRMLVLIVVTAASPVYQRCFQDGAIVKQNPSKEAVTEVCLKDDVSMIKTEARYVKNATGVFSNNVAIRKWLVSDWHDCRPKKIVGGHINVIEVGDDLSLHTESYVCSADCTIGVDKETAQVRLQTDTTNHFEIAGTTVKSGWFKSTTYITLDQTCEHLKVSCGPKSVQFHACFNQHMSCVRFLHRTILPGSIANSICQNIEIIILVTLTLLIFILLSILSKTYICYLLMPIFIPIAYMYGVIYNKSCKKCKLCGLVYHPFTECGTHCVCGARYDTSDRMKLHRASGLCPGYKSLRAARVMCKSKGPASILSIITAVLVLTFVTPINSMVLGESKETFELEELPDDMLEMALRINSYYFTCILNYAVSWGLIIAGLLVGLIFKKYQHRFLNIYAMYCEECNMYHDKSGLKRHGDFTNKCRQCTCGQYEDATGLITHRKTYNCLVQYKAKWMMNFLIIYIFLILIKDSAIVVQATGTDFTTCLETESINWNCTGPFLNLGNCQKQQKKEPYTNIATQLKGLKAISVLDIPIITSIPDDIAGALRYIEEKEDFHVQLTTEYAMLSKYCDYYTQFSDNSGYSQTTWRVYLRSHDFEACILYPNQHFCKCVKNGEKCSSSNWDFANEMKNYYSGKQAKFDKDLNLALTALHHAFRGTSSAYIAAMLSKKSNDDLIAYTNKIKAKFPGNALLKAIIDYIAYMKGLPEMANFKYDEFWDELLYKPNPAKASNLARGKESSYNFKLAISSKSIKTCKNVKDVACLSPRSGAIYSSIIACGEPNGPSVYRKPSGGVFQSSTDRSIYCLLDSHCLEEFEAISQEELDAVKKSKCWEIEYPDVRPLQESDGAKSCRMKDSGNCNVATNRWPVMQCENDKFYYSELQKDYDKTQDIGHYCLSPGCTTIRYPINPKHISNCNWQVSRSSIAKIDVHNVEDIEQYKKAITQKLQTSLSLFKYAKTKNLPHIKPIYKYITIEGTETAEGIESAYIESEVPALAGTSVGFKINSKEGKHLLDVIAYVKSASYSSVYAKLYSTGPTSGINTKHDELCTGPCPANINHQVGWLTFARERTSSWGCEEFGCLAVSDGCVFGSCQDIIKEELSVYRKETEEVTNVELCLTFSDKTYCTNLNPVTPIITDLFEVQFKTVETYSLPRIVAVQNHEIKIGQINDLGVYSKGCGNVQKVNGTVYGNGVPRFDYLCHLASRKEVIVRKCFDNDYQACKFLQSPASYRLEEDSGTVTIIDYKKILGTIKMKAILGDVKYKTFADSVDITAEGSCAGCINCFENIHCELTLHTTIEASCPIKSSCTVFHDRILVTPNEHKYALKMVCTEKPGNTLTIKVCNTRIEASMALVDAKPIIELAPVDQTAYIREKDERCKTWMCRVRDEGLQVILEPFKNLFGSYIGIFYTFIISIIALLVIIYVLLPICFKLRDTLRKHDDAYKREMKIR

SEQ ID NO: 1954 - protein, 1441 aa, Artificial Sequence
  derived and/or modified protein sequence (wt) from LACV(LACV/93/MO-H)__GU206139.1__GP
MICILVLITVAAASPVYQRCFQDGAIVKQNPSKEAVTEVCLKDDVSMIKTEARYVRNATGVFSNNVAIRKWLVSDWHDCRPKKIVGGHINVIEVGDDLSLHTESYVCSADCTIGVDKETAQVRLQTDTTNHFEIAGTTVKSGWFKSTTYITLDQTCEHLKVSCGPKSVQFHACFNQHMSCVRFLHRTILPGSIANSICQNIEIIILVTLTLLIFILLSILSKTYICYLLMPIFIPIAYIYGIIYNKSCKKCKLCGLVYHPFTECGTHCVCGARYDTSDRMKLHRASGLCPGYKSLRAARVMCKSKGPASILSIITAVLVLTFVTPINSMVLGESKETFELEDLPDDMLEMASRINSYYLTCILNYAVSWGLVIIGLLIGLLFKKYQHRFLNIYAMYCEECDMYHDKSGLKRHGDFTNKCRQCTCGQYEDAAGLMAHRKTYNCLVQYKAKWMMNFLIIYIFLILIKDSAIVVQAAGTDFTTCLETESINWNCTGPFLNLGNCQKQQKKEPYTNIATQLKGLKAISVLDVPIITGIPDDIAGALRYIEEKEDFHVQLTIEYAMLSKYCDYYTQFSDNSGYSQTTWRVYLRSHDFEACILYPNQHFCRCVKNGEKCSSSNWGFANEMKDYYSGKQTKFDKDLNLALTALHHAFRGTSSAYMATMLSKKSNDDLIAYTNKIKTKFPGNALLKAIIDYIAYMKSLPGMANFKYDEFWDELLYKPNPAKASNLARGKESSYNFKLAISSKSIKTCKNVKDVACLSPRSGAIYASIIACGEPNGPSVYRKPSGGVFQSSTDRSIYCLLDSHCLEEFEAIGQEELDAVKKSKCWEIEYPDVKLIQEGDGTKSCRMKDSGNCNVATNRWPVIQCDNDKFYYSELQKDYDKTQDIGHYCLSPGCTTVRYPINPKHISNCNWQVSRSSIAKIDVHNIEDIEQYKKAITQKLQTSLSLFKYAKTKNLPHIKPIYKYITIEGTETAEGIESAYIESEVPALAGTSIGFKINSKEGKHLLDVIAYVKSASYSSVYTKLYSTGPTSGINTKHDELCTGPCPANINHQDGWLTFARERTSSWGCEEFGCLAVSDGCVFGSCQDIIKEELSVYRKETEEVTDVELCLTFSDKTYCTNLNPVTPIITDLFEVQFKTVETYSLPRIVAVQNHEIKIGQINDLGVYSKGCGNVQKVNGTIYGNGVPRFDYLCHLASRKEVIVRKCFDNDYQACKFLQSPASYRLEEDSGTVTIIDYKKILGTIKMKAILGDVKYKTFADSVDITAEGSCTGCINCFENIHCELTLHTTIEASCPIKSSCTVFHDRILVTPNEHKYALKVVCTEKPGNTLTIEVCNTKIEASMALVDAKPIIELAPVDQTTYIREKDERCKTWMCRVRDEGLQVILEPFKNLFGSYIGIFYTFIISIVALLVIIYVLLPICFKLRDTLRKHEDAYKREMKIR

SEQ ID NO: 1955 - protein, 1441 aa, Artificial Sequence
  derived and/or modified protein sequence (wt) from LACV(LACV/95/OH-H (CCH-MB96))__GU206136.1__GP
MIRILVLIAVTAASPVYQRCFQDGAIVKQNPSKEAVTEVCLKDDVSMIKTEARYIRNATGVFSNNVAIRKWLVSDWHDCRPKKIIGGHINVIEVGDDLSLHTESYVCSADCTIGVDKETAQVRLQTDTTNHFEIAGTTVKSGWFKSTTYITLDQTCEHLKVSCGPKSVQFHACFNQHMSCVRFLHRTILPGSIANSICQNIEIIILVTLTLLIFILLSILSKTYICYLLMPIFIPIAYVYGIIYNKSCKKCKLCGLVYHPFTECGTHCVCGARYDTSDRMKLHRASGLCPGYKSLRAARVMCKSKGPASILSMITAVLVLTFVTPINSMVLGESKETFELEELPDDMLEMVSRINSYYFTCILNYAVSWGLIIIGLLTGLLFKKYQHRFLNVYAMYCEECDMYHDKSGLKRHGDFTNKCRQCTCGQYEDAAGLMAHRKTYNCLVQYKAKWMMNFLIIYIFLILIKDSAIVVQAAGTDFTTCLETESINWNCTGPFLNLGNCQKQQKKEPYTNIATQLKGLKAISVLDIPIITGIPDDIAGALRYIEEREDFHVQLTIEYAMLSKYCDYYTQFSDNSGYSQTTWRVYLRSHDFEACILYPNQHFCRCVKNGEKCSSSNWGFANEMKDFYSGKQTKFDKDLNLALTALHHAFRGTSSAYIATVLSKKSNDDLIAYTNKIKTKFPGNALLKAIIDYIAYMKSLPGMANFKYDEFWDELLYKPNPAKASNLARGKESSYNFKLAISSKSIKTCKNVKDVACLSPRSGAIYASIIACGEPSGPSVYRKPPGGVFQSSTDRSIYCLLDSHCLEEFEAISQEELDAVKKSKCWEIEYPDVKPLQESDGTKSCRMKDSGNCNVATNRWPVIQCENDKFYYSELQKDYDKTQDIGHYCLSPGCTTVRYPINPKHISNCNWQVSRSSIAKIDVHNIEDIEQYKKAITQKLQTSLSLFKYAKTKNLPHIKPIYKYITIEGTETAEGIESAYIESEVPALAGTSIGFKINSKEGKHLLDVIAYVKSASYSSVYTKLYSTGPTSGINTKHDELCTGPCPANINHQVGWLTFARERTSSWGCEEFGCLAVSDGCVFGSCQDIIKEELSVYRKETEEVTDVELCLTFSDKTYCTNLNPVTPIITDLFEVQFKTVETYSLPRIVAVQNHEIKIGQINDLGVYSRGCGNVQKVNGTVYGNGVPRFDYLCHLASRKEVIVRKCFDNDYQACKFLQSPASYRLEEDSGTVTIIDYKKILGTIKMKAILGDVKYKTFADSVDITAEGSCTGCINCFENIHCELTLHTTIEASCPIKSSCTVFHDRILVTPNEHKYALKMVCTEKPGNTLTIKVCNTKIEASMALVDAKPIIELAPVDQTAYIREKDERCKTWMCRVRDEGLQVILEPFKNLFGSYIGIFYTFIISIVALLVIIYVLLPICFKLRDTLRKHEDAYKREMKIR

SEQ ID NO: 1956 - protein, 1441 aa, Artificial Sequence
  derived and/or modified protein sequence (wt) from LACV(LACV/95/WV-H)__GU206133.1__GP
MICILVLITVAAASPVYQRCFQDGAIVKQNPSKEAVTEVCLKDDVSMIKTEARYVRNATGVFSNNVAIRKWLVSDWHDCRPKKIVGGHINVIEVGDDLSLHTESYVCSADCTIGVDKETAQVRLQTDTTNHFEIAGTTVKSGWFKSTTYITLDQTCEHLKVSCGPKSVQFHACFNQHMSCVRFLHRTILPGSIANSICQNIEIIILVTLTLLIFILLSILSKTYICYLLMPIFIPIAYIYGTIYNKSCKKCKLCGLVYHPFTECGTHCVCGARYDTSDRMKLHRASGLCPGYKSLRAARVMCKSKGPASILSIITAVLVLTFVTPINSMVLGESKETFELEDLPDDMLEMASRINSYYLTCILNYAVSWGLVIIGLLIGLLFKKYQHRFLNVYAMYCEECDMYHDKSGLKRHGDFTNKCRQCTCGQYEDAAGLMAHRKTYNCLVQYKAKWMMNFLIIYIFLILIKDSAIVVQAAGTDFTTCLETESINWNCTGPFLNLGNCQKQQKKEPYTNIATQLKGLKAISVLDVPIITGIPDDIAGALRYIEEKEDFHVQLTIEYAMLSKYCDYYTQFSDNSGYSQTTWRVYLRSHDFEACILYPNQHFCRCVKNGEKCSSSNWDFANEMKDYYSGKQTKFDKDLNLALTALHHAFRGTSSAYIATMLSKKSNDDLIAYTNKIKTKFPGNALLKAIIDYIAYMKSLPGMANFKYDEFWDELLYKPNPAKASNLARGKESSYNFKLAISSKSIKTCKNVKDVACLSPRSGAIYASIIACGEPNGPSVYRKPSGGVFQSSTDQSIYCLLDSHCLEEFEAIGQEELDAVKKSKCWEIEYPDVKLIQEGDGTKSCRMKDSGNCNVATNRWPVIQCENDKFYYSELQKDYDKTQDIGHYCLSPGCTTVRYPINPKHISNCNWQVSRSSIAKIDVHNIEDIEQYKKAITQKLQTSLSLFKYAKTKNLPHIKPIYKYITIEGTETAEGIESAYIESEVPALAGTSIGFKINSKEGKHLLDVIAYVKSASYSSVYTKLYSTGPTSGINTKHDELCTGPCPANINHQVGWLTFARERTSSWGCEEFGCLAVSDGCVFGSCQDIIKEELSVYRKETEEVTDVELCLTFSDKTYCTNLNPVTPIITDLFEVQFKTVETYSLPRIVAVQNHEIKIGQINDLGVYSKGCGNVQKVNGTIYGNGVPRFDYLCHLASRKEVIVRKCFDNDYQACKFLQSPASYRLEEDSGTVTIIDYKKILGTIKMKAILGDVKYKTFADSVDITAEGSCTGCINCFENIHCELTLHTTIEASCPIKSSCTVFHDRILVTPNEHKYALKMVCTEKPGNTLTIKVCNTKIEASMALVDAKPIIELAPVDQTAYIREKDERCKTWMCRVRDEGLQVILEPFKNLFGSYIGIFYTFIISIVALLVIIYVLLPICFKLRDTLRKHEDAYKREMKIR

SEQ ID NO: 1957 - protein, 1441 aa, Artificial Sequence
  derived and/or modified protein sequence (wt) from LACV(LACV/96/WV-M (WV96-3955))__GU206145.1__GP
MIYILVLIAVTAASPVYQRCFQDGAIVKQNPSKEAVTEVCLKDDVSMIKTEARYIRNATGVFSNNVAIRKWLVSDWHDCRPKKITGGHINVIEVGDDLSLHTESYVCSADCTIGVDKETAQVRLQTDTTNHFEIAGTTVKSGWFKSTTYITLDQTCEHLKVSCGPKSVQFHACFNQHMSCVRFLHRTILPGSIANSICQNIEIIILVTLTLLIFILLSILSKTYICYLLMPIFIPIAYVYGIIYNKSCKKCKLCGLVYHPFTECGTHCVCGARYDTSDRMKLHRASGLCPGYKSLRAARVMCKSKGPASILSIITAVLVLTFVTPINSMVLGESKEVFELEELPDDMLEMALRINSYYFTCILNYAVSWGLIIIGLLTGLLFKKYQHRFLNIYAMYCEECDMYHDKSGLKRHGDFTNKCRQCTCGQYEDAAGLMTHRKTYNCLVQYKAKWIMNFLIVYIFLILIKDSAIIVRAAGTDFSSCLETEIINWNCTGPFLNLGNCQRQQKKEPYANIAAQLKGLKAISVLDIPMITEIPDDIASALRYIEEREAFHVQLTAEYAMLSRYCDYYTQFSDNSGYSQTTWRVYLRSHDFEACILYPNQHFCRCVKNGEKCSSANWDFANEMKDYYSGKQAKFDKDLNLALTAMHHAFRGTSSAYMAAMLSKKSNDDLITYTNKLKTKFPGNALLKAIIDYIAYMKGLPGMANFKHDEFWDELLYKPTPTKAPNLARGRESSYNFELAISSKSIKTCKNVKDVACLSPRSGAIYASIIACGEPNGPSVYRKPSGGVFQSSTDQSMYCLLDSHCLEEFEAISQEELDAVKKSKCWEIEYPDVKLLQENDGTKSCRMKDSGNCNVATNRWPVIQCENDKFYYSELQKDYDKTQDIGHYCLSPGCATIRYPINPKHISNCNWQVSRSSIAKIDVHNIEDIEQYKKAITQKLQTSLSLFKYAKTKNLPHIKPIYKYITIEGTETAEGIESAYIESEVPALAGTSIGFKINSKEGKHLLDVIAYVKSASYSSVYTKLYSTGPTSGVNTKHDELCTGPCPANINHQVGWLTFARERTSSWGCEEFGCLAVSDGCVFGSCQDIIKEELSVYRKETEEVTDVELCLTFSDKTYCTNLNPVTPIITDLFEVQFKTVETYSLPRIVAVQNHEIKIGQINDLGVYSKGCGNVQKVNGTIYGNGVPRFDYLCHLASRKEVIVRKCFDNDYQACKFLQSPASYRLEEDSGTVTIIDYKKILGTIKMKAILGDVKYKTFADNVDITAEGSCTGCINCFENIHCELTLHTTIEASCPIKSSCTVFHDRILVTPNEHKYALKVVCTEKPGNTLTIKVCNTKIEAAMALVDAKPIIELAPVDQTAYIREKDERCKTWMCRVRDEGLQVILEPFKNLFGSYIGIFYTFIISIVALLVIIYILLPICFKLRDTLRKHEDAYKREMKIR

SEQ ID NO: 1958 - protein, 1441 aa, Artificial Sequence
  derived and/or modified protein sequence (wt) from LACV(LACV/97/NC-M (NC97-7306))__GU206127.1__GP
MIRILVLIAVTAASPVYQRCFQDGAIVKQNPSKEAVTEVCLKDDVSMIKTEARYIRNATGVFSNNVAIRKWLVSDWHDCRPKKIIGGHINVIEVGDDLSLHTESYVCSADCTIGVDKETAQVRLQTDTTNHFEIAGTTVKSGWFKSTTYITLDQTCEHLKVSCGPKSVQFHACFNQHMSCVRFLHRTILPGSIANSICQNIEIIILVTLTLLIFILLSILSKTYICYLLMPIFIPIAYVYGIIYNKSCKKCKLCGLVYHPFTECGTHCVCGARYDTSDRMKLHRASGLCPGYKSLRAARVMCKSKGPASILSMITAVLVLTFVTPINSMVLGESKETFELEELPDDMLEMVSRINSYYFTCILNYAVSWGLIIIGLLTGLLFKKYQHRFLNVYAMYCEECDMYHDKSGLKRHGDFTNKCRQCTCGQYEDAAGLMAHRKTYNCLVQYKAKWMMNFLIIYIFLILIKDSAIVVQAAGTDFTTCLETESINWNCTGPFLNLGNCQKQQKKEPYTNIATQLKGLKAISVLDIPIITGIPDDIAGALRYIEEREDFHVQLTIEYAMLSKYCDYYTQFSDNSGYSQTTWRVYLRSHDFEACILYPNQHFCRCVKNGEKCSSSNWDFANEMKDFYSGKQTKFDKDLNLALTALHHAFRGTSSVYIATMLSKKSNDDLIAYTNKIKTKFPGNALLKAIIDYIAYMKSLPGMANFKYDEFWDELLYKPNPAKASNLARGKESSYNFKLAISSKSIKTCKNVKDVACLSPRSGAIYASIIACGEPNGPSVYRKPPGGVFQSSTDRSIYCLLDSHCLEEFEAISQEELDAVKKSKCWEIEYPDVKPLQESDGTKSCRMKDSGNCNVATNRWPVIQCENDKFYYSELQKDYDKTQDIGHYCLSPGCTTVRYPINPKHISNCNWQVSRSSIAKIDVHNIEDIEQYKKAITQKLQTSLSLFKYAKTKNLPHIKPIYKYITIEGTETAEGIESAYIESEVPALAGTSIGFKINSKEGKHLLDVIAYVKSASYSSVYTKLYSTGPTSGINTKHDELCTGPCPANINHQVGWLTFARERTSSWGCEEFGCLAVSDGCVFGSCQDIIKEELSVYRKETEEVTDVELCLTFSDKTYCTNLNPVTPIITDLFEVQFKTVETYSLPRIVAVQNHEIKIGQINDLGVYSKACGNVQKVNGTVYGNGVPRFDYLCHLASRKEVIVRKCFDNDYQACKFLQSPASYRLEEDSGTVTIIDYKKILGTIKMKAILGDVKYKTFADSVDITAEGSCTGCINCFENIHCELTLHTTIEASCPIKSSCTVFHDRILVTPNEHKYALKMVCTERPGNTLTIKVCNTKIEASMALVDAKPIIELAPVDQTAYIREKDERCKTWMCRVRDEGLQVILEPFKNLFGSYIGIFYTFIISIVALLVIIYVLLPICFKLRDTLRKHEDAYKREMKIR

SEQ ID NO: 1959 - protein, 1441 aa, Artificial Sequence
  derived and/or modified protein sequence (wt) from LACV(LACV/human/1960)__EF485031.1__GP
MICILVLITVAAASPVYQRCFQDGAIVKQNPSKEAVTEVCLKDDVSMIKTEARYVRNATGVFSNNVAIRKWLVSDWHDCRPKKIVGGHINVIEVGDDLSLHTESYVCSADCTIGVDKETAQVRLQTDTTNHFEIAGTTVKSGWFKSTTYITLDQTCEHLKVSCGPKSVQFHACFNQHMSCVRFLHRTILPGSIANSICQNIEIIILVTLTLLIFILLSILSKTYICYLLMPIFIPIAYIYGTIYNKSCKKCKLCGLVYHPFTECGTHCVCGARYDTSDRMKLHRASGLCPGYKSLRAARVMCKSKGPASILSIITAVLVLTFVTPINSMVLGESKETFELEDLPDDMLEMASRINSYYLTCILNYAVSWGLVIIGLLIGLLFKKYQHRFLNVYAMYCEECDMYHDKSGLKGHGDFTNKCRQCTCGQYEDAAGLMAHRKTYNCLVQYKAKWMMNFLIIYIFLILIKDSAIVVQAAGTDFTTCLETESINWNCTGPFLNLGNCQKQQKKEPYTNIATQLKGLKAISVLDVPIITGIPDDIAGALRYIEEKEDFHVQLTIEYAMLSKYCDYYTQFSDNSGYSQTTWRVYLRSHDFEACILYPNQHFCRCVKNGEKCSSSNWDFANEMKDYYSGKQTKFDKDLNLALTALHHAFRGTSSAYIATMLSKKSNDDLIAYTNKIKTKFPGDALLKAIIDYIAYMKSLPGMANFKYDEFWDELLYKPNPAKASNLARGKESSYNFKLAISSKSIKTCKNVKDVACLSPRSGAIYASIIACGEPNGPSVYRKPSGGVFQSSTDQSIYCLLDSHCLEEFEAIGQEELDAVKKSKCWEIEYPDVKLIQEGDGTKSCRMKDSGNCNVATNRWPVIQCENDKFYYSELQKDYDKTQDIGHYCLSPGCTTVRYPINPKHISNCNWQVSRSSIAKIDVHNIEDIEQYKKAITQKLQTSLSLFKYAKTKNLPHIKPIYKYITIEGTETAEGIESAYIESEVPALAGTSIGFKINSKEGKHLLDVIAYVKSASYSSVYTKLYSTGPTSGINTKHDELCTGPCPANINHQVGWLTFARERTSSWGCEEFGCLAVSDGCVFGSCQDIIKEELSVYRKETEEVTDVELCLTFSDKTYCTNLNPVTPIITDLFEVQFKTVETYSLPRIVAVQNHEIKIGQINDLGVYSKGCGNVQKVNGTIYGNGVPRFDYLCHLASRKEVIVRKCFDNDYQACKFLQSPASYRLEEDSGTVTIIDYKKILGTIKMKAILGDVKYKTFADSVDITAEGSCTGCINCFENIHCELTLHTTIEASCPIKSSCTVFHDRILVTPNEHKYALKMVCTEKPGNTLTIKVCNTKIEASMALVDAKPIIELAPVDQTAYIREKDERCKTWMCRVRDEGLQVILEPFKNLFGSYIGIFYTFIISIVALLVIIYVLLPICFKLRDTLRKHEDAYKREMKIR

SEQ ID NO: 1960 - protein, 1441 aa, Artificial Sequence
  derived and/or modified protein sequence (wt) from LACV(LACV/mosquito/1978)__EF485037.1__GP
MIRILVLIAVTAASPVYQRCFQDGAIVKQNPSKEAVTEVCLKDDVSMIKTEARYVRNATGVFSNNVAIRKWLVSDWHDCRPKKIIGGHINVIEVSDDLSLHTESYVCSADCTIGVDKETAQVRLQTDTTNHFEIAGTTVKSGWFKSTTYITLDQTCEHLKVSCGPKSVQFHACFNQHMSCVRFLHRTILPGSIANSICQNIEIIILVTLTLLIFILLSILSKTYICYLLMPIFIPIAYMYGIIYNKSCKKCKLCGLVYHPFTECGTHCVCGARYDTSDRMKLHRASGLCPGYKSLRAARVMCKSKGPASILSIITAVLVLTFVTPINSMVLGESKETFELEELPDDMLEMASRINSYYFTCILNYAVSWGLVIIGLLTGLLFKKYQHRFLNIYAMYCEECDMYHDKSGLKRHGDFTNKCRQCTCGQYEDAAGLMAHRKTYNCLVQYKAKWMMNFLIIYIFLILIKDSAIVVQAAGTDFTTCLETESIDWNCTGPFLNLGNCQKQQKKEPYTNIATQLKGLKAISVLDIPIITRIPDDIAGALRYIEEREDFHVQLTTEYAMLSKYCDYYTQFSDNSGYSQTTWRVYLRSHDFEACILYPNQNFCRCVKNGEKCSSSNWDFANEMKDYYPGKQAKFDKDLNLALTALHHAFRGTSSAYIATMLSKKSNDDLIAYTNKIKTKFPGNALLKAIIDYIAYMKSLPGMANFKYDEFWDELLYKPNPAKASNLARGKESSYNFKLAISSKSIKTCKNVKDVACLSPRSGAIYASIIACGEPNGPSVYRKPSGGVFQSSTDRSIYCLLDSHCLEEFEAISQEELDAVKKSKCWEIEYSDVKPLQEGNGTKSCRMKDSGNCNVATNRWPVIQCENDKFYYSELQKDYDKTQDIGHYCLSPGCTTVRYPINPKHISNCNWQVSRSSIAKIDVHNIEDIEQYKKAITQKLQTSLSLFKYAKTKNLPHIKPIYKYITIEGTETAEGIESAYIESEVPALAGTSIGFKINSKEGKHLLDVIAYVKSASYSSVYAKLYSTGPTSGINTKHDELCTGPCPANINHQVGWLTFAKERTSSWGCEEFGCLAVSDGCVFGSCQDIIKEELSVYRKETEEVTDVELCLTFSDKTYCTNLNPVTPIITDLFEVQFKTVETYSLPRIVAVQNHEIKIGQINDLGVYSKGCGNVQKVNGTVYGNGVPRFDYLCHLASRKEVIVRKCFDNDYQACKFLQSPASYRLEEDSGTVTIIDYKKILGTIKMKAILGDVKYKTFADSVDITAEGSCTGCINCFENIHCELTLHTTIEASCPIKSSCTVFHDRILVTPNEHKYALKMVCTEKPGNTLTIKVCNTKIEASMALVDAKPIIELAPVDQTAYIREKDERCKTWMCRVRDEGLQVILEPFKNLFGSYIGIFYTFIISIVALLAIIYVLLPICFKLRDTLRKHEDAYKREMKIR

SEQ ID NO: 1961 - protein, 1441 aa, Artificial Sequence; identical to SEQ ID NO: 1930
  derived and/or modified protein sequence (wt) from LACV__KP271111.1__GP

SEQ ID NO: 1962 - protein, 1420 aa, Artificial Sequence
  derived and/or modified protein sequence (wt) from OROV(BeAn19992)__NC_005775.1__GP
MANLIIISMVLGVAYGHPLSTSQIGDRCFAGGNLFKEMNLSVGLGEICVKDDISIVKSTTVFSKNKPALEATTKFYRSFIVKDWSECNPVLDKFGNFMVLSVDDNGHIIPKMYTCRAACDIRLNKDNAEIILSSTKLNHFEIVGTTSTSGWFKNTITNNLEHTCEHVTVNCGQKSVKFHACFRQHRGCIRFFKGTYMPYSMIEAMCVNIELIILTLYIFAAIIFALIITKSYVAYLLLPLFYPVTWFYGKVYKKINSCPNCLLASHPFTSCPKFCICGSRFSCTEALKVHRMGKDCLGYKSLSKARQMCKSKSWSFTAAILTGLILMEFISPIAGERMYKLEELADEFIKLTEQVNILEREMEVLKQSIIVMFAIILVLLLFENMIFNRLFRIFYRSCSMCGLIHYRPGLKIDLTKTNRCGSCICGFDEQQSSGFEYEIFLKDMHVQKESCKFSPRVNHFRNIKALLFALVICATIYTVYADEDCLSKDIKITYQELHNCIGPKIMGDTCVSKSELYSDLFSKNLVTEYDKKYFEPDTVNDQFNKIEFAQDAHRMILLERILYKTECEMLSLKKNSGPYNVAWRTYLKNHNIDLCSRHNYKMICQCINTHSMCNNTDIDYNKEIETYYKSNAAAYRADLNTIMDTLKTAFRGLTKVLIENYIEKDDSDALKALFSNITDSVQDNYQMIGILKFASKLLDINLGRSTRSAHHSIMTNEIPKSNPFTDYSYSNLNIKECMSPESLKCFKKRGSTPHTNHLLCKIDNKYKAFDWPEIETIQKGQKLCLGDSHCNLEFTAITADKIMSLTNCYKESFTAQPADMQAGIKKCSADEIGECTTLEDKTWPIIFCGGKYYYSDSKEHAKDGSINNYCLTNKCSEQRFPIHENWFKKCNWDKTHKEFSTMRQINYNDITSYRKAIESEIGTDLMTHHYKPTKNLPHVVPRYHSIDVQGTESTEGIINGFIQNTIPAISGLGVGYHLNFQSNQLFDIVIFVKKAVYKAQYQKAYTTGPSISINIEHNERCTGHCPEKIPAKEGWLTFSKEHTSSWGCEEYGCLAIDTGCLYGSCQDVIRPELDVYKKIGSEVSLIEICITLPHETYCNDMDILEPIIGDKLSASFQNTQTNQLPTLIAYKKGKIYTGQINDIGNTALQCGSIQVINGSTIGTGSPKFDYICHAMRRKDVIVRKCFNDNYQSCTRLEKRNDLIPYRKGDVIEVSKTGSNMGQMTFKIELGDINYKIFTKSIDLQMSGICAGCIDCAEGISCSINAEVPAETVCHCKTNCEDFINNIVFSPQIKNYNIKVHCKSKVEKITAHICGRDIDLQLTIKPYNQKIDLSQLDESNYIREEDLQCGTWLCKVQKEGIDIIFKGLFSGLGRYWTILIYSIIGVVIIVILVYILLPIGRLLKAFLIRHEIEYAMEQKIK

SEQ ID NO: 1963 - protein, 1420 aa, Artificial Sequence
  derived and/or modified protein sequence (wt) from OROV(BeH759021)__KP691607.1__GP
MANLIIISMVLSVAYGHPLSTSQIGDRCFAGGNLFKEMNLSVGLGEICVKDDISIVKSTTVFSKNRPALEATTKFYRSFIVKDWSECNPVLDKFGNFMVLSVDDNGHIMPKMYTCRAACDIRLNKDNAEIILSSTKLNHFEIVGTTSTSGWFKNTITNNLEHTCEHVTVNCGQKSVKFHACFRQHRGCIRFFKGTYMPYSMIEAMCVNIELIILTLYIFAAIIFALIITKSYVAYLLLPLFYPVTWFYGKVYKKINSCPNCLLASHPFTSCPKICICGSRFSCTEALKVHRMGKDCLGYKSLSKARQMCKSKSWSFTAAILTGLILMEFISPIAGERMYKLEELADEFIKLTEQVNILEREMEVLKQSIIVMFAIILVLLLFENMIFNRLFSIFYRSCSMCGLIHYRPGLKIDLTKTNKCGSCICGFNEQQSSGFEYEIFLKDMHIQKESCKFSPRVNHFRNIKALLFALVICATIYTVYADEDCLSKDIKITYQELHNCIGPKIMGNTCVSKNELYSDLFSKNLVTEYDKKYFEPDTVNDQFNKIEFAQDAHRMILLERILYKTECEMLSLKKNSGPYNVAWRTYLKNHNIDLCSRHNYKMICQCINTHSMCKNTDIDYNKEIETYYKSNAAAYRADLNTIMDTLKTAFRGLTKVLIENYIEKDDSDALKALFSNITDSVQDNYQMIGILKFASKLLDINLGRSTRSAHHSIMTNEIPKSNPFTDYSYSNVNIKECMSPESLKCFKKRDSTPHTNHLLCKIDSKYKAFDWPEIETIQKGQKLCLGDSHCNLEFTAITADKIMSLTNCYKESFTAQPADMQTGIKKCSADEIGECTTLEDKTWPIVFCGGKYYYSDSKEHAKDGSINNYCLTNKCSEQRFPIHENWFKKCNWDKTHKEFSTMRQINYNDITSYRKAIESEIGSDLMTHHYKPTKNLPHVVPRYHSIDVQGTESTEGIINGFIQNTIPAISGLGVGYHLNFKGNQLFDIVIFVKKAVYKAQYQKAYTTGPSISINIEHNERCTGHCPEKIPAKEGWLTFSKEHTSSWGCEEYGCLAIDTGCLYGSCQDVIRPELDVYKKIGSEVSLIEICITLPHETYCNDMDILEPIIGDKLSASFQNTQTNQLPTLIAYKKGKIYTGQINDIGNTALQCGSIQVINGSTIGTGSPKFDYICHAMRRKDVIVRKCFNDNYQSCTRLEKRNDLIPYRKGDVIEVSKTGSNMGQMTFKIELGDVNYKIFTKSIDLQMSGICAGCIDCAEGISCSINAEVPAETVCHCKTNCEDFINNIVFSPQIKNYNIKVHCKSKVEKIIAHICGRDIDLQLTVKPYNQKIDLSQLDESNYIREEDLQCGTWLCKVQKEGVDIIFKGLFSGLGRYWTILIYSIIGVVIIVILVYILLPIGRLLKAFLIRHEIEYAMEQKIK

SEQ ID NO: 1964 - protein, 1420 aa, Artificial Sequence
  derived and/or modified protein sequence (wt) from OROV(BeH759022)__KP691610.1__GP
MANLIIISMALSVAYGHPLSTSQIGDRCFAGGNLFKEMNLSVGLGEICVKDDISIVKSTTVFSKNRPALEATTKFYRSFIVKDWSECNPVLDKFGNFMVLSVDDNGHIMPKMYTCRAACDIRLNKDNAEIILSSTKLNHFEIVGTTSTSGWFKNTITNNLEHTCEHVTVNCGQKSVKFHACFRQHRGCIRFFKGTYMPYSMIEAMCVNIELIILTLYIFAAIIFALIITKSYVAYLLLPLFYPVTWFYGKVYKKINSCPNCLLASHPFTSCPKICICGSRFSCTEALKVHRMGKDCLGYKSLSKARQMCKSKSWSFTAAILTGLILMEFISPIAGERMYKLEELADEFIKLTEQVNILEREMEVLKQSIIVMFAIILVLLLFENMIFNRLFSIFYRSCSMCGLIHYRPGLKIDLTKTNKCGSCICGFNEQQSSGFEYEIFLKDMHIQKESCKFSPRVNHFRNIKALLFALVICATIYTVYADEDCLSKDIKITYQELHNCIGPKIMGNTCVSKNELYSDLFSKNLVTEYDKKYFEPDTVNDQFNKIEFAQDAHRMILLERILYKTECEMLSLKKNSGPYNVAWRTYLKNHNIDLCSRHNYKMICQCINTHSMCKNTDIDYNKEIETYYKSNAAAYRADLNTIMDTLKTAFRGLTKVLIENYIEKDDSDALKALFSNITDSVQDNYQMIGILKFASKLLDINLGRSTRSAHHSIMTNEIPKSNPFTDYSYSNVNIKECMSPESLKCFKKRDSTPHTNHLLCKIDSKYKAFDWPEIETIQKGQKLCLGDSHCNLEFTAITADKIMSLTNCYKESFTAQPADMQTGIKKCSADEIGECTTLEDKTWPIVFCGGKYYYSDSKEHAKDGSINNYCLTNKCSEQRFPIHENWFKKCNWDKTHKEFSTMRQINYNDITSYRKAIESEIGSDLMTHHYKPTKNLPHVVPRYHSIDVQGTESTEGIINGFIQNTIPAISGLGVGYHLNFKGNQLFDIVIFVKKAVYKAQYQKAYTTGPSISINIEHNERCTGHCPEKIPAKEGWLTFSKEHTSSWGCEEYGCLAIDTGCLYGSCQDVIRPELDVYKKIGSEVSLIEICITLPHETYCNDMDILEPIIGDKLSASFQNTQTNQLPTLIAYKKGKIYTGQINDIGNTALQCGSIQVINGSTIGTGSPKFDYICHAMRRKDVIVRKCFNDNYQSCTRLEKRNDLIPYRKGDVIEVSKTGSNMGQMTFKIELGDVNYKIFTKSIDLQMSGICAGCIDCAEGISCSINAEVPAETVCHCKTNCEDFINNIVFSPQIKNYNIKVHCKSKVEKIIAHICGRDIDLQLTVKPYNQKIDLSQLDESNYIREEDLQCGTWLCKVQKEGVDIIFKGLFSGLGRYWTILIYSIIGVVIIVILVYILLPIGRLLKAFLIRHEIEYAMEQKIK

SEQ ID NO: 1965 - protein, 1420 aa, Artificial Sequence
  derived and/or modified protein sequence (wt) from OROV(BeH759040)__KP691616.1__GP
MANLIIISMILSVAYGHPLSTSQIGDRCFAGGNLFKEMNLSVGLGEICVKDDISIVKSTTVFSKNRPALEATTKFYRSFIVKDWSECNPVLDKFGNFMVLSVDDNGHIMPKMYTCRAACDIRLNKDNAEIILSSTKLNHFEIVGTTSTSGWFKNTITNNLEHTCEHVTVNCGQKSVKFHACFRQHRGCIRFFKGTYMPYSMIEAMCVNIELIILTLYIFAAIIFALIITKSYVAYLLLPLFYPVTWFYGKVYKKINSCPNCLLASHPFTSCPKICICGSRFSCTEALKVHRMGKDCLGYKSLSKARQMCKSKSWSFTAAILTGLILMEFISPIAGERMYKLEELADEFIKLTEQVNILEREMEVLKQSIIVMFAIILVLLLFENMIFNRLFSIFYRSCSMCGLIHYRPGLKIDLTKTNKCGSCICGFNEQQSSGFEYEIFLKDMHIQKESCKFSPRVNHFRNIKALLFALVICATIYTVYADEDCLSKDIKITYQELHNCIGPKIMGNTCVSKNELYSDLFSKNLVTEYDKKYFEPDTVNDQFNKIEFAQDAHRMILLERILYKTECEMLSLKKNSGPYNVAWRTYLKNHNIDLCSRHNYKMICQCINTHSMCKNTDIDYNKEIETYYKSNAAAYRADLNTIMDTLKTAFRGLTKVLIENYIEKDDSDALKALFSNITDSVQDNYQMIGILKFASKLLDINLGRSTRSAHHSIMTNEIPKSNPFTDYSYSNVNIKECMSPESLKCFKKRDSTPHTNHLLCKIDSKYKAFDWPEIETIQKGQKLCLGDSHCNLEFTAITADKIMSLTNCYKESFTAQPADMQTGIKKCSADEIGECTTLEDKTWPIVFCGGKYYYSDSKEHAKDGSINNYCLTNKCSEQRFPIHENWFKKCNWDKTHKEFSTMRQINYNDITSYRKAIESEIGSDLMTHHYKPTKNLPHVVPRYHSIDVQGTESTEGIINGFIQNTIPAISGLGVGYHLNFKGNQLFDIVIFVKKAVYKAQYQKAYTTGPSISINIEHNERCTGHCPEKIPAKEGWLTFSKEHTSSWGCEEYGCLAIDTGCLYGSCQDVIRPELDVYKKIGSEVSLIEICITLPHETYCNDMDILEPIIGDKLSASFQNTQTNQLPTLIAYKKGKIYTGQINDIGNTALQCGSIQVINGSTIGTGSPKFDYICHAMRRKDVIVRKCFNDNYQSCTRLEKRNDLIPYRKGDVIEVSKTGSNMGQMTFKIELGDVNYKIFTKSIDLQMSGICAGCIDCAEGISCSINAEVPAETVCHCKTNCEDFINNIVFSPQIKNYNIKVHCKSKVEKIIAHICGRDIDLQLTVKPYNQKIDLSQLDESNYIREEDLQCGTWLCKVQKEGVDIIFKGLFSGLGRYWTILIYSIIGVVIIVILVYILLPIGRLLKAFLIRHEIEYAMEQKIK

SEQ ID NO: 1966 - protein, 1420 aa, Artificial Sequence
  derived and/or modified protein sequence (wt) from OROV(BeH759146)__KP691631.1__GP
MANLIIISMVLSVAYGHPLSTSQIGDRCFAGGNLFKEMNLSVGLGEICVKDDISIVKSTTVFSKNRPALEATTKFYRSFIVKDWSECNPVLDKFGNFMVLSVDDNGHIMPKMYTCRAACDIRLNKDNAEIILSSTKLNHFEIVGTTSTSGWFKNTITNNLEHTCEHVTVNCCQKSVKFHACFRQHRGCIRFFKGTYMPYSMIEAMCVNIELIILTLYIFAAIIFALIITKSYVAYLLLPLFYPVTWFYGKVYKKINSCPNCLLASHPFTSCPKICICGSRFSCTEALKVHRMGKDCLGYKSLSKARQMCKSKSWSFTAAILTGLILMEFISPIAGERMYKLEELADEFIKLTEQVNILEREMEVLKQSIIVMFAIILVLLLFENMIFNRLFSIFYRSCSMCGLIHYRPGLKIDLTKTNKCGSCICGFNEQQSSGFEYEIFLKDMHIQKESCKFSPRVNHFRNIKALLFALVICATIYTVYADEDCLSKDIKITYQELHNCIGPKIMGNTCVSKNELYSDLFSKNLVTEYDKKYFEPDTVNDQFNKIEFAQDAHRMILLERILYKTECEMLSLKKNSGPYNVAWRTYLKNHNIDLCSRHNYKMICQCINTHSMCKNTDIDYNKEIETYYKSNAAAYRADLNIIMDTLKTAFRGLTKVLIENYIEKDDSDALKALFSNITDSVQDNYQMIGILKFASKLLDINLGRSTRSAHHSIMTNEIPKSNPFTDYSYSNVNIKECMSPESLKCFKKRDSTPHTNHLLCKIDSKYKAFDWPEIETIQKGQKLCLGDSHCNLEFTAITADKIMSLTNCYKESFTAQPADMQTGIKKCSADEIGECTTLEDKTWPIVFCGGKYYYSDSKEHAKDGSINNYCLTNKCSEQRFPIHENWFKKCNWDKTHKEFSTMRQINYNDITSYRKAIESEIGSDLMTHHYKPTKNLPHVVPRYHSIDVQGTESTEGIINGFIQNTIPAISGLGVGYHLNFKGNQLFDIVIFVKKAVYKAQYQKAYTTGPSISINIEHNERCTGHCPEKIPAKEGWLTFSKEHTSSWGCEEYVCLAIDTGCLYGSCQDVIRPELDVYKKIGSEVSLIEICITLPHETYCNDMDILEPIIGDKLSASFQNTQTNQLPTLIAYKKGKIYTGQINDIGNTALQCGSIQVINGSTIGTGSPKFDYICHAMRRKDVIVRKCFNDNYQSCTRLEKRNDLIPYRKGDVIEVSKTGSNMGQMTFKIELGDVNYKIFTKSIDLQMSGICAGCIDCAEGISCSINAEVPAETVCHCKTNCEDFINNIVFSPQIKNYNIKVHCKSKVEKIIAHICGRDIDLQLTVKPYNQKIDLSQLDESNYIREEDLQCGTWLCKVQKEGVDIIFKGLFSGLGRYWTILIYSIIGVVIIVILVYILLPIGRLLKAFLIRHEIEYAMEQKIK

SEQ ID NO: 1967 - protein, 1420 aa, Artificial Sequence
  derived and/or modified protein sequence (wt) from OROV(BeH759620)__KP691622.1__GP
MANLIIISMVLSVAYGHPLSTSQIGDRCFAGGNLFKEMNLSVGLGEICVKDDISIVKSTTVFSKNRPALEATTKFYRSFIVKDWSECNPVLDKFGNFMVLSVDDNGHIMPKMYTCRAACDIRLNKDNAEIILSSTKLNHFEIVGTTSTSGWFKNTITNNLEHTCEHVTVNCGQKSIKFHACFRQHRGCIRFFKGTYMPYSMIEAMCVNIELIILTLYIFAAIIFALIITKSYVAYLLLPLFYPVTWFYGKVYKKINSCPNCLLASHPFTSCPKICICGSRFSCTEALKVHRMGKDCLGYKSLSKARQMCKSKSWSFTAAILTGLILMEFISPIAGERMYKLEELADEFIKLTEQVNILEREMEVLKQSIIVMFAIILVLLLFENMIFNRLFSIFYRSCSMCGLIHYRPGLKIDLTKTNKCGSCICGFNEQQSSGFEYEIFLKDMHIQKESCKFSPRVNHFRNIKALLFALVICATIYTVYADEDCLSKDIKITYQELHNCIGPKIMGNTCVSKNELYSDLFSKNLVTEYDKKYFEPDTVNDQFNKIEFAQDSHRMILLERILYKTECEMLSLKKNSGPYNVAWRTYLKNHNIDLCSRHNYKMICQCINTHSMCKNTDIDYNKEIETYYKSNAAAYRADLNTIMDTLKTAFRGLTKVLIENYIEKDDSDALKALFSNITDSVQDNYQMIGILKFASKLLDINLGRSTRSAHHSIMTNEIPKSNPFTDYSYSNVNIKECMSPESLKCFKKRDSTPHTNHLLCKIDSKYKAFDWPEIETIQKGQKLCLGDSHCNLEFTAITADKIMSLTNCYKESFTAQPADMQTGIKKCSADEIGECTTLEDKTWPIVFCGGKYYYSDSKEHAKDGSINNYCLTNKCSEQRFPIHENWFKKCNWDKTHKEFSTMRQINYNDITSYRKAIESEIGSDLMTHHYKPTKNLPHVVPRYHSIDVQGTESTEGIINGFIQNTIPAISGLGVGYHLNFKGNQLFDIVIFVKKAVYKAQYQKAYTTGPSISINIEHNERCTGHCPEKIPAKEGWLTFSKEHTSSWGCEEYGCLAIDTGCLYGSCQDVIRPELDVYKKIGSEVSLIEICITLPHETYCNDMDILEPIIGDKLSASFQNTQTNQLPTLIAYKKGKIYTGQINDIGNTALQCGSIQVINGSTIGTGSPKFDYICHAMRRKDVIVRKCFNDNYQSCTRLEKRNDLIPYRKGDVIEVSKTGSNMGQMTFKIELGDVNYKIFTKSIDLQMSGICAGCIDCAEGISCSINAEVPAETVCHCKTNCEDFINNIVFSPQIKNYNIKVHCKSKVEKIIAHICGRDIDLQLTVKPYNQKIDLSQLDESNYIREEDLQCGTWLCKVQKEGVDIIFKGLFSGLGRYWTILIYSIIGVVIIVILVYILLPIGRLLKAFLIRHEIEYAMEQKIK

SEQ ID NO: 1968 - protein, 1420 aa, Artificial Sequence
  derived and/or modified protein sequence (wt) from OROV(BeAn19991)__KP052851.1__GP
MANLIIISMVLGVAYGHPLSTSQIGDRCFAGGNLFKEMNLSVGLGEICVKDDISIVKSTTVFSKNKPALEATTKFYRSFIVKDWSECNPVLDKFGNFMVLSVDDNGHIIPKMYTCRAACDIRLNKDNAEIILSSTKLNHFEIVGTTSTSGWFKNTITNNLEHTCEHVTVNCGQKSVKFHACFRQHRGCIRFFKGTYMPYSMIEAMCVNIELIILTLYIFAAIIFALIITKSYVAYLLLPLFYPVTWFYGKVYKKINSCPNCLLASHPFTSCPKICICGSRFSCTEALKVHRMGKDCLGYKSLSKARQMCKSKSWSFTAAILTGLILMEFISPIAGERMYKLEELADEFIKLTEQVNILEREMEVLKQSIIVMFAIILVLLLFENMIFNRLFRIFYRSCSMCGLIHYRPGLKIDLTKTNRCGSCICGFDEQQSSGFEYEIFLKDMHVQKESCKFSPRVNHFRNIKALLFALVICATIYTVYADEDCLSKDIKITYQELHNCIGPKIMGDTCVSKSELYSDLFSKNLVTEYDKKYFEPDTVNDQFNKIEFAQDAHRMILLERILYKTECEMLSLKKNSGPYNVAWRTYFKNHNIDLCSRHNYKMICQCINTHSMCKNTDIDYNKEIETYYKSNAAAYRADLNTIMDTLKTAFRGLTKVLIENYIEKDDSDALKALFSNITDSVQDNYQMIGILKFASKLLDINLGRSTRSAHHSIMTNEIPKSNPFTDYSYSNLNIKECMSPESLKCFKKRDSTPHTNHLLCKIDNKYKAFDWPEIETIQKGQKLCLGDSHCNLEFTAITADKIMSLTNCYKESFTAQPADMQAGIKKCSADEIGECTTLEDKTWPIIFCGGKYYYSDSKEHAKDGSINNYCLTNKCSEQRFPIHENWFKKCNWDKTHKEFSTMRQINYNDITSYRKAIESEIGTDLMTHHYKPTKNLPHVVPRYHSIDVQGTESTEGIINGFIQNTIPAISGLGVGYHLNFKGNQLFDIVIFVKKAVYKAQYQKAYTTGPSISINIEHNERCTGHCPEKIPAKEGWLTFSKEHTSSWGCEEYGCLAIDTGCLYGSCQDVIRPELDVYKKIGSEVSLIEICITLPHETYCNDMDILEPIIGDKLSASFQNTQTNQLPTLIAYKKGKIYTGQINDIGNTALQCGSIQVINGSTIGTGSPKFDYICHAMRRKDVIVRKCFNDNYQSCTRLEKRNDLIPYRKGDVIEVSKTGSNMGQMTFKIELGDINYKIFTKSIDLQMSGICAGCIDCAEGISCSINAEVPAETVCHCKTNCEDFINNIVFSPQIKNYNIKVHCKSKVEKITAHICGRDIDLQLTIKPYNQKIDLSQLDESNYIREEDLQCGTWLCKVQKEGIDIIFKGLFSGLGRYWTILIYSIIGVVIIVILVYILLPIGRLLKAFLIRHEIEYAMEQKIK

SEQ ID NO: 1969 - protein, 1420 aa, Artificial Sequence
  derived and/or modified protein sequence (wt) from OROV(Tr9760)__AF312381.2__GP
MANLIIISMVLSIAYGHPLSTSQIGDRCFAGGNLFKEMNLSVGLGEICVKDDISIVKSTTVFSKNKLALEATTKFYRSFIVKDWSECNPVLDKFGNFMVLSVDDNGHTIPKMYTCRAACDIRLNKDNAEIILSSTKLNHFEIVGTTSTSGWFKNTITNNLEHTCEHVTVNCGQKSVKFHACFRQHRGCVRFFKGTYMPHSMIEAMCVNIELIILTLYIFAAIIFALIITKSYVAYLLLPLFYPATWFYGKVYKKINSCPNCLLASHPFTSCPKICICGSRFSCTEALKVHRMGKDCLGYKSLSKARQMCKSKSWSFTAAILTGLILMEFISPIAGERMYKLEELADEFIKLTEQVNILEREMEVLKQSIIVMFAIILVLLLFENMIFNRLFRIFYRSCSMCGLIHYRPGLKIDLTKTNRCGSCICGFDEQQSSGFEYEIFLTDMHVQKESCKFSPRVNHFRNTKALLFALVICATIYTVYADEDCLSKDIKITYQELHNCIGPKIMGDTCVSKSELYSDLFSKNLVTEYDKKYFEPDTVNDQFNKIEFAQDAHRMILLERILYKTECEMLSLKKNSGPYNVAWRTHLKNHNIDLCSRHNYKMICQCINAHSMCKNTDIDYNKEIETYYKSNAAAYRAGLNTIMDTLKTAFRGLTKVLIENYIEKDDSDALKALFSNITDSVQDNYQMIGILKFASKLLDINLGRSTRSAHHSIMTNEIPKSNPFTDYSYSNVNIKECMSPESLKCFKKRDSTPHTNHLLCKIDNKYKAFDWPEIETIQKGQKLCLGDSHCNLEFTAITADRIMSLTNCYKESFTAQPADMQAGIKKCSADEIGECTTLEDKTWPIVFCSGKYYYSDSKEHAKDGSINNYCLTNKCSEQRFPIHENWFKKCNWDKTHKEFRPYETNNYNDITSYRKAIESEIGTDLMTHHYKPTKNLPHVVPRYHSIDVQGTESTEGIINGFIQNTIPAISGLDVGYHLNFKGNQLFDIVIFVKKAVYKAQYQKAYTTGPSISINIEHNERCTGHCPEKIPAKEGWLTFSKEHTSSWGCEEYGCLAIDTGCLYGSCQDVIRPELDVYKKIGSEASLIEICITLPHETYCNDMDILEPIIGDKLSASFQNTQTNQLPTLIAYKKGKIYTGQINDIGNTALQCGSIQVINGSTIGTGSPKFDYICHAMRRKDVIVRKCFNDNYQSCTRLEKRNDLIPYRKGDVIEVSKTGSNMGQMTFKIELGDINYKIFTKSVDLQMSGICAGCIDCAEGISCSINAEVPAETVCHCKTNCEDFINNIVFSPQIKNYNIKVHCKSKVEKITAHICGRDIDLQLTVKPYNQKIDLSQLDESNYIREEDLQCGTWLCKVQKEGIDIMFKGLFSGLGRYWTILIYSIIGVVIIVILVYILLPIGRLLKAFLIRHEIEYAMEQKIK

SEQ ID NO: 1970 - protein, 1420 aa, Artificial Sequence
  derived and/or modified protein sequence (wt) from OROV(TRVL-9760)__KC759123.1__GP
MANLIIISMVLSIAYGHPLSTSQIGDRCFAGGNLFKEMNLSVGLGEICVKDDISIVKSTTVFSKNKLALEATTKFYRSFIVKDWSECNPVLDKFGNFMVLSVDDNGHIIPKMYTCRAACDIRLNKDNAEIILSSTKLNHFEIVGTTSTSGWFKNTITNNLEHTCEHVTVNCGQKSVKFHACFRQHRGCIRFFKGTYMPYSMIEAMCVNIELIILTLYIFAAIIFALIITKSYVAYLLLPLFYPATWFYGKVYKKINSCPNCLLASHPFTSCPKICICGSRFSCTEALKVHRMGKDCLGYKSLSKARQMCKSKSWSFTAAILTGLILMEFISPIAGERMYKLEELAAEFIKLTEQVNILEREMEVLKQSIIVMFAIILVLLLFENMIFNRLFRIFYRSCSMCGLIHYRPGLKIDLTKTNRCGSCICGFDEQQSSGFEYEIFLKDMHVQKESCKFSPRVNHFRNTKALLFALVICATIYTVYADEDCLSKDIKITYQELHNCIGPKIMGDTCVSKSELYSDLFSKNLVTEYDKKYFEPDTVNDQFNKIEFAQDAHRMILLERILYKTECEMLSLKKNSGPYNVAWRTYLKNHNIDLCSRHNYKMICQCINAHSMCKNTDIDYNKEIETYYKSNAAAYRADLNTIMDTLKTAFRGLTKVLIENYIEKDDSDALKALFSNITDSVQDNYQMIGILKFASKLLDINLGRSTRSAHHSIMTNEIPKSNPFTDYSYSNVNIKECMSPESLKCFKKRDSTPHTNHLLCKIDNKYKAFDWPEIETIQKGQKLCLGDSHCNLEFTAITADRIMSLTNCYKESFTAQPADMQAGIKKCSADEIGECTTLEDKTWPIVFCSGKYYYSDSKEHAKDGSINNYCLTNKCSEQRFPIHENWFKKCNWDKTHKEFSTMRQINYNDITSYRKAIESEIGTDLMTHHYKPTKNLPHVVPRYHSIDVQGTESTEGIINGFIQNTIPAISGLGVGYHLNFKGNQLFDIVIFVKKAVYKAQYQKAYTTGPSISINIEHNERCTGHCPEKIPAKEGWLTFSKEHTSSWGCEEYGCLAIDTGCLYGSCQDVIRPELDVYKKIGSEASLIEICITLPHETYCNDMDILEPIIGDKLSASFQNTQTNQLPTLIAYKKGKIYTGQINDIGNTALQCGSIQVINGSTIGTGSPKFDYICHAMRRKDVIVRKCFNDNYQSCTRLEKRNDLIPYRKGDVIEVSKTGSNMGQMTFKIELGDINYKIFTKSVDLQMSGICAGCIDCAEGISCSINAEVPAETVCHCKTNCEDFINNIVFSPQIKNYNIKVHCKSKVEKITAHICGRDIDLQLTVKPYNQKIDLSQLDESNYIREEDLQCGTWLCKVQKEGIDIMFKGLFSGLGRYWTILIYSIIGVVIIVILVYILLPIGRLLKAFLIRHEIEYAMEQKIK

SEQ ID NO: 1971 - protein, 1420 aa, Artificial Sequence
  derived and/or modified protein sequence (wt) from OROV(TVP-19244/DEI-216)__KP795073.1__GP
MANLIIISMILGIAYGHPLSTSQIGDRCFAGGILFKEMNLSVGLGEICVKDDISIVKSTTAFSKNALALEATTKFYRSFIVKDWSECNPVLDKFGNFMVLNVDDNGHLVPKMYTCRAACDIRLNKDNAEIILSSTKLNHFEIVGTTSTSGWFKNTITNNLEHTCEHVTVNCGQKSVKFHACFRQHRGCIRFFKGTYMPYSMIEAMCVNIELIILTLYIFAAIIFALIITKSYIAYLLLPLFYPVTWLYGKVYKRINSCPNCLLASHPFTSCPKICICGSRFSCTEALKVHRMGKDCLGYKSLSKARQMCKSKSWSFTAAILTGLILMEFVSPIAGERMYKLEELADDYIELTEQVNILGKEIKILKQSIIVMLAIILILLLSENIIFNYLFSTLYRSCSMCGLIHYRPGLKVDSTKTNKCGSCICGFDEQQSSGFEYEVFLKDMHVQRESCKFGPRVNHFRNTKILLFTVAICTSFYTVYADEDCLSKNIRITYQELHNCIGPHIMGDTCMSKSELYSDLLSKNLITEYDKKYFEPDTVNDQFNKIEFAQDAHRMILLERILYKTECEMLSLKKNSGPYNVAWRTYLKNHNIDLCSRHNYKMICQCINTHSMCKNTDIDFNKEIETYYKANAAAYRSDFNTIIDTLKTAFRGLTKVLIENYIEKDDSDALKALFSNITDSVQDNYQMVGVLKFASKLLNISLGRTTRSAQHSIMTNEIPKSNPFTDYSYSSVNIKECMSPESLKCFKKRDSAPHMNHLLCKMDNKYKAFDWPEIETVQKGQKLCLGDSHCNLEFTAITADKIMSLTNCYKESFTAQPADMQTGIKKCSADEIGECITLEDKSWPIVFCGDKYYYSDGKEHAKDGSINNYCLANKCSEQRFPIHKNWFKKCNWDKTHKEFTTMRQINYNDITSYRKAIESEIGTDLMTHHYKPTKNLPHVVPRYHSIDVQGTESTEGIINGFIQNTIPAISGLGVGYHLGFKGNQLFDIVIFVKKAVYKAQYQKVYTTGPSISINIEHNEKCTGHCPEKIPAKEGWLTFSKEHTSSWGCEEYGCLAIDTGCLYGSCQDVIRPELDIYKKIGSEASLIEICITLPHETYCNDMDILEPIIGDKLSASFQNTQTNQLPNLMAYKKGKVYTGQINDVGNTALQCGSIQVVNGSTIGSGNPKFDYICHAMRRKDVIVRKCFNDNYQSCTRLNPRNDLIPYRKGDIIEISKTGSNMGQMTFKIELGDINYKIFTKSVDLQMSGICAGCIDCAEGISCSINADVSAETVCHCKTNCEDFISNIVISPQIKTYNIKVHCKSKVKKITANICGRNIDLQLTVKPYNQKIDLSQLDESNYIKEEDLQCGTWLCKVQKEGIDIVFKGLFSGLGKYWAILIYSIIGIIVVILLIYVLLPIGRLLKAFLIKNEIEYTMEQKIK

SEQ ID NO: 1972 - protein, 1420 aa, Artificial Sequence
  derived and/or modified protein sequence (wt) from OROV(TVP-19249/GML-444672)__KP795076.1__GP
MANLIIFSIILGIAYGHPLSTSQIGDRCFAGGSLFKEMNLSVGLGEICVKDDISIVKSTTAFSKNTLALEATTKFYRSFIVKDWSECNPVLDKLGNFMVLNVDDNGHLVPRMYTCRAACDIRLNKDNAEIILSSTKLNHFEIVGTTSTSGWFKNTITNNLEHTCEHVTVNCGQKSVKFHACFRQHRGCIRFFKGTYMPYSMIEAMCINIELIILTLYIFAAIIFALIITKSYIAYLLLPLFYPVTWLYGKVYKRINSCSNCLLASHPFTSCPKICICGSRFSCTEALKVHRMGKDCLGYKSLSKARQMCKSKSWSFTAAILTGLILMEFVSPIAGERMYKLEELADDYIEMAERVGMLEKEIKVLKQFTIVMLVIILILLLFENTIFNYLFNTLYRSCSMCGLIHYRPGLKVDLTKTNKCGSCICGFDEQQSSGFEYEVFLKDMHIQRESCKFGPRVNHFRNTKILLFTIAICTSFYTVYADEDCLSKNIKITYQELHNCIGPYIMGDTCVSKSELYSDLLSKNLITEYDKKYFEPDTVNDQFNKIEFAQDAHRMILLERILYKTECEMLSLKKNSGPYNVAWRTYLKNHNIDLCSRHNYKMICQCINMHSMCKNTDIDFNNEIETYYKANAAAYRSDFYTIIDTLKTAFRGLTKVLIENYIEKDDSDALKALFSNITNSVQDNYQMVGVLKFASKLLNISLGRSTRSAQHSIMTNEIPKSNPFTDYSYSSVNIKECMSPESLKCFKKRDSVPHTNHLLCKMDNKYKAFDWPEIETVQKGQKLCLGDSHCNLEFTAITADKIMSLTNCYKESFTAQPADMQTGIKKCSADEIGECITLEDKAWPIVVCGDKYYYSDGKEHAKDGSINNYCLANKCSEQRFPIHKNWFKKCNWDKTHKEFTTMRQINYNDITSYRKAIESEIGTDLMTHHYKPTKNLPHVVPRYHSIDVQGTESTEGIINGFIQNTIPAISGLGVGYHLGFRGNQLFDIVIFVKKAVYKAQYQKVYTTGPSISINIEHNEKCTGHCPEKIPAKEGWLTFSKEHTSSWGCEEYGCLAIDTGCLYGSCQDVIRPELDIYKKIGSEASLIEICITLPHETYCNDMDILEPIIGDKLSASFQNTQTNQLPVLMAYKKGKVYTGQINDVGNTALQCGSIQVVNGSTIGSGNPKFDYICHAMRRKDVIVRKCFNDNYQSCTRLDARNDLIPYRKGDIIEISKTGSNMGQMTFKIELGDINYKIFTKSVDLQMSGICAGCIDCAEGISCSINADVSAETVCHCKTNCEDFISNIVISPQIKTYNIKVHCKSKVEKITANICGRNIDLQLTVKPYNQKIDLSQLDESNYIKEEDLQCGTWLCKVQKEGIDIVFKGLFSGLGKYWTILIYSIIGIIVIVLLIYVLLPIGRLLKAFLIKNEIEYTMEQKIK

SEQ ID NO: 1973 - protein, 1420 aa, Artificial Sequence
  derived and/or modified protein sequence (wt) from OROV(TVP-19254/GML-480914)__KP795082.1__GP
MANLIIISMVLSVAYGHPLSTSQIGDRCFAGGNLFKEMNLSVGLGEICVKDDISIVKSTTAFSKNKPALEATTKFYRSFIVKDWSECNPVLDKFGNFMVLSVDDNGHIIPKMYTCRAACDIRLNKDNAEIILSSTKLNHFEIVGTTSTSGWFKNTITNNLEHTCEHVTVNCGQKSVKFHACFRQHRGCIRFFKGTYMPYSMIEAMCVNIELIILTLYIFAAIIFALIITKSYVAYLLLPLFYPVTWFYGKVYKKINSCPNCLLASHPFTSCPKICICGSRFSCTEALKVHRMGKDCLGYKSLSKARQMCKSKSWSFTAAILTGLILMEFISPIAGERMYKLEELADEFIKLTEQVNILEREMEVLKQSVIVMLAIILVLLLFENMIFNRLFRIFYRSCSMCGLIHYRPGLKIDLTKTNRCGSCICGFDEQQSSGFEYEIFLKDMHIQKESCKFSPRVNHFRNIKALLFALVICATIYTVYADEDCLSKNIKITYQELHNCIGPKIMGDTCVSKSELYSDLFSKNLVTEYDKKYFEPDTINDQFNKIEFAQDAHRMILLERILYKTECEMLSLKKNSGPYNVAWRTYLKNHNIDLCSRHNYKMICQCINTHSMCKNTDIDYNKEIETYYKSNAAAYRADLNTIIDTLKTAFRGLTKVLIENYIEKDDSDALKALFSNITDSVQDNYQMIGILKFASKLLDINLGRSTRSAHHSIMTNEIPKSNPFTDYSYSNVNIKECMSPESLKCFKKRDSTPHTNHLLCKIDNKYKAFDWPEIETIQKGQKLCLGDSHCNLEFTAITADKIMSLTNCYKESFTAQPADMQAGIKKCSADEIGECTTLEDKTWPIVFCGGKYYYSDSKEHAKDGSINNYCLTNKCSEQRFPIHENWFKKCNWDKTHKEFSTMKQINYNDITSYRKAIESEIGTDLMTHHYKPTKNLPHVVPRYHSIDVQGTESTEGLINGFIQNTIPAISGLGVGYHLNFKGNQLFDIVIFVKKAVYKAQYQKAYTTGPSISINIEHNERCTGHCPEKIPAKEGWLTFSKEHTSSWGCEEYGCLAIDTGCLYGSCQDVIRPELDVYKKIGSEVSLIEICITLPHETYCNDMDILEPIIGDKLSASFQNTQTNQLPTLIAYKKGKIYTGQINDIGNTALQCGSIQVINGSTIGTGSPKFDYICHAMRRKDVIVRKCFNDNYQSCTRLEKRNDLIPYRKGDVIEVSKTGSNMGQMTFKIELGDINYKIFTKSIDLQMSGICAGCIDCAEGISCSINAEVSAETVCHCKTNCEDFINNIVFSPQIKNYNIKVHCKSKVEKIIAHICGKDIDLQLTVKPYNQKIDLSQLDESNYIREEDLQCGTWLCKVQKEGIDIIFKGLFSGLGRYWTILIYSIIGVVIIVILVYILLPIGRLLKAFLIRHEIEYAMEQKIK

SEQ ID NO: 1974 - protein, 1420 aa, Artificial Sequence
  derived and/or modified protein sequence (wt) from OROV(TVP-19256/IQE-7894)__KP795085.1__GP
MANLIIISMILGIAYGHPLSTSQIGDRCFAGGSLFKEMNLSVGLGEICVKDDISIVKSTTAFSKNALALEATTKFYRSFIVKDWSECNPVLDKFGNFMVLNVDDNGHLVPKMYTCRAACDIRLNKDNAEVILSSTKLNHFEIVGTTSTSGWFKNTITNNLEHTCEHVTVNCGQKSVKFHACFRQHRGCIRFFKGAYMPYSMIEAMCVNIELIILTLYIFAAIIFALIITKSYIAYLLLPLFYPVTWLYGKVYKRINSCPNCLLASHPFTSCPKICICGSRFSCTEALKVHRMGKDCLGYKSLSKARQMCKSKSWSFTAAILTGLILMEFVSPIAGERMYKLEELADDYIELAEQVNILGKEIKILKQSIIVMLAIILILLLSENIIFNYLFKTLYRSCSMCGLIHYRPGLKVDLTKTNKCGSCICGFDEQQSSGFEYEVFLKDMHVQRESCKFGPRVNHFRNTKILLFTIAICTSFYTVYADEDCLSKNIRITYQELHNCIGPHIMGDTCMSKSELYSDLLSKNLITEYDKKYFEPDTVNDQFNKIEFAQDAHRMILLERILYKTECEMLSLKKNSGPYNVAWRTYLKNHNIDLCSRHNYKMICQCINTHSMCKNTDIDFNKEIETYYKANAAAYRSDFNTIIDTLKTAFRGLTKVLIENYIEKDDSDALKALFSNITDSVQDNYQMVGVLKFASKLLNISLGRTTRSAQHSIMTNEIPKSNPFTDYSYSSVNIKECMSPESLKCFKKRDSVPHTNHLLCKMDNKYKVFDWPEIETVQKGQKLCLGDSHCNLEFTAITADKIMSLTNCYKESFTAQPADMQTGIKKCSADEIGECITLEDKSWPIVFCGDKYYYSEGKEHAKDGSINNYCLANKCSEQRFPIHKNWLKKCNWDKTHKEFTTMRRINYNDITSYRKAIESEIGTDLMTHHYKPTKNLPHVVPRYHSIDVQGTESTEGIINGFIQNTIPAISGLGVGYHLGFKGNQLFDIVIFVKKAVYKAQYQKVYTTGPSISINIEHNEKCTGHCPEKIPAKEGWLTFSKEHTSSWGCEEYGCLAIDTGCLYGSCQDVIRPELDIYKKIGSEASLIEICITLPHETYCNDMDILEPIIGDKLSASFQNTQTNQLPNLMAYKKGKVYTGQINDVGNTALQCGSIQVVNGSTIGSGNPKFDYICHAMRRKDVIVRKCFNDNYQSCTRLDPRNDLIPYRKGDIVEISKTGSNMGQMTFKIELGDINYKIFTKSVDLQMSGICAGCIDCAEGISCSINADASAETVCHCKTNCEDFISNIVISPQIKTYNIKVHCKSKVEKITANICGRNIDLQLTVKPYNQKIDLSQLDESNYIKEEDLQCGTWLCKVQKEGIDIVFKGLFSGLGKYWAILIYSIIGVIVVILLIYVLLPIGRLLKAFLIKNEIEYTMEQKIK

SEQ ID NO: 1975 - protein, 1420 aa, Artificial Sequence
  derived and/or modified protein sequence (wt) from OROV(TVP-19257/IQT-1690)__KP795088.1__GP
MANLIIIPMILGIAYGHPLSTSQIGDRCFAGGSLFKEMNLSVGLGEICVKDDISIVKSTTAFSKNALALEATTKFYRSFIVKDWSECNPVLDKFGNFMVLNVDDNGHLVPKMYTCRAACDIRLNKDNAEIILSSTKLNHFEIVGTTSTSGWFKNTITNNLEHTCEHVTVNCGQRSVKFHACFRQHRGCIRFFKGTYMPYSMIEAMCVNIELIILTLYIFAAIIFALIITKSYIAYLLLPLFYPVTWLYGKVYKRINSCPNCLLASHPFTSCPKICICGSRFSCTEALKVHRMGKDCLGYKSLSKARQMCKSKSWSFTAAILTGLILMEFVSPIAGERMYKLEELADDYIELAEQVNILGKEIKILKQSIIVMLAIILILLLSENIIFNYLFNTLYRSCSMCGLIHYRPGLKVDLTKTNKCGSCICGFDEQQSSGFEYEVFLKDMHVQRESCKFGPRVNHFRNTKILLFIIAICTSFYTVYADEDCLSKNIRITYQELHNCIGPHIMGDTCMSKSELYSDLLSKNLITEYDKKYFEPDTVNDQFNKIEFAQDAHRMILLERILYKTECEMLSLKKNSGPYNVAWRTYLKNHNIDLCSRHNYKMICQCINTHSMCKNTDIDFNKEIETYYKANAAAYRSDFNTIIDTLKTAFRGLTKVLIENYIEKDDSDALKALFSNITDSVQDNYQMVGVLKFASKLLNISLGRTTRSAQHSIMTNEIPKSNPFTDYSYSSVNIKECMSPESLKCFKKRDSAPHTNHLLCKMDNKYKAFDWPEIETVQKGQKLCLGDSHCNLEFTAITADKIMSLTNCYKESFTAQPADMQTGVKKCSADEIGECITLEDKSWPIVFCGDKYYYSDGKEHAKDGSINNYCLANKCSEQRFPIHKNWFKKCNWDKTHKEFTTMRQINYNDITSYRKAIESEIGTDLMTHHYKPTKNLPHVVPRYHSIDVQGTESTEGIINGFIQNTIPAISGLGVGYHLGFKGNQLFDIVIFVKKAVYKAQYQKVYTTGPSISINIEHNEKCTGHCPEKIPAKEGWLTFSKEHTSSWGCEEYGCLAIDTGCLYGSCQDVIRPELDIYKKIGSEASLLEICITLPHETYCNDMDILEPIIGDKLSASFQNTQTNQLPNLMAYKKGKVYTGQINDVGNTALQCGSIQVVNGSTIGSGNPKFDYICHAMRRKDVIVRKCFNDNYQSCTRLDPRNDLIPYRKGDIIEISKTGSNMGQMTFKIELGDINYKIFTKSVDLQMSGICAGCIDCAEGISCSINADVSAETVCHCKTNCEDFISNIVISPQIKTYNIKVHCKSKVEKITANICGRNIDLQLTVKPYNQKIDLSQLDESNYIKEEDLQCGTWLCKVQKEGIDIVFKGLFSGLGKYWAILIYSIIGIIVVILLIYVLLPIGRLLKAFLIKNEIEYTMEQKIK

SEQ ID NO: 1976 - protein, 1420 aa, Artificial Sequence
  derived and/or modified protein sequence (wt) from OROV(TVP-19258/IQT-4083)__KP795091.1__GP
MANLIIISMILGIAYGHPLSTSQIGDRCFAGGSLFKEMNLSVGLGEICVKDDISIVKSTTAFSKNALALEATTKFYRSFIVKDWSECNPVLDKFGNFMVLNVDNNGHLVPKMYTCRAACDIRLNKDNAEIILSSTKLNHFEIVGTTSTSGWFKNTITNNLEHTCEHVTVNCGQKSVKFHACFRQHRACIRFFKGTYMPYSMIEAMCVNIELIILTLYIFAAIIFALIITKSYIAYLLLPLFYPATWLYGKVYKRINSCPNCLLASHPFTSCPKICICGSRFSCTEALKVHRMGKDCLGYKSLSKARQMCKSKSWSFTAAILTGLILMEFVSPIAGERMYKLEELADDYIELTEQVNILGKEIKILKQSIIVMLAIILILLLSENIIFNYLFNTLYRSCSMCGLIHYRPGLKVDLTKTNKCGSCICGFDEQQSSGFEYEVFLKDMHVQRESCKFGPRVNHFRNTKILLFTIAICTSFYTVYADEDCLSKNIRITYQELHNCIGPHIMGDTCMPKSELYSDLLSKNLITEYDKKYFEPDTVNDQFNKIEFAQDAHRMILLERILYKTECEMLSLKKNSGPYNVAWRTYLKNHNIDLCSRHNYKMICQCINTHSMCKNTDIDFNKEIETYYKANAAAYRSDFNTIIDTLKTAFRGLTKVLIENYIEKDDSDALKALFSNITDSVQDNYQMVGVLKFASKLLNISLGRTTRSAQHSIMTNEIPKSNPFTDYSYSSINIKECMSPESLKCFKKRDSAPHTNHLLCKIDNKYKAFDWPEIETVQKGQKLCLGDSHCNLEFTAITADKIMSLTNCYKESFTAQPADMQTGIKKCSADEIGECITLEDKSWPIIFCGDKYYYSDGKEHAKDGSINNYCLANKCSEQRFPIHKNWFKKCNWDKTHKEFTTMRQINYNDITSYRKAIESEIGTDLMTHHYKPTKNLPHVVPRYHSIDVQGTESTEGIINGFIQNTIPAISGLGVGYHLGFKGNQLFDIVIFVKKAVYKAQYQKVYTTGPSISINIEHNEKCTGHCPEKIPAKEGWLTFSKEHTSSWGCEEYGCLAIDTGCLYGSCQDVIRPELDIYKKIGSEASLIEICITLPHETYCNDMDILEPIIGDKLSASFQNTQTNQLPNLMAYKKGKVYTGQINDVGNTALQCGSIQVVNGSTIGSGNPKFDYICHAMRRKDVIVRKCFNDNYQSCTRLDPRNDLIPYRKGDIIEISKTGSNMGQMTFKIELGDINYKIFTKSVDLQMSGICAGCIDCAEGISCSINADVSAETVCHCKTNCEDFISNIVISPQIKTYNIKVHCKSKVEKITANICERNIDLQLTVKPYNQKIDLSQLDESNYIKEEDLQCGTWLCKVQKEGIDIVFKGLFSGLGKYWAILIYSIIGIIVVILLIYVLLPIGRLLRAFLIKNEIEYTMEQKIK

SEQ ID NO: 1977 - protein, 1420 aa, Artificial Sequence
  derived and/or modified protein sequence (wt) from OROV(TVP-19259/IQT-7085)__KP795094.1__GP
MANLIIISMILGIAYGHPLSISQIGDRCFAGGSLFKEMNLSVGLGEICVKDDISIVKSTTAFSKNALALEATTKFYRSFIVKDWSECNPVLDKFGNFMVLNVDDNGHLVPKMYTCRAACDIRLNKDNAEIILSSTKLNHFEIVGTTSTSGWFKNTITNNLEHTCEHVTVNCGQKSVKFHACFRQHRGCIRFFKGTYMPYSMIEAMCVNIELIILTLYIFAAIIFALIITKSYIAYLLLPLFYPVTWLYGKVYKRINSCPNCLLASHPFTSCPKICICGSRFSCTEALKVHRMGKDCLGYKSLSKARQMCKSKSWSFTAAILTGLILMEFVSPIAGERMYKLEELADDYIELAEQVNILGKEIKILKQSIVVMLAIILILLLSENIIFNYLFNTLYRSCSMCGLIHYRPGLKVDLTKTNKCGSCICGFDEQQSSGFEYEVFLKDMHVQRESCKFGPRVNHFRNTKILLFTIAICTSFYTVYADEDCLSKNIRITYQELHNCIGPHIMGDTCMSKSELYSDLLSKNLITEYDKKYFEPDTVNDQFNKIEFAQDAHRMILLERILYKTECEMLSLKKNSGPYNVAWRTYLKNHNIDLCSRHNYKMICQCINTHSMCKNTDIDFNKEIETYYKANAAAYRSDFNTIIDTLKTAFRGLTKVLIENYIEKDDSDALKALFSNITDSVQDNYQMVGVLKFASKLLNISLGRTTRSAQHSIMTNEIPKSNPFTDYSYSSVNIKECMSPESLKCFKKRDSAPHTNHLLCKMDNKYKAFDWPEIETVQKGQKLCLGDSHCNLEFTAITADKIMSLTNCYKESFTAQPADMQTGIKKCSADEIGECITLEDKSWPIVFCGDKYYYSDGKEHAKDGSINNYCLANKCSEQRFPIHKNWFKKCNWDKTHKEFTTMRQINYNDITSYRKAIESEIGTDLMTHHYKPTKNLPHVVPRYHSIDVQGTESTEGIINGFIQNTIPAISGLGVGYHLGFKGNQLFDIVIFVKKAVYKAQYQKVYTTGPSISINIEHNEKCTGHCPEKIPAKEGWLTFSKEHTSSWGCEEYGCLAIDTGCLYGSCQDVIRPELDIYKKIGSEASLIEICITLPHETYCNDMDILEPIIGDKLSASFQNTQTNQLPNLMAYKKGKVYTGQINDVGNTALQCGSIQVVNGSTIGSGNPKFDYICHAMRRKDVIVRKCFNDNYQSCTRLDPRNDLIPYRKGDIIEISKTGSNMGQMTFKIELGDINYKIFTKSVDLQMSGICAGCIDCAEGISCSINADVSAETVCHCKTNCEDFISNIVISPQIKTYNIKVHCKSKVEKITANICGRNIDLQLTVKPYNQKIDLSQLDESNYIKEEDLQCGTWLCKVQKEGIDIVFKGLFSGLGKYWAILIYSIIGVIVVILLIYVLLPIGRLLKAFLIKNEIEYTMEQKIK

SEQ ID NO: 1978 - protein, 1420 aa, Artificial Sequence
  derived and/or modified protein sequence (wt) from OROV(TVP-19262/OBS-9478)__KP795100.1__GP
MANLIIISMILGIAYGHPLSTSQIGDRCFAGGSLFKEMNLSVGLGEICVKDDISIVKSTTAFSKNALALEATTKFYRSFIVKDWSECNPVLDKFGNFMVLNVDNNGHLIPKMYTCRAACDIRLNKDNAEIILSSTKLNHFEIIGTTSTSGWFKNTITNNLEHTCEHVTVNCGQKSVKFHACFRQHRGCIRFFKGTYMPYSMIEAMCVNIELIILTLYIFAAIIFALIITKSYIAYLLLPLFYPATWLYGKVYKRINSCPNCLLASHPFTSCPKICICGSRFSCTEALKVHRMGKDCLGYKSLSKARQMCKSKSWSFTAAILTGLILMEFVSPIAGERMYKLEELADDYIELTEQVNILGKEIKILKQSIIVMLAIILILLLSENIIFNYLFNTLYRSCSMCGLIHYRPGLKVDLTKTNKCGSCICGFDEQQSSGFEYEVFLKDMHVQRESCKFGPRVNHFRNTKILLFTIAICTSFYTVYADEDCLSKNIRITYQELHNCIGPHIMGDTCMPKSELYSDLLSKNLITEYDKKYFEPGTVNDQFNKIEFAQDAHRMILLERILYKTECEMLSLKKNSGPYNVAWRTYLKNHNIDLCSRHNYKMICQCINTHSMCKNTDIDFNKEIETYYKANAAAYRSDFNTIIDTLKTAFRGLTKVLIENYIEKDDSDALKALFSNITDSVQDNYQMVGVLKFASKLLNISLGRTTRSAQHSIMTNEIPKSNPFTDYSYSSINIKECMSPESLKCFKKRDSAPHTNHLLCKIDNKYKAFDWPEIETVQKGQKLCLGDSHCNLEFTAITADKIMSLTNCYKESFTAQPADMQTGIKKCSADEIGECITLEDKSWPIIFCGDKYYYSDGKEHAKDGSINNYCLANKCSEQRFPIHKNWFKKCNWDKTHKEFTIMRQINYNDITSYRKAIESEIGTDLMTHHYKPTKNLPHVVPRYHSIDVQGTESTEGIINGFIQNTIPAISGLGVGYHLGFKGNQLFDIVIFVKKAVYKAQYQRVYTTGPSISINIEHNEKCTGHCPEKIPAKEGWLTFSKEHTSSWGCEEYGCLAIDTGCLYGSCQDVIRPELDIYKKIGSEASLIEICITLPHETYCNDMDILEPIIGDKLSASFQNTQTNQLPNLMAYKKGKVYTGQINDVGNTALQCGSIQVVNGSIIGSGNPKFDYICHAMRRKDVIVRKCFNDNYQSCTRLDPRNDLIPYRKGDIIEISKTGSNMGQMTFKIELGDINYKIFTKSVDLQMSGICAGCIDCAEGISCSINADVSAETVCHCKTNCEDFISNIVISPQIKTYNIKVHCKSKVEKITANICERNIDLQLTVKPYNQKIDLSQLDESNYIKEEDLQCGTWLCKVQKEGIDIVFKGLFSGLGKYWAILIYSIIGIIVVILLIYVLLPIGRLLRAFLIKNEIEYTMEQKIK

SEQ ID NO: 1979 - protein, 1432 aa, Artificial Sequence
  derived and/or modified protein sequence (wt) from OROV/FPV(Aus Ch 16129)__KF697137.1__GP
MKFVSILLFVSWLGATYQNPVSHRQIGERCFAGGSLIKTVNQTSGVSEVCVRDDISMIKSIVHTTKASDTAVNNYIRFYRVFIVKEWHDCNPFPDPKGTFMVLDVSSTNHLEPITYTCRTPCEITLDKDSAEVTLSSQKMNHYEISGSTINNGWFKNSISVSLEHTCEHITVSCGQKTVRFHACFRQHRSCTRFFKNSMMPARMTESICQNLEIILLTCFSFVCFIFLCIITKTYVAYVLIPVFYPFTYIYGRLYDKYFKLCENCLLAVHPFTPCETVCVCGSQYANTEQLRTHRMTNNCKGYKSLSKSRAMCKSKGCSFVVAIFCSIIFFSFITPINSQEYKLSDLPDEFTRLEEENTMLKIRLLVIKITISVISVTITVTSLTERKVFQELFNAIYRHCPFCGMIHRRRGLRVVNSTTNKCGTCICGYKEETEHGVEYEIFLKTMHQENVNCMFKPSQRHFRNFKILIAFLAMCMIITSVSADEKHCLKYKEPVKLSNLTECHSLWLNITECQINQSTLFETLKGEQLVTDFDKPDFTIMGQKYDIAMERIENAQNLHHMILLEYLHAKSNCLKYKQLKSNSGPYNIPWRTYIHGHGLDVCGQYSYKLICKCISTGMHCENTALDIYNEMRQFYTNNQENYNLDLNTVIKAIGLAMRGIGQMIIEEFFGESQIEELSNFLNMTSKNLGTNKQLIGLINFGLMLLDINQTKTPQIDPKPRTLQARSSIPTGTEITDWTKGQSKIKTCAEYSTLTCQSWRKTVNTKSFLMCKVSSKWHVYNWPEIPTVVRNSKLCLGDYHCNMEFTPIDADEALKQLRCYKTEFVPSPDGMDESIKKCTLEKFGGCTTANGHSWTIMVCNGRYYQTNTREHAKDGLLNSYCFEPKCQSGRHPIHKSFLNNCIWKESSRQIIETRTIEYNNIEDYKKSVESDIKSDLTIHHFKPTKNLPLVTPTYISVVADGTMVSDGIQNAYVKGTIPGISGVATGLHVKTPDGILLMDIIVYVRKALYKANYEKIYSTGPTIGINVKHNEKCTGTCPEHIPKDEGWLTFSKEHTSNWGCEEYGCFAINSGCLYGSCQDIIRPELDIYKQQGEEQTLLELCITLPHETFCNDLDVLEPVITDKLQLDFQTTQSDHLPELVALKKGLILTGQLNDLGNTAAMCGSVQLVNKTIYGQGNPKFDFICHAMRRKDVIVRRCYDNHYSTCALLKQRNDLLHKEVNDQMSITVNGKNLGLINFRLNLGDLNYKLFVNEPNFELTGQCAGCISCADEISCQLNIIADHEFTCKVSSSCNLYISNMMITPANHIYNLKVSCREHVSNIDLAVCGRSFSLHATLKQHSQKLDLSALDETNFVKEEDLRCGTWLCKVKDEGLSFLTRSIFGSLGTYWSYFIYGLIFMILLFIAIYFLYPLCKRLKGLLEENEREYLIESKMK

SEQ ID NO: 1980 - protein, 1418 aa, Artificial Sequence
  derived and/or modified protein sequence (wt) from OROV/IQTV(IQT9924)__KF697143.1__GP
MDCIIFYLSFFAVVTAHPVSHHQVGDRCFAGGNLIKDLNKTVNIGEVCVRDDISIIKSTTAIQKSLDHLSTRTKFYRVYIVKEWAECNPIIDYAGNFIVMNIDDNGHLVPRMHTCRASCDIRLNKNDAEIILSSQKTNHYEIIGTTTVSGWFKNTINLPLEHTCEHITVNCGQKSLRFHACFRMHRGCTRFFKNTYMPSTMIEHMCVNLELIIFTLYIFTALVFAYIITKSYIAYILLPLFYPLTYVFGIIYSKLKQCKTCMLAAHPFTNCPKRCVCGSRFNCTEALRVHRLGRDCQGYKSLSKARQMCKSKSWSFIIAIFTGLILMEFITPIHGERTYKLSELADEFIAMKTEVTVMQRSIYNQKILNIALLTLVVLIILLETYIFKILFSLLYRSCSMCGLIHYKVGLKINLLTTNKCGTCICGFSEQQSSGFEYEVFLKDMHKQRESCKYFPMLNHFRNLKILTTILLLILLATSVSSECLQKPLKIKLEDLHECIGVNFLDKQCYNRKNLYESLRSKNLISEVDKKYFENADLEGQFKRIEYAQDAHRMILLERILYSTECEMHTILTNGGAYNIPWRTYLKNHNLNLCGKHVHKMVCQCVNTHTQCLSTGIDYQDEITKFYQADGDSYRSDLSIILETISTAFRGLTKVLIETYIEQDNSESMIKLLNTIQGKVPNNYQMLGILKFAIKIMNINQTRGVRSARHTIVSNDIPMSEPFSNFEVSNINIKQCLEPLTLKCFTKRGDSPHSNHLLCKEQSKYKVFEWPEVETVTKNNKLCLGDTHCNLKFTATTSDEIIKLLNCFSDTYKPNPGEMEIGLKKCNAEKIGECVTLENSPWPIVYCENKYYYSEAKEHAKDGSVNSYCLTNKCTEDRLPINPAWFKSCNWEKNIKETATIKEFVYNDIKSYRKSLESEINTDLMIHHYRPTKNLPHIKPIYKSLSIQGSETVDGLQNSFIEGEMPAISGLANGYHLMYKGTQLFDIVIFIRKAVYKANYYKIYTTGPSIAINMEHNEQCTGHCPSKIPSKENWLTFSREHTSSWGCEEYGCLAIDTGCLYGSCQDVIRPEIDVYKKSGTEQSLIELCITSAHETFCNDLDILEPIIGEKISASFQSTQSNQLPNIIAFRKGQILTGAINDLGNTGSQCGSIQLVNNTLLGEGNVKFDYICHAMRRKDVIIRRCYNDHFTSCNLLQKRSDLIGNINGKELQISMSGRSMGSMKFKIELGDINYKLYTENADITIRGECGGCIGCAEAVSCSLEVESASEILCKVECNCQPYIENILIKPQTKTYSFKATCLEKSNTLDIKICGKQIIAPLTIKSYNQKIDLSKLDESNYVKEEDLACNTWLCKVQTEGFNFVFSGLFAGFGRYWTIAIYILIAVVIILILIYILMPIFRLIRTFLIKNEIEYTTEQKMR

SEQ ID NO: 1981 - protein, 1418 aa, Artificial Sequence
  derived and/or modified protein sequence (wt) from OROV/IQTV(MIS-0397)__KJ866387.1__GP
MDCIIFYLSFFAVVTAHPVSHHQVGDRCFAGGNLIKDLNKTVNIGEVCVRDDISIIKSTTAIQKSLDHLSTRTKFYRVYIVKEWAECNPIIDYAGNFIVMNIDDNGHLVPRMHTCRASCDIRLNKNDAEIILSSQKTNHYEIIGTTTVSGWFKNTINLPLEHTCEHITVNCGQKSLRFHACFRMHRGCTRFFKNTYMPSTMIEHMCANLELIIFTLYIFTALVFAYIITKSYIAYILLPLFYPLTYVFGIIYSKLKQCKTCMLAAHPFTNCPKRCVCGSRFNCTEALRVHRLGRDCQGYKSLSKARQMCKSKSWSFIIAIFTGLILMEFITPIHGERTYKLSELADEFIAMKTEVTVMQRSIYNQKILNIALLTLVVLIILLETYIFKILFSLLYRSCSMCGLIHYKLGLKINLLTTNKCGTCICGFSEQQSSGFEYEVFLKDMHKQRESCKYFPMLNHFRNLKILTTILLLILLATSVSSECLQKPLKIKLEDLHECIGVNFLDRQCYNRKDLYESLRSKNLISEVDKKYFESADLGGQFKRIEYAQDAHRMILLERILYSTECEMHTILTNGGAYNIPWRTYLKNHNLNLCGKHVHKMVCQCVNTHTQCLSTGIDYQDEITKFYQADGDSYRSDLSIILETISTAFRGLTKVLIETYIEQDNSESMIKLLNTIQGKVPNNYQMLGILKFAIKIMNINQTRGVRSARHTIVSNDIPMSEPFSNFEASNINIKQCSEPLTLKCFTKRGDSPHSNHLLCKEQSKYKVFEWPEIETVTKNNKLCLGDTHCNLKFTATTSDEIIKLLNCFSDTYKPNPGEMEIGLKKCNAEKIGECVTLENSPWPIVYCENKYYYSEAKEHAKDGSVNSYCLTNKCTEDRLPINPAWFKSCNWEKNIKETATIKEFVYNDIKSYRKSLESEINTDLMIHHYRPTKNLPHIKPIYKSLSIQGSETVDGLQNSFIEGEMPAISGLANGYHLTYKGTQLFDIVIFIRKAVYKANYYKIYTTGPSIAINMEHNEQCTGHCPSKIPSKENWLTFSREHTSSWGCEEYGCLAIDTGCLYGSCQDVIRPEIDVYKKSGNEQSLIELCITSAHETFCNDLDILEPIIGEKISASFQSTQSNQLPNIIAFRKGQILTGAINDLGNTGSQCGSIQLVNNTLLGEGNVKFDYICHAMRRKDVIIRRCYNDHFTSCNLLQKRSDLIGNINGKELQISMSGRSMGSMKFKIELGDINYKLYTENADITIRGECGGCIGCAEAVSCSLEVESSSEILCKVECNCQPYIENILIKPQTKTYSFKATCLERSNTLDIKICGKQIIAPLTIKSYNQKIDLSKLDESNYVKEEDLACNTWLCKVQTEGFNFVFSGLFAGFGRYWTIAIYILIAVVIILILIYILMPIFRLIRTFLIKNEIEYTTEQKMR

SEQ ID NO: 1982 - protein, 1418 aa, Artificial Sequence
  derived and/or modified protein sequence (wt) from OROV/MDDV(FMD 1303)__KF697145.1__GP
MAFLLIYVVLAAAVASHPLSNHQIGDRCFAGGNLIRELNKTVNIGELCVRDDISMIKSTTAIQKSVGHLSTRTKFYRVYIVKEWAECNPIIDFAGNFIIMNIDENGHLVPKMHTCRASCDIRLNKDDAEIILSSQKTNHYEIIGTTSISGWFKNTINLPLEHTCEHITVNCGQKSLRFHACFRMHRGCTRFFKNTYMPSTMIETMCVNLELIIFTLYIFSAAVFAYVITKSYIAYILLPVFYPITYILGSIYSRFKQCKTCMLAAHPFTSCPKKCVCGSRFNCTEALRVHRLGKDCQGYKSLSKARQMCKSKSWSFIIAVFTGLILMEFITPISGERMYKLSELAEEFIEMKEEASALKKAINNLKLLNVLLSAIATLVVVMETYIFKSLFNLLYRSCSMCGLIHYKIGLRVNLLTTNRCGTCICGFNEQQSSGFEYEIFLKDMHKQRESCKYFPMLNHFRNVKILTVFLLLTMLTASASSECLQKPLKIKLEDLHECIGVNFLNRQCYNSQELYQSLKSKNLVSEVDKKYFDNKNLEDLFKRIEYAQDAHRMILLERILYSTECEMHTILTNGGAYNIPWRTYLKNHNLNLCGKHVHKMVCQCINTHTQCLSTGIDYQDEITKFYQADGDSYRADLSVILQTIATAFRGMTKVLIETYIEQDNSESMIKLLNTIKEKVPNNYQMLGILNFAIKIMSVNQTRGVRSARHTIISNDIPMSETFSNFEVSNIDVKQCTDPLTLKCFTKRGDAPHSNHLLCKEQNKYKVFEWPEIETVMKNNKLCLGDTHCNLKFAAIASDEVIKLLNCFSDTYKPNPGEMEVGAKKCNADKIGECITLENNPWPIVYCETKYYYSDAKEHAKDGNVNSYCLTNKCNEDRFPINPTWFKSCSWDRNVKETTTIKEFVHNDISAYRKSLESEISTDLLIHHYRPTKNLPHIMPAYKSLTIQGSETVDGLQNSFIEGEMPAISGLANGYHLKYKGIELFDIVIFIRKAVYKANYYKIYTTGPSVAINMEHNEQCTGSCPKKIPAKENWLTFSKEHTSSWGCEEYGCLAIDTGCLYGSCQDVIRPEVDVYKKASAEQSLIELCITSAHETFCNDLDILEPIIGDKISAAFQSTQVNQLPNIIAFKKGQIFTGAINDLGNTGSQCGSIQLINNTLLGEGNVKFDYICHAMKRKDVIVRRCYNDHFASCNLLQKRSDLVGTLNGKELQVSMSGRSMGSMKFKVELGDISYKLYTENADISISGECGGCINCAEAISCALEIDSSTEVLCKLECSCQPYIQNILIKPQVKKYSFKATCFEKRNSLEVTVCKKQHTIPLTIKSYNQKIDLSRLDESNYVREEDLTCNTWLCKVEKEGIGVMFSGLFAGFGKYWSIAIYALIALVIFLILIYILVPIFRLIRTFLIKNEVEYTTEQKMR

SEQ ID NO: 1983 - protein, 1418 aa, Artificial Sequence
  derived and/or modified protein sequence (wt) from OROV/MDDV(INHRR 17a-10)__KJ866390.1__GP
MAFLLIYVVLAATVASHPLSNHQIGDRCFAGGNLIRELNKTVNIGELCVRDDISMIKSTTAIQKSVGHLSTRTKFYRVYIVKEWAECNPIIDFAGNFIIMNIDENGHLVPKMHTCRASCDIRLNKDDAEIILSSQKTNHYEIIGTTSISGWFKNTINLPLEHTCEHITVNCGQKSLRFHACFRMHRGCTRFFKNTYMPSTMIETMCVNLELIIFTLYIFSAAVFAYVITKSYIAYILLPVFYPITYILGSIYSRFKQCKTCMLAAHPFTSCPKKCVCGSRFNCTEALRVHRLGKDCQGYKSLSKARQMCKSKSWSFIIAVFTGLILMEFITPISGERMYKLSELAEEFIEMKEEASALKKAINNLKLLNVLLSAIATLVVVMETCIFKSLFNLLYRSCSMCGLIHYKIGLRVNLLTTNRCGTCICGFSEQQSSGFEYEIFLKDMHKQRESCKYFPMLNHFRNVKILTVFLLLTMLTASASSECLQKPLKIKLEDLHECIGVNFLNRQCYNSQELYQSLKSKNLVSEVDKKYFDNKNLEDLFKRIEYAQDAHRMILLERILYSTECEMHTILTNGGAYNIPWRTYLKNHNLNLCGKHVHKMVCQCINTHTQCLSTGIDYQDEITKFYQADGDSYRADLSIILETIATAFRGMTKVLIETYIEQDNSESMIKLLNTIKEKVPNNYQMLGILNFAIKIMSVNQTRGVRSARHTIISNDIPMSETFTNFEVSNIDVKQCTDPLTLKCFTKRGDAPHSNHLLCKEQNKYKVFEWPEIETVMKNNKLCLGDTHCNLKFAAIASDEVIKLLNCFSDTYKPNPGEMEVGTKKCNADKIGECITLENNPWPIVYCETKYYYSDAKEHAKDGNVNSYCLTNKCNEDRFPINPTWFKSCSWDRNVKETTTIKEFVHNDISAYRKSLESEISTDLLIHHYRPTKNLPHIMPAYKSLTIQGSETVDGLQNSFIEGDMPAISGLANGYHLKYKGIELFDIVIFIKKAVYKANYYKIYTTGPSVAINMEHNEQCTGSCPKKIPAKENWLTFSKEHTSSWGCEEYGCLAIDTGCLYGSCQDVIRPEIDVYKKASAEQSLIELCITSAHETFCNDLDILEPIIGDKISAAFQSTQVNQLPNIIAFKKGQIFTGAINDLGNTGSQCGSIQLINNTLLGEGNVKFDYICHAMKRKDVIVRRCYNDHFASCNLLQKRSDLVGTLNGKELQVSMSGRSMGSMKFKVELGDISYKLYTENADISISGECGGCINCAEAISCALEIDSSTEVLCKLECSCQPYIQNILIKPQVKKYSFKATCFEKRNSLEVTVCKKQHTIPLTIKSYNQKIDLSRLDESNYVREEDLTCNTWLCKVEKEGIGVMFSGLFAGFGKYWSIAIYALIALVIFLILIYILVPIFRLIRTFLIKNEVEYTTEQKMR

SEQ ID NO: 1984 - protein, 1418 aa, Artificial Sequence
  derived and/or modified protein sequence (wt) from OROV/Perdoes virus(BeAn789726)__KP691625.1__GP
MFIQFNLAFFCLSIVCGHPLTKDHIGDRCFAGGNLFKEITQTTGLSEICIKDDISIIKSQVEIKKQSSEVTYAVKFYRVYLVKEWSECNPIQDQHGSIMILDVTNTGLIVPKMYTCRAACDITLDKDNAEVVFISQKNNNYELAGTTVMHGWFKNVVSIKLEHTCEHLTATCGQKTVKFHACFRQHRACARFLKTTYMPIVMVESLCSNLELVIFITYIFVCLAFAFIITRTYVAYLLIPVFYPFTYAYGKMYLKCVKTCPNCLLAMHPFTNCTNLCICGSRFSNTESLKVHRLGNCYGYKALSGARSMCKSKVSSFTTAMFFGIIILSFIAPLNGERLYKLSELPDEYIEMESTIEGSKQKETIVDIINYTALVLILITILLQGILENYIFRLKFRFCSFCDMIHMKKNLKIFSNMTNKCGTCICGFNQEIRSGFDYEVFIKDMHVSRESCKYNYHKNYSFYIKMLLVVLLVPLIGTTAAEDTKCLKYDLNKNIEDLKDCYGLKLNIDKHDTVENAYKNLVDQKLVSELDRLDLNIMLGSKESIFEAIETSMNIHQMVFLEYLAYKTDPKLSEIKQNTGPYNIAWRTFIHGNSLEVCGNYPYKLICYCINQKTHCENSTVDYGIQIQPFYNQHPNSYKSDMEALIKTVQIAFRGIIKVLIQYYVENNKTSELSNLLTELRNVMGNNIQMKGILKYLETYLKKPLLMARTIRIAAKVDTSGDPYNNFSTSKENITKCIKIQKLRCITKLTRIEHNYILCGDSEKKLYQWPAKPTIVDDNDACLGDKHCHLPFIPIGNDEAIKTVNCYVEVYEQNPGDMNSYQKKCDAMNVGTCLTIKNENWPIVQCKTGKYYYADGRIHAKDGTINTYCFSEKCNADRYPIHQDYINSCNWQETIKDFQHVREFVHLDIESYKKAIESDIKTDLVVHKFRPVKNLPHVIPIYKSITVQGTETSDGIQNAFIQGSMPAISGLANGYHLFTPDSKQLFDVVLFLRKASYKAEYRKIYSTGPTIGINVEHNEKCTGSCPKTIDKKDNWLTFSKEHTSQWGCEEYGCLAINTGCVFGSCQDIIRPEIDVYKMHGAERSVVELCITLPHETYCNDLDVLEPIIGDKIQAAFQTVQSNHMPRLMAIKNNKAFTGQINDLGSTASYCGSVQKFNETIIGQGDPKFDYVCHLLKRKDIIVRRCYSNNYESCKLLTPRADIIVDKKGESLQASIVGLNLGQMNFKIMLGDINYKQYTESNNLEATGQCVGCVDCSEDIVCNLKIESQSESVCNIKSDCNLYLSSMLIQPTVGEYNLKMSCNAKLDKVNIEICKQKFVLPLTIKSHNQKIDLSKLDESNYIREEDLKCDTMICKVKDEGLSFITNSLFGGISYFWKILISSLIVIFLIILFYYVGLPILRLIKDYLKENELEYLAEGK

SEQ ID NO: 1985 - protein, 1418 aa, Artificial Sequence
  derived and/or modified protein sequence (wt) from OROV/Perdoes virus(BeAn790177)__KP691628.1__GP
MFIQFNLAFFCLSIVCGHPLTKDHIGDRCFAGGNLFKEITQTTGLSEICIKDDISIIKSQVEIKKQSSEVTYAVKFYRVYLVKEWSECNPIQDQHGSIMILDVTNTGLIVPKMYTCRAACDITLDKDNAEVVFISQKNNNYELAGTTVMHGWFKNVVSIKLEHTCEHLTATCGQKTVKFHACFRQHRACARFLKTTYMPIVMVESLCSNLELVIFITYIFVCLAFAFIITRTYVAYLLIPVFYPFTYAYGKMYLKCVKTCPNCLLAMHPFTNCTNLCICGSRFSNTESLKVHRLGNCYGYKALSGARSMCKSKVSSFTTAMFFGIIILSFIAPLNGERLYKLSELPDEYIEMESTIEGSKQKETIVDIINYTALVLILITILLQGILENYIFRLKFRFCSFCDMIHMKKNLKIFSNMTNKCGTCICGFNQEIRSGFDYEVFIKDMHVSRESCKYNYHKNYSFYIKMLLVVLLVPLIGTTAAEDTKCLKYDLNKNIEDLKDCYGLKLNIDKHDTVENAYKNLVDQKLVSELDRLDLNIMLGSKESIFEAIETSMNIHQMVFLEYLAYKTDPKLSEIKQNTGPYNIAWRTFIHGNSLEVCGNYPYKLICYCIKQKTHCENSTVDYGIQIQPFYNQHPNSYKSDMEALIKTVQIAFRGIIKVLIQYYVENNKTSELSNLLTELRNVMGNNIQMKGILKYLETYLKKPLLMARTIRIAAKVDTSGDPYNNFSTSKENITKCIKIQKLRCITKLTRIEHNYILCGDSEKKLYQWPAKPTIVDDNDACLGDKHCHLPFIPIGNDEAIKTVNCYVEVYEQNPGDMNSYQKKCDAMNVGTCLTIKNENWPIVQCKTGKYYYADGRIHAKDGTINTYCFSEKCNADRYPIHQDYINSCNWQETIKDFQHVREFVHLDIESYKKAIESDIKTDLVVHKFRPVKNLPHVIPIYKSITVQGTETSDGIQNAFIQGSMPAISGLANGYHLFTPDSKQLFDVVLFLRKASYKAEYRKIYSTGPTIGINVEHNEKCTGSCPKTIDKKDNWLTFSKEHTSQWGCEEYGCLAINTGCVFGSCQDIIRPEIDVYKMHGAERSVVELCITLPHETYCNDLDVLEPIIGDKIQAAFQTVQSNHMPRLMAIKNNKAFTGQINDLGSTASYCGSVQKFNETIIGQGDPKFDYVCHLLKRKDIIVRRCYSNNYESCKLLTPRADIIVDKKGESLQASIVGLNLGQMNFKIMLGDINYKQYTESNNLEATGQCVGCVDCSEDIVCNLKIESQSESVCNIKSDCNLYLSSMLIQPTVGEYNLKMSCNAKLDKVNIEICKQKFVLPLTIKSHNQKIDLSKLDESNYIREEDLKCDTMICKVKDEGLSFITNSLFGGISYFWKILISSLIVIFLIILFYYVGLPILRLIKDYLKENELEYLAEGK

SEQ ID NO: 1986 - protein, 1427 aa, Artificial Sequence
  derived and/or modified protein sequence (wt) from OROV/UTIV(BeAn84785)__KF697155.1__GP
MFLIFILIQIAASTPLSPQQVGDRCFIGGSLIKEINQSTGLGEVCIKDDISIIKSINIQKKISNDQVQNTVKFYKTYIAREWHDCNPIFDEHGSFMVFDISNTGSIIPKMHTCRAQCEITLNKDNAEVIFTSAKTNHYEVSGTTTVNGWFKQTISVSLEHTCEHIIASCGQKSLKFHACFRQHRSCVRFFRNSYLPYKMIESLCINIELIIILCYALLCFIFAYIITKTYIAYLLIPLFYPITYIYGKIYNKYFKRCKSCLLAVHPLTNCNKTCVCGCRFNSTEALKVHRLGKDCNGFKALSKARFLCKSTGPSFTICFLTGMLILSFITPINSEKLYKLEELPDDYINLENQLSECNNNKQITRALAVACILGNILFVLFFKFIYNKLINNIYRTCNLCNMVHHRKNLKIYSEFTNKCGTCVCGFNEEIRSGFDYEVFIKDMHIFRDNCLFKFYSKYSIIYICIIILVINLQLGMTLAEETETNCLNLPISAQTLDIVKCYGLNLNITENKQKSDLISELKSQKTITDHDIPDFNIIDMKTESAFEKIETAENIHRMAFLEYILYKMESKLNTIKTNSGPYNVAWRTYIKYHNLDACGKYPHKTICTCINAHLSCSQPTVDSNSEIKTFYSNHQSAFKNDINVLIETISIAFRGIIKVSINLLLKNNKIDELKELLTNISKKLDTNIQMKGILLFTAEQLKTQETTVKSMQQTRMAIIVKPLESMTGDKFDNFSTTNRNITKCKEAKSLSCYMTRKNSINKYLLCNLDGYKIFSWPEKPTLSINNNICIGDSHCNLYFKPILNDEAIKTINCYKGDFTPNPMDMGSAIKKCEAKEIGDCLVGDNNMWPIIQCSNEKYYYADGKNHAKEGDINSYCLSEKCNTDRFPIHNEWFKSCKWISTIKESISVKEFVHLDIESYKKGIESDIRTDLIIHKFRPVKNLPHIAPKYKSITISGILVADGIQNAFVSGEMPAISGLGIGYNLYSPDGTKLFDIVLFLRKAIYKSSYKLIYKTGPTIGINVEHNEQCTGSCPSTIPKQEGWLTFSKEHTSQWGCEEFGCLAIDTGCLYGSCQDIIRPEMSIYKMLGEEMTSIEICLTTPKETYCNDLDLLEPLIGDKIEVSFQTVQSSHMPKIIAVKNNKVYTGQINDIGNTANICGSVQIINKTVIGQGNPKFDYLCHAMKRKDVIVRKCYDNHFETCKLLEERSEILINQQSDTIAASMSGKNLGIMNFKFALGDIDYKTFTEDASFDIKGQCVGCINCIEEIVCELNIVSTSSILCTIKTPCENYHNSLEINPATTKYHIKMSCPHNIDKMKITICSKDLEMPLTLKQHDQKIDLSKLDESNYIKEEDLRCSTWLCKVKEEGIGFIFSGIFGNFGKYWTIFLIVLVILATGLLGIFVIYPCCKRLRGFLEINDIAYLAEQKMK

SEQ ID NO: 1987 - protein, 1076 aa, Artificial Sequence
  derived and/or modified protein sequence (wt) from HRTV(TN)__KJ740147.1__GP
MIVPIVLFLTLCPSELSAWGSPGDPIVCGVRTETNKSIQIEWKEGRSEKLCQIDRLGHVTSWLRNHSSFQGLVGQVKGRPSVSYFPEGASYPRWSGLLSPCDAEWLGMIAVSKAGDTDMIVPGPTYKGKIFVERPTYNGYKGWGCADGKSLSHSGTYCETDSSVSSGLIQGDRVLWVGEVVCQRGTPVPEDVFSELVSLSQSEFPDVCKIDGVALNQCEQESIPQPLDVAWIDVGRSHKVLMREHKTKWVQESSAKDFVCFKVGQGPCSKQEEDDCMSKGNCHGDEVFCRMAGCSARMQDNQEGCRCELLQKPGEIIVNYGGVSVRPTCYGFSRMMATLEVHKPDRELTGCTGCHLECIEGGVKIVTLTSELRSATVCASHFCASAKGGSKTTDILFHTGALVGPNSIRITGQLLDGSKFSFDGHCIFPDGCMALDCTFCKEFLRNPQCYPVKKWLFLVVVIMCCYCALMLLTNILRAIGVWGTWVFAPIKLALALGLRLAKLSKKGLVAVVTRGQMIVNDELHQIRVERGEQNEGRQGYGPRGPIRHWLYSPALILILTTSICSGCDELVHAESKSITCKSASGNEKECSVTGRALLPAVNPGQEACLHFSMPGSPDSKCLKIKVKSINLRCKQASSYYVPEAKARCTSVRRCRWAGDCQSGCPTYFSSNSFSDDWANRMDRAGLGMSGCSDGCGGAACGCFNAAPSCIFWRKWVENPSNRVWKVSPCASWVLAATIELTLPSGEVKTLEPVTGQATQMFKGVAITYLGSSIEIVGMTRLCEMKEMGTGIMALAPCNDPGHAIMGNVGEIQCSSIESAKHIRSDGCIWNADLVGIELRVDDAVCFSKLTSVEAVANFSKIPATISGVRFDQGNHGESRIYGSPLDITRVSGEFSVSFRGMRLKLSEISASCTGEITNVSGCYSCMTGASVSIKLHSSKNTTGHLKCDSDETAFSVMEGTHTYRPHMSFDKAVIDEECVLNCGGHSSKLLLKGSLVFMDVPRFVDGSYVQTYHSKVPAGGRVPNPVDWLNALFGDGITRWILGIIGVLLACVMLFVVVVAITRRLIKGLTQRAKVA

SEQ ID NO: 1988 - protein, 1076 aa, Artificial Sequence
  derived and/or modified protein sequence (wt) from HRTV(Patient2)__JX005844.1__GP
MIVPIVLFLTLCPSELSAWGSPGDPIVCGVRTETNKSIQIEWKEGRSEKLCQIDRLGHVTSWLRNHSSFQGLIGQVKGRPSVSYFPEGASYPRWSGLLSPCDAEWLGLIAVSKAGDTDMIVPGPTYKGKIFVERPTYNGYKGWGCADGKSLSHSGTYCETDSSVSSGLIQGDRVLWVGEVVCQRGTPVPEDVFSELVSLSQSEFPDVCKIDGVALNQCEQESIPQPLDVAWIDVGRSHKVLMREHKTKWVQESSAKDFVCFKVGQGPCSKQEEDDCMSKGNCHGDEVFCRMAGCSARMQDNQEGCRCELLQKPGEIIVNYGGVSVRPTCYGFSRMMATLEVHKPDRELTGCTGCHLECIEGGVKIVTLTSELRSATVCASHFCASAKGGSKTTDILFHTGALVGPNSIRITGQLLDGSKFSFDGHCIFPDGCMALDCTFCKEFLRNPQCYPVKKWLFLVVVIMCCYCALMLLTNILRAIGVWGTWVFAPIKLALALGLRLAKLSKKGLVAVVTRGQMIVNDELHQVRVERGEQNEGRQGYGPRGPIRHWLYSPALILILTTSICSGCDELVHAESKSITCKSASGNEKECSVTGRALLPAVNPGQEACLHFSVPGSPDSKCLKIKVKSINLRCKQASSYYVPEAKARCTSVRRCRWAGDCQSGCPTYFSSNSFSDDWANRMDRAGLGMSGCSDGCGGAACGCFNAAPSCIFWRKWVENPSNRVWKVSPCASWVLAATIELTLPSGEVKTLEPVTGQATQMFKGVAITYLGSSIEIVGMTRLCEMKEMGTGIMALAPCNDPGHAIMGNVGEIQCSSIESAKHIRSDGCIWNADLVGIELRVDDAVCFSKLTSVEAVANFSKIPATISGVRFDQGNHGESRIYGSPLDITRVSGEFSVSFRGMRLKLSEISASCTGEITNVSGCYSCMTGASVSIKLHSSKNTTGHLKCDSDETAFSVMEGTHTYRPHMSFDKAVIDEECVLNCGGHSSKLLLKGSLVFMDVPRFVDGSYVQTYHSKVPAGGRVPNPVDWLNALFGDGITRWILGIIGVLLACVMLFVVVVAITRRLIKGLTQRAKVA

SEQ ID NO: 1989 - protein, 1076 aa, Artificial Sequence
  derived and/or modified protein sequence (wt) from HRTV(Patient1)__JX005845.1__GP
MIAPVVLFFTLCPSQLSAWGSPGDPIVCGVRTETNKSIQIEWKEGRSEKLCQIDRLGHVTSWLRNHSSFQGLIGQVKGRPSVSYFPEGASYPRWSGLLSPCDAEWLGLIAVSKAGDTDMIVPGPTYKGKIFVERPTYNGYKGWGCADGKSLSHSGTYCETDSSVSSGLIQGDRVLWVGEVVCQRGTPVPEDVFSELISLSQSEFPDVCKVDGVALNQCEQESIPQPLDVAWIDVGRSHKVLMREHKTKWVQESSAKDFVCFKVGQGPCSKQEEDDCMSKGNCHGDEVFCRMAGCSARMQDNQEGCRCELLQKPGEIIVNYGGVSVRPTCYGFSRMMATLEVHKPDRELTGCTGCHLECIEGGVKIVTLTSELRSATVCASHFCASAKGGSKTTDILFHTGALVGPKSIRITGQLLDGSKFSFDGHCIFPDGCMALDCTFCKEFLRNPQCYPVKKWLFLVVVVMCCYCALMLLTNILRAIGVWGTWVFAPIKLVLALGLRLAKLSKKGLVAVVTRGQMIVNDELHQIRVERGEQNEGRLGHGPRGPVRHWLYSPALILILTTSICSGCDELVHAESKSITCKSASGNEKECSVTGRALLPAVNPGQEACLHFSMPGSPDSKCLKIKVKSINLRCKQASSYYVPEAKARCTSVRRCRWAGDCQSGCPTYFSSNSFSDDWANRMDRAGLGMSGCSDGCGGAACGCFNAAPSCIFWRKWVENPSNRVWKVSPCASWVLAAIIELTLPSGEVKTLEPVTGQATQMFKGVAITYLGSSIEIVGMTRLCEMKEMGTGIMALAPCNDPGHAIMGNVGEIQCSSIESAKHIRSDGCIWNADLVGIELRVDDAVCFSKLTSVEAVANFSKIPAIISGVRFDQGNHGESRIYGSPLDITKVSGEFSVSFRGMRLKLSEISASCTGEITNVSGCYSCMTGASVSIKLHSSKNTTGHLKCDSDETAFSVMEGTHTYRPHMSFDKAVVDEECVLNCGGHSSKLLLKGSLVFMDVPRFVDGSYVQTYHSKVPAGGRVPNPVDWLNALFGDGITRWILGIIGVLLACVLLFVVVVAITRRLIKGLTQRAKVA

SEQ ID NO: 1990 - protein, 1313 aa, Artificial Sequence
  derived and/or modified protein sequence (wt) from PTV(PAN472868)__NC_027201.1__GP
MIFTILNVLTRAMLVMSMYSLTTWDSTSRNDMCFSNDSPLEGLVYYWETHSKKHDYKKQESQRCRVGDSDKKMITNVTIISLISEIQKSISELSLSCGNDDNSTGQVLTFNGLEDTIQGDYIVDCVTGLYQSDIGVGVGLGKTHHDHQQVKNKAVVIDEKERMISFLETQQSENDIKMQVLMSEIEQLKNQLSKKRNERGQEKRDAEKVMSDLMARNSDLRKHNDILTAEISQMENNNTIQRNKNVMSTTVVPAILSVALLSSSIAPIMAASPDSPMINPWPHAKNRVGTGMYKYDENDDSGCRPIRYGVSCIGFDFMLKMDKYPFFNAFIGHKTPLESFADKIIEKEEETCEIGTNKEFKCFEERAYIKGTCPTNINAVHYIDNKGKLRYVKCKENLEMTEDCAFCRKIKKKAGQSIQVQKTSVPLQDAICQENSDTYSGPKIPFKGVCKIGLIKYKECKFKTSSYETVSFITLKEKGKIYIEHLMLKNIEVVTNVSFVCYEHAGQDEQEVEHRALKRVSVNDCKIVDNSKQKICTGDHIFCEKYDCSTSYPDVTCIHAPGSGPLYINLMGSWIKPQCVGYERVLVDREVKQPLLAPEQNCDTCVSECLDEGVHIKSTGFEITSAVACSHGSCISAHQEASTSVIVPYPGLLASVGGRIGIHLSHTSDSASVHMVVVCPPRDSCAAHNCLLCYHGILNYQCHSTLSAILTSFLLILFIYTVFSVTTNMLYVLRLIPKQLKSPVGWLRLFINWLLTALRIKTRNVMGRINQRIGWVDHHDVERPRHREPMRRFKTTLLLTLIMMTGGNACSNTVVANSKQTRCVQEGSSTKCSITATITLRAGVIGAESCFIIKGPMENQQKTISIKTISSETVCREGSSFWTSLYIPSCLSSRRCHLVGDCVGNKCQSWRDDQLSREFSGVKDNHIMNENKCFEQCGAIGCGCFNINPSCLYVHAYLKSARNEAVRVFSCSDWVHRVSFEVKGPDGETELVTLGSLGTKFLNWGTLSLSLDAEGISGTNSISFLESSKGGFALYDEGYSEIPREGFLGEIRCSSESAAISAHKSCIRAPGLIKYKPMTDQIECTASLVDPFAIFLKGSLPQTRNGQTFTSTKDKKTVQAFTNGAIKALLSINLDDHEIVFINKVRSCDATFLNVSGCYSCDYGAHVCVKVKSSESADFFAESEDKTTVLSFPIQSGTHDYCQVLHFQKPLVDERLSYSCGSEPKLIVIKGTLVYMGVYDFRNKTGGSSTVVNPSEGAWSISNWFSGLLDWLGGPMKAILKILGFIAIGIVCFILFMILIRIAVNSINIKKKN

SEQ ID NO: 1991 - protein, 1313 aa, Artificial Sequence
  derived and/or modified protein sequence (wt) from PTV(Adames)__KR912209.1__GP
MIFTILNVLTRAMLVMSMYSLTTWDSSSRNDICFSNDSPLEGLVYYWETHSKKHDYKKQGSQKCRVGDSDKKMISNVTIISLISEIQKSISELSLSCGNNDNSTGQVLTFNGLEDTIRGDYIVDCVTGLYQSDIGVGVGLGRINHDHQQVKNKAVVIDEKEKMISLLETQQSENDIKTQVLMSEIEQLKNQLSKRRNERGQEKRDAEKLMSDLMARNSDLRNHNVILTDEISQIKNNITIHRNRNMMSTTVVPAILSVALLSSSVGPITAAPPDSTMINPWPHAKNRVGTGMYKYDENDESGCRPIRYGVSCIGFDFMLKMDKYPFFNAFIGHKTPLESFADKIIEKEEETCEIGTNKEFKCFEERAYIKGTCPTNINAVHYIDNKGKLRYVKCKENLEMTEDCAFCRKIKKKAGQSVQVQKTSVPLQDAICQENSDIYSGPKIPFKGVCKIGLIKYKECKFKTSSYETISFITLKGKGKIYIEHLMLKNIEVVTNVSFVCYEHAGQDEQEVEHRALKRVSVNDCKIVDNSKQKICTGDHIFCEKYDCSTSYPDVTCIHTPGSGPLYINLMGSWIKPQCVGYERVLVDREVKQPLLVPEQNCDTCVSECLDEGVHIKSTGFEITSAVACSHGSCISAHQEASTSVIIPYPGLLASVGGRIGIHLSHTSDSASVHMVVVCPPRDSCAAHNCLLCYHGILNYQCHSTLSAILTSFLLILFIYTAFSVTTNVLYVLRLIPKQLKSPVGWLKLFVNWLLTALRIKTRRVMGRINQRIGWVDHHDVERPRHREPMRRFKTTLLLTLIMVTGGNACSNTVVANSKQTRCVQEGSNTKCSITATITLRAGVIGAESCFIIKGPMENQQKTISIKTISSETVCREGSSFWTSLYIPSCLSSRRCHLVGDCVGNKCQSWRDDQLSREFSGVKDNHIMNENKCFEQCGAIGCGCFNINPSCLYVHAYLKSARNEAVRVFSCSDWVHRVSFEVKGPDGEMELVTLGSLGTKFLNWGTLSLSLDAEGISGTNSISFLESSKGGFALYDEGYSEIPREGFLGEIRCSSESAAISAHKSCIRAPGLIKYKPMTDQIECTASLVDPFAIFLKGSLPQTRNGQTFTSTKDKKTVQAFTNGAIKALLSINLDDHEIIFINKVKSCDATFLNVSGCYSCDYGAHVCVKVKSSESADFFAESEDKTTVLSFPIQSGTRDYCQVLHFQKPLVDERLSYSCGSEPKLIVIKGTLVYMGVYDFRDKTGGSSTVINPSEGTWSISNWFSGLLDWLGGPMKAILKILGFIAIGIVCFILFMILIRIAVNSINIKKKN

SEQ ID NO: 1992 - protein, 1313 aa, Artificial Sequence
  derived and/or modified protein sequence (wt) from PTV(Balliet)__KR912213.1__GP
MIFTILNVLTRAMLVMSMYSLTTWDSTSRNDMCFSNDSPLEGLVYYWETHSKKHDYKKQESQRCRVGDSDKKMITNVTIISLISEIQKSISELSLSCGNDDNSTGQVLTFNGLEDTIRGDYIVDCVTGLYQSDIGVGVGLGRTHHGHQQMKNKAVVIDEKERMISLLETQQSENDIKMQVLMSEIEQLKNQLSKKRNERGQEKRDAEKVMSDLMARNSDLRKHNDILTAEISQMKNKNTIQRNKNTVSTTVVPAILSVALLSSSVAPIIAAPPDSPMINPWPHAKNRVGTGMYKYDENDDSGCRPIRYGVSCIGFDFMLKMDKYPFFNAFIGHKTPLESFADKIIEKEEETCEIGTNKEFKCFEERAYIKGTCPTNINAVHYIDNKGKLRYVKCKENLEMTEDCAFCRKIKKKAGQSVQVQKTSVPLQDAICQENSDTYSGPKIPFKGVCKIGLIKYKECKFKTSSYETVSFITLKEKGKIYIEHLMLKNIEVVTNVSFVCYEHVGQDEQEVEHRALKRVSVNDCKIVDNSKQKICTGDHVFCEKYDCSTSYPDVTCIHAPGSGPLYINLMGSWIKPQCVGYERVLVDREVKQPLLAPEQNCDTCVSECLDEGVHIKSTGFEITSAVACSHGSCISAHQEPSTSVIVPYPGLLASVGGRIGIHLSHTSDSASVHMVVVCPPRDSCAAHNCLLCYHGILNYQCHSTLSAILTSFLLILFIYTVFSVTTNILYVLRLIPKQLKSPVGWLKLFINWLLTALRIKTRNVMRRINQRIGWVDHHDVERPRHREPMRRFKTTLLLTLIMMTGGNACSNTVVANSKQTRCVQEGSNTKCSITATITLRAGVIGAESCFIIKGPMENQQKTISIKTISSETVCREGSSFWTSLYIPSCLSSRRCHLVGDCVGNKCQSWRDDQLSREFSGVKDNHIMNENKCFEQCGAIGCGCFNINPSCLYVHAYLKSARNEAVRVFSCSDWVHRVSFEVKGPDGETELVTLGSLGTKFLNWGTLSLSLDAEGISGTNSISFLESSKGGFALYDEGYNEIPREGFLGEIRCSSESAAISAHKSCIRAPGLIKYKPMTDQIECTASLVDPFAIFLKGSLPQTRNGQTFTSTKDKKTVQAFTNGAIKALLSINLDDHEIVFINKVKNCDATFLNVSGCYSCDYGAHVCVKVKSSESADFFAESEDKTTVLSFPIQSGTHDYCQVLHFQKPLVDERLSYSCGSEPKLIVIKGTLVYMGVYDFRNKTGGSSTVVNPSEGAWSISNWFSGLLDWLGGPMKAILKILGFIAIGIVCFVLFMILIRIAVNSINIKKKN

SEQ ID NO: 1993 - protein, 1313 aa, Artificial Sequence
  derived and/or modified protein sequence (wt) from PTV(PaAR2381)__KP272005.1__GP
MIFTILNILTRAMLVMSMYSLTTWDSTSRNDMCFSNDSPLEGLVYYWETHSKKHDYKKQESQKCRVGDSDKKMISNVTIISLISEIQKSISELSLSCGNDDNSTGQVLTFNGLEDTIRGDYIVDCVTGLYQSDIGVGVGLGRTHHDHHQVKNKAVVIDEKERMISLLETQQSENDIKMQVLMSEIEQLKNQLSRKRNERGQEKRDAEKVMSDLMARNSDLRKHNDILTAEISQMKYNNTIQRSKNVMSTTVVPAILSVALLSSSVAPIMAAPPDSPMINPWPHAKNRVGTGMYKYDDNDDSGCRPIRYGVSCIGFDFMLKMDKYPFFNAFIGHKTPLESFADKIIEKEEETCEIGTNKEFKCFEERAYIKGTCPTNINAVHYIDNKGKLRYVKCKENLEMTEDCAFCRKIKKKAGQSVQVQKTSVPLQDAICQENSDNYSGPKIPFKGVCRIGLIKYKECKFKTSSYETVSFITLKEKGKIYIEHLMLKNIEVVTNVSFVCYEHAGQDEQEVEHRALKRVSVNDCKIVDNSKQKICTGDHVFCEKYDCSTSYPDVTCIHAPGSGPLYINLMGSWIKPQCVGYERVLVDREVKQPLLAPEQNCDTCVSECLDEGVHIKSTGFEITSAVACSHGSCISAHQEASTSVIVPYPGLLASVGGRIGIHLSHTSDSASVHMVVVCPPRDSCEAHNCLLCYHGILNYQCHSTLSAILTSFLLILFIYTVFSVTTNMLYVLRLIPKQLKSPVGWLKLFINWLLTALRIKTRNVMGRINQRIGWVDHHDVERPRHREPMRRFKTTLLLTLIMMTGGNACSNTVVANSKQTRCVQEGSNTKCSITATITLRAGVIGAESCFIIKGPMENQQKTISIKTISSETVCREGSSFWTSLYIPSCLSSRRCHLVGDCVGNKCQSWRDDQLSREFSGVKDNHIMNENKCFEQCGAIGCGCFNINPSCLYVHAYLKSARNEAVRVFSCSDWVHRVSFEVKGPDGETELVTLGSLGTKFLNWGTLSLSLDAEGISGTNSISFLESSKGGFALYDEGYSEIPREGFLGEIRCSSESAAISAHKSCIRAPGLIKYKPMTDQIECTASLVDPFAIFLKGSLPQTRNGQTFTSTKDKKTVQAFTNGAIKALLSINLDDHEIVFINKVKSCDATFLNVSGCYSCDYGAHVCVKVKSSESADFFAESEDKTTVLSFPIQSGTHDYCQVLHFQKPLVDERLSYSCGSEPKLIVIKGTLVYMGVYDFRNKTGGSSTVVNPSEGAWSISNWFSGLLDWLGGPMKAILKILGFIAIGIVCFILFMIMIRIAVNSINIKKKN

SEQ ID NO: 1994 - protein, 1313 aa, Artificial Sequence
  derived and/or modified protein sequence (wt) from PTV(PAN483391)__KP272008.1__GP
MIFTILNILTRAMLVMSMYSLTTWDSTSRNDMCFSNDSPLEGLVYYWETHSKKHDYKKQESQRCRVGDSDKKMITNVTIISLISEIQKSISELSLSCGNDDNSTGQVLTFNGLEDTIRGDYIVDCVTGLYQSDIGVGVGLGRTHHDHQQVKNKAVVIDEKERMISLLETQQSENDIKMQVLMSEIEQLKNQLSKKRNERGQEKRDAEKVMSDLMARNSDLRKHNDILTAEISQMKYDNTIQRNKNVMSTTVVPAILSVALLSSSIAPIMAASPDSPMINPWPHAKNRVGTGMYKYDENDDSGCRPIRYGVSCIGFDFMLKMDKYPFFNAFIGHKTPLESFADKIIEKEEETCEIGTNKEFKCFEERAYIKGTCPTNINAVHYIDNKGKLRYVKCKENLEMTEDCAFCRKIKKKAGQSVQVQKTSVPLQDAICQENSDTYSGPKIPFKGVCKIGLIKYKECKFKTSSYETVSFITLKEKGKIYIEHLMLKNIEVVTNVSFVCYEHAGQDEQEVEHRALKRVSVNDCKIVDNSKQKICTGDHVFCEKYDCSTSYPDVTCIHAPGSGPLYINLMGSWIKPQCVGYEKVLVDREVKQPLLAPEQNCDTCVSECLDEGVHIKSTGFEITSAVACSHGSCISAHQEASTSVIVPYPGLLASVGGKIGIHLSHTSDSASVHMVVVCPPRDSCAAHNCLLCYHGILNYQCHSTLSAILTSFLLILFIYTVFSVTTNMLYVLRLIPKQLKSPVGWLRLFINWLLTALRIKTRNVMGRINQRIGWVDHHDVERPRHREPMRRFKTTLLLTLIMMTGGNACSNTVVANSKQTRCVQEGSNTKCSITATITLKAGVIGAESCFIIKGPMENQQKTISIKTISSETVCREGSSFWTSLYIPSCLSSRRCHLVGDCVGNKCQSWRDDQLSREFSGVKDNHIMNENKCFEQCGAIGCGCFNINPSCLYVHAYLKSARNEAVRVFSCSDWVHRVSFEVKGPDGETELVTLGSLGTKFLNWGTLSLSLDAEGISGTNSISFLESSKGGFALYDEGYSEIPREGFLGEIRCSSESAAISAHKSCIRAPGLIKYKPMTDQIECTASLVDPFAIFLKGSLPQTRNGQTFTSTKDKKTVQAFTNGAIKALLSINLDDHEIVFINKVRSCDATFLNVSGCYSCDYGAHVCVKVKSSESADFFAESEDKTTVLSFPIQSGTHDYCQVLHFQKPLVDERLSYSCGSEPKLIVIKGTLVYMGVYDFRNKTGGSSTVVNPSEGAWSISNWFSGLLDWLGGPMKAILKILGFIAIGIVCFILFMILIRIAVNSINIKKKN

SEQ ID NO: 1995 - protein, 1313 aa, Artificial Sequence
  derived and/or modified protein sequence (wt) from PTV(GML902876)__KP272011.1__GP
MIFTILNVLTRAMLVMSMYSLTTWDSTSRNDMCFSNDSPLEGLVYYWETHSKKHDYKKQESQKCRVGDSDKKMISNVTIISLISEIQKSISELSLSCGNDDNSTGQVLTFNGLEDTIRGDYIVDCVTGLYQSDIGVGVGLGRTHHDHHQVKNKAVVIDEKERMISLLETQQSENDIKMQVLMSEIEQLKNQLSRKRNERGQEKRDAEKVMSDLMARNSDLRKHNDILTAEISQMENNNTIQRNKNVMSTTVVPAILSVALLSSSIAPIMAASPDSPMINPWPHAKNRVGTGMYKYDENDDSGCRPIRYGVSCIGFDFMLKMDKYPFFNAFIGHKTPLESFADKIIEKEEETCEIGTNKEFKCFEERAYIKGTCPTNINAVHYIDNKGKLRYVKCKENLEMTEDCAFCRKIKKKAGQSIQVQKTSVPLQDAICQENSDTYSGPKIPFKGVCKIGLIKYKECKFKTSSYETVSFITLKEKGKIYIEHLMLKNIEVVTNVSFVCYEHAGQDEQEVEHRALKRVSVNDCKIVDNSKQKICTGDHIFCEKYDCSTSYPDVTCIHAPGSGPLYINLMGSWIKPQCVGYERVLVDREVKQPLLAPEQNCDTCVSECLDEGVHIKSTGFEITSAVACSHGSCISAHQEASTSVIVPYPGLLASVGGRIGIHLSHTSDSASVHMVVVCPPRDSCAAHNCLLCYHGILNYQCHSTLSAILTSFLLILFIYTVFSVTTNMLYVLRLIPKQLKSPVGWLRLFINWLLTALRIKTRNVMGRINQRIGWVDHHDVERPRHREPMRRFKTTLLLTLIMMTGGNACSNTVVANSKQTRCVQEGSSTKCSITATITLRAGVIGAESCFIIKGPMENQQKTISIKTISSETVCREGSSFWTSLYIPSCLSSRRCHLVGDCVGNKCQSWRDDQLSREFSGVKDNHIMNENKCFEQCGAIGCGCFNINPSCLYVHAYLKSARNEAVRVFSCSDWVHRVSFEVKGPDGETELVALGSLGTKFLNWGTLSLSLDAEGISGTNSISFLESSKGGFALYDEGYSEIPREGFLGEIRCSSESAAISAHKSCIRAPGLIKYKPMTDQIECTASLVDPFAIFLKGSLPQTRNGQTFTSTKDKKTVQAFTNGAIKALLSINLDDHEIVFINKVKSCDATFLNVSGCYSCDYGAHVCVKVKSSESADFFAESEDKTTVLSFPIQSGTHDYCQVLHFQKPLVDERLSYSCGSEPKLIVIKGTLVYMGVYDFRNKTGGSSTVVNPSEGAWSISNWFSGLLDWLGGPMKAILKILGFIAIGIVCFILFMIMIRIAVNSINIKKKN

SEQ ID NO: 1996 - protein, 1313 aa, Artificial Sequence
  derived and/or modified protein sequence (wt) from PTV(PAN479603)__KP272014.1__GP
MIFTILNILTRAMLVMSMYSLTTWDSTSRNDMCFSNDSPLEGLVYYWETHSKRHDYKKQESQKCRVGDSDKKMISNVTIISLISEIQKSISELSLSCGNDDNSTGQVLTFNGLEDTIRGDYIVDCVTGLYQSDIGVGVGLGRTHHDHHQVKNKAVVIDEKERMISLLETQQSENDIKMQVLMSEIEQLKNQLSRKRNERGQEKRDAEKVMSDLMARNSDLRKHNDILTAEISQMKYDNTIQRNKNVMSTTVVPAILSVALLSSSVAPIIAAPPDSPMINPWPHAKNRVGTGMYKYDDNDDSGCRPIRYGVSCIGFDFMLKMDKYPFFNAFIGHKTPLESFADKIIEKEEETCEIGTNKEFKCFEERAYIKGTCPTNINAVHYIDNKGKLRYVKCKENLEMTEDCAFCRKIKKKAGQSVQVQKTSVPLQDAICQENSDTYSGPKIPFKGVCKIGLIKYKECKFKTSSYETVSFITLKEKGKIYIEHLMLKNIEVVTNVSFVCYEHAGQDEQEVEHRALKRVSVNDCKIVDNSKQKICTGDHVFCEKYDCSTSYPDVTCIHAPGSGPLYINLMGSWIKPQCVGYERVLVDREVKQPLLAPEQNCDTCVSECLDEGVHIKSTGFEITSAVACSHGSCISAHQEASTSVIVPYPGLLASVGGRIGIHLSHTSDSASVHMVVVCPPRDSCAAHNCLLCYHGILNYQCHSTLSAILTSFLLILFIYTVFSVTTNMLYVLRLIPKQLKSPVGWLKLFINWLLTTLRIKTRNVMGRINQRIGWVDHFDVERPRHREPMRRFKTTLLLTLIMMTGGNACSNTVVANSKQTRCVQEGSNTKCSITATITLRAGVIGAESCFIIKGPMENQQKTISIKTISSETVCREGSSFWTSLYIPSCLSSRRCHLVGDCVGNKCQSWRDDQLSREFSGVKDNHIMNENKCFEQCGAIGCGCFNINPSCLYVHAYLKSARNEAVRVFSCSDWVHRVSFEVKGPDGETELVTLGSLGTKFLNWGTLSLSLDAEGISGTNSISFLESSKGGFALYDEGYSEIPREGFLGEIRCSSESAAISAHKSCIRAPGLIKYKPMTDQIECTASLVDPFAIFLKGSLPQTRNGQTFTSTKDKKTVQAFTNGAIKALLSINLDDHEIVFINRVKSCDATFLNVSGCYSCDYGAHVCVKVKSSESADFFAESEDKTTVLSFPIQSGTHDYCQVLHFQKPLVDERLSYSCGSEPKLIVIKGTLVYMGVYDFRNKTGGSSTVVNPSEGAWSISNWFSGLLDWLGGPMKAILKILGFIAIGIVCFILFMILIRIAVNSINIKKKN

SEQ ID NO: 1997 - protein, 1313 aa, Artificial Sequence
  derived and/or modified protein sequence (wt) from PTV(PAN478718)__KP272017.1__GP
MIFTILNVLTRAMLVMSMYSLTTWDSSSRNDMCFSNDSPLEGLVYYWETHSKKHDYKKQESQRCRVGDSDKKMITNVTIISLISEIQKSISELSLSCGNDDNSTGQVLTFNGLEDTIRGDYIVDCVTGLYQSDIGVGVGLGRTHHDHQQVKNKAVVIDEKERMISLLETQQSENDIKMQVLMSEIEQLKNQLSKKRNERGQEKRDAEKVMSDLMARNSDLRKHNDILTAEISQMKYNNTIQRNKNIMSTTVVPAILSVALLSSSVAPIMAAPPDSPMINPWPHAKNRVGTGMYKYDDNDDSGCRPIRYGVSCIGFDFMLKMDKYPFFNAFIGHKTPLESFADKIIEKEEETCEIGTNKEFKCFEERAYIKGTCPTNINAVHYIDNKGKLRYVKCKENLEMTEDCAFCRKIKKKAGQSVQVQKTSVPLQDAICQENSDTYSGPKIPFKGVCKIGLIKYKECKFKTSSYETVSFITLKEKGKIYIEHLMLKNIEVVTNVSFVCYEHAGQDEQEVEHRALKRVSVNDCKIVDSSKQKICTGDHVFCEKYDCSTSYPDVTCIHAPGSGPLYINLMGSWIKPQCVGYERVLVDREVKQPLLAPEQNCDTCVSECLDEGVHIKSTGFEITSAVACSHGSCISAHQEASTSVIVPYPGLLASVGGRIGIHLSHTSDSASVHMVVVCPPRDSCAAHNCLLCYHGILNYQCHSTLSAILTSFLLILFIYTVFSVTTNMLYVLRLIPKQLKSPVGWLKLFINWLLTALRIKTRNVMGRINQRIGWVDHHDVERPRHREPMRRFKTTLLLTLIMMTGGNACSNTVVANSKQTRCVQEGSNTKCSITATITLRAGVIGAESCFIVKGPMENQQKTISIKTISSETVCREGSSFWTSLYIPSCLSSRRCHLVGDCVGNKCQSWRDDQLSREFSGVKDNHIMNENKCFEQCGAIGCGCFNINPSCLYVHAYLKSARNEAVRVFSCSDWVHRVSFEVKGPDGETELVTLGSLGTKFLNWGTLSLSLDAEGISGTNSISFLESSKGGFALYDEGYSEIPREGFLGEIRCSSESAAISAHKSCIRAPGLIKYKPMTDQIECTASLVDPFAIFLKGSLPQTRNGQTFTSTKDKKTVQAFTNGAIKALLSINLDDHEIVFINKVISCDATFLNVSGCYSCDYGAHVCVKVKSSESADFFAESEDKTTVLSFPIQSGTHDYCQVLHFQKPLVDERLSYSCGSEPKLIVIKGTLVYMGVYDFRNKTGGSSTVVNPSEGAWSISNWFSGLLDWLGGPMKAILKILGFIAIGIVCFILFMILIRIAVNSINIKKKN

SEQ ID NO: 1998 - protein, 1313 aa, Artificial Sequence
  derived and/or modified protein sequence (wt) from PTV(Balliet)__KP272023.1__GP
MIFTILNVLTRAMLVMSMYSLTTWDSTSRNDMCFSNDSPLEGLVYYWETHSKKHDYKKQKSQRCRVGDSDKKMITNVTIISLISEIQKSISELSLSCGNDDNSTGQVLTFNGLEDTIRGDYIVDCVTGLYQSDIGVGVGLGRTHHGHQQMKNKAVVIDEKERMILLLETQQSENDIKMQVLMSEIEQLKNQLSKKRNERGQEKRDAEKVMSDLMARNSDLRKHNDILTAEISQMKNKNTIQRNKNTVSTTVVPAILSVALLSSSVAPIIAAPPDSPMINPWPHAKNRVGTGMYKYDENDDSGCRPIRYGVSCIGFDFMLKMDKYPFFNAFIGHKTPLESFADKIIEKEEETCEIGTNKEFKCFEERAYIKGTCPTNINAVHYIDNKGKLRYVKCKENLEMTEDCAFCRKIKKKAGQSVQVQKTSVPLQDAICQENSDTYSGPKIPFKGVCKIGLIKYKECKFKTSSYETVSFITLKEKGKIYIEHLMLKNIEVVTNVSFVCYEHAGQDEQEVEHKALKRVSVNDCKIVDNSKQKICTGDHVFCEKYDCSTSYPDVTCIHAPGSGPLYINLMGSWIKPQCVGYERVLVDREVKQPLLAPEQNCDTCVSECLDEGVHIKSTGFEITSAVACSHGSCISAHQEPSTSVIVPYPGLLASVGGRIGIHLSHTSDSASVHMVVVCPPRDSCAAHNCLLCYHGILNYQCHSTLSAILTSFLLILFIYTVFSVTTNILYVLRLIPKQLKSPVGWLKLFINWLLTALRIKTRNVMGRINQRIGWVDHHDVERPRHREPMRRFKTTLLLTLIMMTGGNACSNTVVANSKQTRCVQEGSNTKCSITATITLRAGVIGAESCFIIKGPMENQQKTISIKTISSETVCREGSSFWTSLYIPSCLSSRRCHLVGDCVGNKCQSWRDDQLSREFSGVKDNHIMNENKCFEQCGAIGCGCFNINPSCLYVHAYLKSARNEAVRVFSCSDWVHRVSFEVKGPDGETELVTLGSLGTKFLNWGTLSLSLDAEGISGTNSISFLESSKGGFALYDEGYNEIPREGFLGEIRCSSESAAISAHKSCIRAPGLIKYKPMTDQIECTASLVDPFAIFLKGSLPQTRNGQTFTSTKDKKTVQAFTNGAIKALLSINLDDHEIVFINKVKNCDATFLNVSGCYSCDYGAHVCVKVKSSESADFFAESEDKTTVLSFPIQSGTHDYCQVLHFQKPLVDERLSYSCGSEPKLIVIKGTLVYMGVYDFRNKTGGSSTVVNPSEGAWSISNWFSGLLDWLGGPMKAILKILGFIAIGIVCFVLFMILIRIAVNSINIKKKN

SEQ ID NO: 1999 - protein, 1313 aa, Artificial Sequence
  derived and/or modified protein sequence (wt) from PTV(Adames)__KP272029.1__GP
MIFTILNVLTRAMLVMSMYSLTTWDSSSRNDICFSNDSPLEGLVYYWETHSKKHDYKKQGSQKCRVGDSDKKMISNVTIISLISEIQKSISELSLSCGNNDNSTGQVLTFNGLEDTIRGDYIVDCVTGLYQSDIGVGVGLGRINHDHQQVKNKAVVIDEKEKMISLLETQQSENDIKTQVLMSEIEQLKNQLSKRRNERGQEKRDAEKLMSDLMARNSDLRNHNVILTDEISQIKNNITIHRNRNMMSTTVVPAILSVALLSSSVGPITAAPPDSTMINPWPHAKNRVGTGMYKYDENDESGCRPIRYGVSCIGFDFMLKMDKYPFFNAFIGHKTPLESFADKIIEKEEETCEIGTNKEFKCFEERAYIKGTCPTNINAVHYIDNKGKLRYVKCKENLEMTEDCAFCRKIKKKAGQSVQVQKTSVPLQDAICQENSDIYSGPKIPFKGVCKIGLIKYKECKFKTSSYETISFITLKGKGKIYIEHLMLKNIEVVTNVSFVCYEHAGQDEQEVEHRALKRVSVNDCKIVDNSKQKICTGDHIFCEKYDCSTSYPDVTCIHTPGSGPLYINLMGSWIKPQCVGYERVLVDREVKQPLLVPEQNCDTCVSECLDEGVHIKSTGFEITSAVACSHGSCISAHQEASTSVIIPYPGLLASVGGRIGIHLSHTSDSASVHMVVVCPPRDSCAAHNCLLCYHGILNYQCHSTLSAILTSFLLILFIYTAFSVTTNVLYVLRLIPKQLKSPVGWLKLFVNWLLTALRIKTRRVMGRINQRIGWVDHHDVERPRHREPMRRFKTTLLLTLIMVTGGNACSNTVVANSKQTRCVQEGSNTKCSITATITLRAGVIGAESCFIIKGPMENQQKTISIKTISSETVCREGSSFWTSLYIPSCLSSRRCHLVGDCVGNKCQSWRDDQLSREFSGVKDNHIMNENKCFEQCGAIGCGCFNINPSCLYVHAYLKSARNEAVRVFSCSDWVHRVSFEVKGPDGEMELVTLGSLGTKFLNWGTLSLSLDAEGISGTNSISFLESSKGGFALYDEGYSEIPREGFLGEIRCSSESAAISAHKSCIRAPGLIKYKPMTDQIECTASLVDPFAIFLKGSLPQTRNGQTFTSTKDKKTVQAFTNGAIKALLSINLDDHEIIFINKVKSCDATFLNVSGCYSCDYGAHVCVKVKSSESADFFAESEDKTTVLSFPIQSGTRDYCQVLHFQKPLVDERLSYSCGSEPKLIVIKGTLVYMGVYDFRNKTGGSSTVINPSEGTWSISNWFSGLLDWLGGPMKAILKILGFIAIGIVCFILFMILIRIAVNSINIKKKN

SEQ ID NO: 2000 - protein, 1313 aa, Artificial Sequence
  derived and/or modified protein sequence (wt) from PTV(GML488831)__KP272032.1__GP
MIFTILNVLTRAMLVMSMYSLTTWDSTSRNDMCFSNDSPLEGLVYYWETHSKKHDYKKQESQRCRVGDSDKKMITNVTIISLISEIQKSISELSLSCGNDDNSTGQVLTFNGLEDTIRGDYIVDCVTGLYQSDIGVGVGLGRAHHDHQQVKNKAVVIDEKERMISLLETQQSENDIKMQVLMSEIEQLKNQLSKKRNERGQEKRDAEKVMSDLMARNSDLRKHNDILTAEISQMKYNNTIQRSKNVMSTTVVPAILSVALLSSSVAPIMAAPPDSPMINPWPHAKNRVGTGMYKYDDNDDSGCRPIRYGVSCIGFDFMLKMDKYPFFNAFIGHKTPLESFADKIIEKEEETCEIGTNKEFKCFEERAYIKGTCPTNINAVHYIDNKGKLRYVKCKENLEMTEDCAFCRKIKKKAGQSVQVQKTSVSLQDAICQENSDNYSGPKIPFKGVCKIGLIKYKECKFKTSSYETVSFITLKEKGKIYIEHLMLKNIEVVTNVSFVCYEHAGQDEQEVEHRALKRVSVNDCKIVDNSKQKICTGDHVFCEKYDCSTSYPDVTCIHAPGSGPLYINLMGSWIKPQCVGYERVLVDREVKQPLLAPEQNCDTCVSECLDEGVHIKSTGFEITSAVACSHGSCISAHQEASTSVIVPYPGLLASVGGRIGIHLSHTSDSASVHMVVVCPPRDSCAAHNCLLCYHGILNYQCHSTLSAILTSFLLILFIYTVFSVTTNMLYVLRLIPKQLKSPVGWLKLFINWLLTALRIKTRNVMGRINQRIGWVDHHDVERPRHREPMRRFKTTLLLTLIMMTGGNACSNTVVANSKQTRCVQEGSNTKCSITATITLRAGVIGAESCFIIKGPMENQQKTISIKTISSETVCREGSSFWTSLYIPSCLSSRRCHLVGDCVGNKCQSWRDDQLSREFSGVKDNHIMNENKCFEQCGAIGCGCFNINPSCLYVHAYLKSARNEAVRVFSCSDWVHRVSFEVKGPDGETELVTLGSLGTKFLNWGTLSLSLDAEGISGTNSISFLESSKGGFALYDEGYSEIPREGFLGEIRCSSESAAISAHKSCIRAPGLIKYKPMTDQIECTASLVDPFAIFLKGSLPQTRNGQTFTSTKDKKTVQAFTNGAIKALLSINLDDHEIVFINKVRSCDATFLNVSGCYSCDYGAHVCVKVKSSESADFFAESEDKTTVLSFPIQSGTHDYCQVLHFQKPLVDERLSYSCGSEPKLIVIKGTLVYIGVYDFRNKTGGSSTVVNPSEGAWSISNWFSGLLDWLGGPMKAILKILGFIAIGIVCFILFMILIRIAVNSINIKKKN

SEQ ID NO: 2001 - protein, 1313 aa, Artificial Sequence
  derived and/or modified protein sequence (wt) from PTV(GML488778)__KP272038.1__GP
MIFTILNVLIRAMLVMSMYSLTTWDSTSRNDMCFSNDSPLEGLVYYWETHSKKHDYKKQESQRCRVGDSDKKMITNVTIISLISEIQKSISELSLSCGNDDNSTGQVLTFNGLEDTIRGDYIVDCVTGLYQSDIGVGVGLGRTHHDHQQVKNKAVVIDEKERMISLLETQQSENDIKMQVLMSEIEQLKNQLSKKRNERGQEKRDAEKVMSDLMARNSDLRKHNGILTAEISQMKYNNTVQRSKNVMSTTVVPAILSVALLSSSVAPIMAAPPDSPMINPWPHAKNRVGTGMYKYDDNDDSGCRPIRYGVSCIGFDFMLKMDKYPFFNAFIGHKTPLESFADKIIEKEEETCEIGTNKEFKCFEERAYIKGTCPTNINAVHYIDNKGKLRYVKCKENLEMTEDCAFCRKIKKKAGQSVQVQKTSVSLQDAICQENSDNYSGPKIPFKGVCKIGLIKYKECKFKTSSYETVSFITLKEKGKIYIEHLMLKNIEVVTNVSFVCYEHAGQDEQEVEHRALKRVSVNDCKIVDSSKQKICTGDHVFCEKFDCSTSYPDVTCIHAPGSGPLYINLMGSWIKPQCVGYERVLVDREVKQPLLAPEQNCDTCVSECLDEGVHIKSTGFEITSAVACSHGSCISAHQEASTSVIVPYPGLLASVGGRIGIHLSHTSDSASVHMVVVCPPRDSCAAHNCLLCYHGILNYQCHSTLSAILTSFLLILFIYTVFSVTTNMLYVLRLIPKQLKSPVGWLKLFINWLLTALRIKTRNVMGRINQRIGWVDHHDVERPRHREPMRRFKTTLLLTLIMMTGGNACSNTVVANSKQTRCVQEGSNTKCSITATITLRAGVIGAESCFIIKSPMENQQKTISIKTISSETVCREGSSFWTSLYIPSCLSSRRCHLVGDCVGNKCQSWRDDQLSREFSGVKDNHIMNENKCFEQCGAIGCGCFNINPSCLYVHAYLKSARNEAVRVFSCSDWVHRVSFEVKGPDGETELVTLGSLGTKFLNWGTLSLSLDAEGISGTNSISFLESSKGGFALYDEGYSEIPREGFLGEIRCSSESAAISAHKSCIRAPGLIKYKPMTDQIECTASLVDPFAIFLKGSLPQTRNGQTFTSTKDKKTVQAFTNGAIKALLSINLDDHEIIFINKVRSCDATFLNVSGCYSCDYGAHVCVKVKSSESADFFAESEDKTTVLSFPIQSGTHDYCQVLHFQKPLVDERLSYSCGSEPKLIVIKGTLVYMGVYDFRNKTGGSSTVVNPSEGAWSISNWFSGLLDWLGGPMKAIIKILGFIAIGVVCFILFMILIRIAVNSINIKKKN

SEQ ID NO: 2002 - protein, 1314 aa, Artificial Sequence
  derived and/or modified protein sequence (wt) from PTV(Adames)__DQ363407.1__GP
MIFTILNVLTRAMLVMSMYSLTTWDSSSRNDICFSNDSPLEGLVYYWETHSKKHDYKKQGSQKCRVGDSDKKMISNVTIISLISEIQKSISELSLSCGNNDNSTGQVLTFNGLEDTIRGDYIVDCVTGLYQSDIGVGVGLGRINHDHQQVKNKAVVIDEKEKMISLLETQQSENDIKTQVLMSEIEQLKNQLSKRRNERGQEKRDAEKLMSDLMARNSDLRNHNVILTDEISQIKNNITIHRNRNMMSTTVVPAILSVALLSSSVGPITAAPPDSTMINPWPHAKNRVGTGMYKYDENDESGCRPIRYGVSCIGFDFMLKMDKYPFFNAFIGHKTPLESFADKIIEKEEETCEIGTNKEFKCFEERAYIKGTCPTNINAVHYIDNKGKLRYVKCKENLEMTEDCAFCRKIKKKAGQSVQVQKTSVPLQDAICQENSDIYSGPKIPFKGVCKIGLIKYKECKFKTSSYETISFITLKGKGKIYIEHLMLKNIEVVTNVSFVCYEHAGQDDEQEVEHRALKRVSVNDCKIVDNSKQKICTGDHIFCEKYDCSTSYPDVTCIHTPGSGPLYINLMGSWIKPQCVGYERVLVDREVKQPLLVPEQNCDTCVSECLDEGVHIKSTGFEITSAVACSHGSCISAHQEASTSVIIPYPGLLASVGGRIGIHLSHTSDSASVHMVVVCPPRDSCAAHNCLLCYHGILNYQCHSTLSAILTSFLLILFIYTAFSVTTNVLYVLRLIPKQLKSPVGWLKLFVNWLLTALRIKTRRVMGRINQRIGWVDHHDVERPRHREPMRRFKTTLLLTLIMVTGGNACSNTVVANSKQTRCVQEGSNTKCSITATITLRAGVIGAESCFIIKGPMENQQKTISIKTISSETVCREGSSFWTSLYIPSCLSSRRCHLVGDCVGNKCQSWRDDQLSREFSGVKDNHIMNENKCFEQCGAIGCGCFNINPSCLYVHAYLKSARNEAVRVFSCSDWVHRVSFEVKGPDGEMELVTLGSLGTKFLNWGTLSLSLDAEGISGTNSISFLESSKGGFALYDEGYSEIPREGFLGEIRCSSESAAISAHKSCIRAPGLIKYKPMTDQIECTASLVDPFAIFLKGSLPQTRNGQTFTSTKDKKTVQAFTNGAIKALLSINLDDHEIIFINKVKSCDATFLNVSGCYSCDYGAHVCVKVKSSESADFFAESEDKTTVLSFPIQSGTRDYCQVLHFQKPLVDERLSYSCGSEPKLIVIKGTLVYMGVYDFRDKTGGSSTVINPSEGTWSISNWFSGLLDWLGGPMKAILKILGFIAIGIVCFILFMILIRIAVNSINIKKKN

SEQ ID NO: 2003 - protein, 1313 aa, Artificial Sequence
  derived and/or modified protein sequence (wt) from PTV__M11156.1__GP
MIFTILNVLTRAMLVMSMYSLTTWDSTSRNDMCFSNDSPLEGLVYYWETHSKRHDYKKQESQRCRVGDSDKKMITNVTIISLISEIQKSISELSLSCVNDDNSTGQVLTFNGLEDTIRGDYIVDCVTGLYQSDIGVGVGLGRTHHGHQQMKNKAVVIDEKERMISLLETQQSENDIKMQVLMSEIEQLKNQLSKKRNERGQEKRDAEKVMSDLMARNSDLRKHNDILTAEISQMKNKNTIQRNKNTVSTTVVPAILSVALLSSSVAPIIAAPPDSPMINPWPHAKNRVGTGMYKYDENDDSGCRPIRYGVSCIGFDFMLKMDKYPFFNAFIGHKTPLESFADKIIEKEEETCEIGTNKEFKCFEERAYIKGTCPTNINAVHYIDNKGKLRYVKCKENLEMTEDCAFCRKIKKKAGQSVQVQKTSVPLQDAICQENSDTYSGPKIPFKGVCKIGLIKYKECKFKTSSYETVSFITLKEKGKIYIEHLMLKNIEVVTNVSFVCYEHVGQDEQEVEHRALKRVSVNDCKIVDNSKQKICTGDHVFCEKYDCSTSYPDVTCIHAPGSGPLYINLMGSWIKPQCVGYERVLVDREVKQPLLAPEQNCDTCVSECLDEGVHIKSTGFEITSAVACSHGSCISAHQEPSTSVIVPYPGLLASVGGRIGIHLSHTSDSASVHMVVVCPPRDSCAAHNCLLCYHGILNYQCHSTLSAILTSFLLILFIYTVFSVTTNILYVLRLIPKQLKSPVGWLKLFINWLLTALRIKTRNVMRRINQRIGWVDHHDVERPRHREPMRRFKTTLLLTLIMMTGGNACSNTVVANSKQTRCVQEGSNTKCSITATITLRAGVIGAESCFIIKGPMENQQKTISIKTISSETVCREGSSFWTSLYIPSCLSSRRCHLVGDCVGNKCQSWRDDQLSREFSGVKDNHIMNENKCFEQCGAIGCGCFNINPSCLYVHAYLKSARNEAVRVFSCSDWVHRVSFEVKGPDGETELVTLGSPGTKFLNWGTLSLSLDAEGISGTNSISFLESSKGGFALYDEGYNEIPREGFLGEIRCSSESAAISAHKSCIRAPGLIKYKPMTDQIECTASLVDPFAIFLKGSLPQTRNGQTFTSTKDKKTVQAFTNGAIKALLSINLDDHEIVFINKVKNCDATFLNVSGCYSCDYGAHVCVKVKSSESADFFAESEDKTTVLSFPIQSGTHDYCQVLHFQKPLVDERLSYSCGSEPKLIVIKGTLVCMGVYDFRNKTGGSSTVVNPSEGAWSISNWFSGLLDWLGGPMKAILKILGFIAIGIVCFVLFMILIRIAVNSINIKKKN

SEQ ID NO: 2004 - protein, 1283 aa, Artificial Sequence
  derived and/or modified protein sequence (wt) from Phlebovirus(CoAr170255)__HM566149.1__GP
MYKLITNILKLSVVSAMYSIMFWDPTGISKLCLSNNSPLEGLVYYWENTMREGEFKREKRKKCRLGISEPAPVSNQTIVSLIEEVQKSPAEMILICEANGNSTGSSLSFDGLSDNEIKPSIVDCTTGDRTSDLRVLVGKGIFEKKMSMSNEIDRVVSLEDHLQREKELVQTFQDLHHNESEKNKLLEHELENVRQQLKRERESNKIKMWTTKRPEITTIGLTTTIATILLASQSVASSVPMPGQLNTWPHAKNRVGGGVFKANDDDEDSCKLIDYGIACHGFDYLLRTDIYPFFNAHVSHRSLLEASNEGIILKDEASCEIETNKDFKCYEERAFLKWSCPHLVNSAHFIDSKGKLRIIKCKAEYEITEDCTYCRRIKKKAAQQKQVYKSSIALQDAVCQENSDYYDGPRITFTGVCKIGTMEYKKCKHKSSSFENIGFITIRDKGKYYIENMRTKNIEMVSNVSFICYNHNGQDTEKDVRLLKRVKPGDCKVVDDSKTKHCTGDHVFCEKYDCTKSYPEATCMHAPGSGPILVLVMGVWFKPQCVGYERVLVEREVKAPVLIQEKDCDTCVFECLEDKILIKSTGFKMISAVACSHGSCVSSHQSPSTFLYIDYPGLTASVGGEIGLHLSHTDDSVSVHKKIHCPARDPCEAHSCIVCYHGLVNYQCHTVLSYSVVSFLLVCMMYLAFFITSRLLFFLRIMPRRLRNPISWLTLLIRWVLQTLLAILRLSFKKLSETIGWNSPNNRQQMDVEANRRPLRRYRTTFILTLLFVGLTSACSNTAVSNSKQTKCLQSGGSVKCSITATITLKAGTIGAESCFIIKGPSENQQKVIRVKTVSSETVCREGSSFWTGQFTPSCVSSRRCHLVGDCVGNRCQAWRDEVVSREFGNMKDNNVMSENKCFEQCGAAGCGCFNINPSCLYVHSTFKSVRREAIRVFKCNDWVHRLTFEVSGPSGEKDRIVLNSLSTKFLQWGTISLSLDAEGISGTNSYSFLESNKGGFAIHDEEFSEIPREGYLGEIRCSSESAVIAAHKSCIRAPNLIKYKPMTDQIDCTASLVDPFAIFLKGSLPQSRSGYTFTSSTDKKTVQAFNSGSIKALISINMDDHEIEFLNDAADCDATFLNVSGCYSCNYGAQVCIKVRSSKSSIFSSNNNDNSIVINFDADQGTRDYCRIIHFNGPLVDETLHYSCGGESKLLQMKGSLITVGPYDFRNTTGGKSTIVNPHEESWNLFSWFSGLLDWLGGPLRAILKIVLIIIIGIILFIVVAFLIRLVIFNVLLKSKKN

SEQ ID NO: 2005 - protein, 1290 aa, Artificial Sequence
  derived and/or modified protein sequence (wt) from Phlebovirus(CoAr171616)__HM566154.1__GP
MFQIIYLLTKLYLVSSMYSIMFWENENISKLCLSNNSPLEGLVYYWENVMKEGDFKEEKRKKCRIGPSDLKRVTNQTLTTLIEEVQKSPSEIQLLCEEDGNKTGISMFFDGLSDDISTPSIVDCNGNIRISDLRVQVGRGHFEKENEIRKIEEIVTLEDDLRRERDLNKLLQDLNKKDAEERRIIEHELTNMREQLQRERERSKQQIKEHEKIEVNNHKEPATHLNVSKLLTIGLLAQQVGQVIATEPGQLNTWIHAKNRIGKGLYKTEDTDEDGCRGLDYGVSCLGFDYLLRTDIYPFFNSFVSHLSMLEASTEDLIEKEGTSCEIETNKEFKCYEERAFIKGSCPHLVNSAHFLDNKGKLRIVKCKTDFEMTEDCTFCRKIKKKNSQHKQVFKTSIALQDAVCQNNSDLYNGPRIVYSNVCKIGMVSYKQCKSKTSSYESVGFVILKGKGKFYIENMKIKNIEVIANVSFICHQYQGQDGTEKEQRSLKRISVGECKSVNPQKTKHCTGDHVFCEKYDCTKSYPEVTCLMAPGSGPILVQIMGSWIKPQCVGYEKVLVEREVKSPTLTEERDCDTCVYECLEDKILIKSTGFKMISAVACSHGMCVSSHQEPSTFLYINYPGMSASIGGEIGLHLSHTDDSLSLHKVISCPSRNPCDVHSCIICYHGIINYQCHTALSYTIVAFSFISFLYLTFKVISQLLYTFKVVPKKLKGPFYWMGYLIKWIVKTILGVVRNTFFTMSNRIGWERRDEIHEDIEANPRRHLQRFKTTFVLTMLMINGGLCCSNTLVSNSKQTRCVQSGNEVKCSVSATVVLKAGVIGAESCFIIKGPSENQHKMISVRTLSSETVCREGASFWTGHFSPSCVSSRRCHLVGECHGNRCQSWRDDQISREFGGVKDNNRMSENKCFEQCGSIGCGCFNMNPSCLYVHTTLKSARNEAVRVFKCNDWIHRLNFEVIGPSGEKDVVTLNSMSTKFLQWGTISLSLDAEGITGTNSYSFLESSKGGFAIHDEEFSDIPREGYLGEIRCSSESAVISAHSSCIRAPDLIKYKPMTDQIECTSTLIDPFAIFMKGSLPQTRSGYTFTSSKDKKTIQAFNTNSIKALISLNLDDHEIVFVSDQTNCECTFLNLTGCYSCDYGAHVCFRIKSDKKGVFVSNTEAKDISFGFEVLTGTHDYCQIQHFNSPSVYKTLSYSCGGESKLLVIKGSLITIGPHDYRNKTGGASTVVNPSEEGWSVTNWIGGFISWLGGPLKALLKIAVTILAGVVIFLIIYFFLRLIATNILMKTKKN

SEQ ID NO: 2006 - protein, 1283 aa, Artificial Sequence
  derived and/or modified protein sequence (wt) from Buenaventura virus(CoAr3319)__KP272002.1__GP
MYKLITNILKLSMVSAMYSIMFWDPTGISKLCLSNNSPLEGLVYYWENTMREGEFKREKRKKCRLGISEPAPVSNQTIVSLIEEVQKSPAEMILICETSGNATGSSLSFDGLSDNEVKPSIVDCATGERTSDLRVLVGKGTFEKKMSMSNEIDRVVSLEDHLQRERELVQTFQDLHHNESEKNKLLEHELENVRQQLRRERESNKVKVWTTKKPEVTTIGLTTTIATILLASQSIASSVPMPGQLNTWPHAKNRVGGGVFKANDDDEDSCKLIDYGIACHGFDYLLRTDIYPFFNAHVSHRSMLEASNEGIILKDEASCEIETNKDLKCYEERAFLKWSCPHLVNSAHFIDSKGKLRIIKCKAEYEITEDCTYCRRIKKKAAQQKQVYKSSIALQDAVCQENSDYYDGPRITFTGVCKIGSMEYKKCKHKSSSFENVGFITIRDKGKYYIENMRIKNIEMVSNVSFICYNHNGQDTEKDIRLLKRVKPSDCKVVDDSKSKHCTGDHIFCDKYDCTKSYPEASCMHAPGSGPILVLVMGVWFKPQCVGYERVLVEREVKVPVLTQEKDCDTCVFECQEDKILIKSTGFKMISAVACSHGSCVSSHQSPSTFLYIDYPGLTASVGGEIGLHLSHTDDSISVHKKIHCPARDPCEAHNCVICYHGLINYQCHTFLSYSVVSFLFISVLYLTFFIVSRLLLFLKIMPKRLKNPISWLTLLIRWVLQTLITILRLSFKKLSETIGWTTNDNRQHVDVEANRRPLRRYRTTFILTLLFIGLASGCSNTAVSNSKQTKCLQSGGSVKCSITATITLKAGIIGAESCFIIKGPSENQQRVIRVKTISSETVCREGSSFWTGLFTPSCVSSRRCHLVGDCVGNRCQSWRDEVVSREFGNMKDNNAMSENKCFEQCGAAGCGCFNINPSCLYVHSVFKSVRREAIRVFKCNDWVHRLTFEVSGPSGEKDRIVLNSLSTKFLQWGTISLSLDAEGISGTNSYSFLESNKGGFAIHDEEFSEIPREGYLGEIRCSSESAVIAAHKSCIRAPNLIKYKPMTDQIDCTASLVDPFAIFLKGSLPQSRSGYTFTSSTDKKTVQAFNSGAIKALISINLDDHEIEFLSDTADCDATFLNISGCYSCNYGAQVCIKVRSSKSSIFSSNNNDNSIVINFDAEQGTRDYCRIIHFNGPLVDETLHYSCGGESKLLQMKGSLITVGPYDFRNTTGGKSTVVNPHEESWNLFSWFSGLLDWLGGPLRAILKIVLIVIIGIILFIVVVFLMRLAILNVLLKSKKN

SEQ ID NO: 2007 - protein, 1313 aa, Artificial Sequence
  derived and/or modified protein sequence (wt) from Cocle virus(GML244915)__KP272034.1__GP
MMFTHLDVLTRAMLVMSMYSLTTWDSIRRNDICFSNDSPLEGLVYYWETQSKMHEYKKEDSQKCRVGDSEKKMISNVTIISLISEIQKSISELSLSCGNDDNSTGQVLMFNGLEDTIRGDYIVDCLTGLYQSDIGVGVGSGKTKHDHTKLRNKAVIIDEKEKMISLLEAQQSENDIKTQVLMSEIEQLKTQLLNRRSERGHEKRKNEEIVSDLMARNSDLRKHNDILKDEMDQIKENLTIFKSRNAISTTSVPAIMSIALLSSSVMPIIAAVSDSPMINPWPHAKNRVGSGMYKYDDNDESGCRPIRYGVSCIGFDHMLKMDKYPFFNAFIGHKTLLESFVDKIIEKEDETCEIGTNKEFKCFEERAYIKGTCPHNINAVHYLDNKGKLRYVKCKENLEMTEDCAFCRKIKKKAGQSVQVQKTSVPLQDAICQDNSDIYTGPRIPYKGMCKIGLVKYKECKSKTSSYETVSFITLKGKGKIYIEHLMLKNIEVVTNVSFVCYEHAGQVEQEVEHRALKRVSVNDCKIVDSSKQKICTGDHVFCEKYDCSTSYPDVTCIQAPGSGPLYVNLMGSWIKPQCVGYERVLVEREVKQPLLTPEQNCDTCVSECLDEGVHIKSTGFEITSAVACSHGSCISAHQEASTSIIVPYPGLLASVGGKIGLHLSHTSDSASVHMIVVCPPRDSCAAHNCLLCYHGMLNYQCHSTLSAILTSFLLILFIYTTFSFITNILYLLRLLPKQLKSPIGWLKLFINWLFTILRIRTKYLMGRLNQRIGWVENHDVERPRPREPMRRFKTTLMLTMLMITGGYACSNTVVANSKQTRCVQEGSNTKCSVTATVTLKAGVIGAESCFVIKGPMENQQKTISIKTVSSETVCREGSSFWTSLYIPSCLSSRRCHLVGDCVGNRCQSWREDQLSREFSGVKDNQIMNENKCFEQCGAIGCGCFNINPSCLYVHAYLKSARNEAVRVFSCSDWVHRVSFEVKGPDGETELVTLGSLGTKFLNWGTLSLSLDAEGITGTNSLSFLESSKGGFALYDEGFSEIPREGFLGEIRCSSESAAISAHKSCIRAPGLIKYKPMTDQIECTASLVDPFAIFLKGSLPQTRNGQTFTSTKDKKTVQAFTTGAIRALLSINLDDHEITFISKIKNCEATFLNVSGCYSCDYGAHVCIKIKSSESADFYAESEDKTTVLSLPVSSGTQDYCQVLHFQKPLVDERLSYSCGSEPKLMVIKGTLVYMGVYDFRNKTGGSSTVVNPSDASWSIANWFSGLLDWLGGPLKAILKILGFIAMGVVCFILFMILIKIAVRSVNMKKKN

SEQ ID NO: 2008 - protein, 1290 aa, Artificial Sequence
  derived and/or modified protein sequence (wt) from Campana virus(VP-334K)__KP272041.1__GP
MLHFITITTKFLAVASMYNLLYWDPNGLSRLCLSNNSPLEGLVYYWENLMKESDFKKDKKKHCRIGTSVAAPVTNETLTTLIEEVQKSPSEIILQCESRNNDTGNSIYFDGLADDIESPSIVNCESGKRESDLRVLVGQGLKKEIILNEIAAIDRQASLEEHLRGEKALTSLLQEISKQDEAERKRLEHEVSSLRQQLMNEREENKKRKNIPAFGVSSTTSSSLMNISRVVTIGLLSQQAIANPSLPGQVNTWPHAKNRIGQGLYRIDTSDEDGCRGLNYGVICLGFDHLLRMDLYPFFNAYVSHLSLLEAYTENIIQKDETECEIEGGKEFKCYEERAYIKGVCPHRIKSAHYLDQKGKLRIIKCKENLELTEDCTYCRKIKKDRGHTKQVYKTSVPLQDAICQDNSDDYSGPKISFKGVCKIGMIEYKECKYKSSSFETVGFITIKEKGKFYIEDMKLKNLEVTNNVAFICHQYTGQDGTTDEENRHLKRMSVKDCKNVNSSKSKYCTGDHIFCQVYDCTKSYPEATCFVAPGSGPVLVQVMGSWIKPQCVGYEKVLVEREVKMPILTEERDCDTCVYECKEDHILIKSTGFNMISAVACSHGSCVSAHQDPSTFLNIEYPGMSASVGGEIGIHISHTDDSLSLHKKIYCPARDSCEAHNCIMCYHGLINYQCHTALSYAVVSFMFVSIAYVIFNVLRLVLVALHVVPRKLKSPIDWLILLIKWVFLLLAKVIRAFLTHLNTTIGWRERQNNFAADLEAQRRPLQRFKTTVLLMMMLISVVSSCSNSVVSNSKQTRCIQSGSNTKCSVSATITLKAGVIGAESCFVIKGPSENQHKTIVIRTVSSETICREGSSFWTGHFTPSCLSSRRCHLVGDCVGSRCQGWREDVISREFGGVKDNNQMSENKCFEQCGAAGCGCFNINPSCLYVHTILRSARNEAVRVFKCNDWVHKLTFHIKGPNGEEEDVVLNSLSTKFLSWGTISLSLDSEGITGTNSYSFLESSKGGFAIHDEEFSEIPREGFLGEIRCSSESAVVSAHKSCIRAPGLIKYKPMTDQVECSASLVDPFAIFIKGSLPQTRSGYTFTSSRDKRTIQAFNNGAIKALLTLNLDDHEVIFSESVITCECTFLNISGCYSCNFGAQVCFKIKSSGIGDFVSSSETGNILFSFPVKSGTEDYCQIQHFNSPMVSESLQYSCGGESKLLLIKGSLISVGPYDYRNKTGGSSTVVNPAEDSWSIFNWLSGFLDWLGGPLRALVKIALAIIGALALLFITIMLARSVISNTLSRKKKN

SEQ ID NO: 2009 - protein, 1197 aa, Artificial Sequence
  derived and/or modified protein sequence (wt) from RVFV(ZH-548)__DQ380206.1__GP
MYVLLTILISVLVCEAVIRVSLSSTREETCFGDSTNPEMIEGAWDSLREEEMPEELSCSISGIREVKTSSQELYRALKAIIAADGLNNITCHGKDPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLLSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHDCIVCAHGLINYQCHTALSAFVVVFVFSSIAIICLAILYRVLKCLKIAPRKVLNPLMWITAFIRWIYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGSLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2010 - protein, 1197 aa, Artificial Sequence
  derived and/or modified protein sequence (wt) from RVFV(ZS-6365)__DQ380205.1__GP
MYVLLTILISVLVCEAVIRVSLSSTREETCFGDSTNPEMIEGAWDSLREEEMPEELSCSISGIREVKTSSQELYRALKAIIAADGLNNITCHGKDPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWIYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGSLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2011 - protein, 1197 aa, Artificial Sequence
  derived and/or modified protein sequence (wt) from RVFV(CAR-R1622)__DQ380219.1__GP
MYVLLTILISVLVCEAVIRVSLSSTREETCFGDSTNPEMIEGAWDSLREEEMPEELSCSISGIREVKTSSQELYRALKAIIAADGLNNITCHGKDPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2012 - protein, 1197 aa, Artificial Sequence
  derived and/or modified protein sequence (wt) from RVFV(2250/74)__DQ380209.1__GP
MYVLLTILISVLVCEAVIRVSLSSTREETCFGDSTNPEMIEGAWDSLREEEMPEELSCSISGIREVKTSSQELYRALKAIIAADGLNNITCHGKDPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWIYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGAKVCLSITSTGTGSLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2013 - protein, 1197 aa, Artificial Sequence
  derived and/or modified protein sequence (wt) from RVFV(T1)__DQ380201.1__GP
MYVLLTILISVLVCEAVIRVSLSSTREETCFGDSTNPEMIEGAWDSLREEEMPEELSCSISGIREVKTSSQELYRALKAIIAADGLNNITCHGKDPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAVLYRVLKCLKIAPRKVLNPLMWITAFIRWIYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGSLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2014 - protein, 1197 aa, Artificial Sequence
  derived and/or modified protein sequence (wt) from RVFV(1853/78)__DQ380220.1__GP
MYVLLTILISVLVCEAVIRVSLSSTREETCFGDSTNPEMIEGAWDSLREEEMPEELSCSISGIREVKTSSQELYRALKAIIAADGLNNITCHGKDPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGVVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

(The sequence listing continues in the following parts.)

The invention claimed is:

1. A purified RNA comprising at least one coding sequence encoding at least one antigenic polypeptide derived a virus of the order Bunyavirales wherein the at least one antigenic polypeptide comprises a Nucleoprotein from Crimean-Congo hemorrhagic fever virus (CCHFV) that is at least 95% identical to SEQ ID NO: 589 and that is encoded by a sequence at least 90% identical to SEQ ID NOs: 6643, 7335 or 8027, wherein the RNA comprises a heterologous 5'UTR and/or 3'UTR element.

2. The purified RNA of claim 1, wherein the at least one antigenic polypeptide comprises an amino acid sequence identical to SEQ ID NO: 589.

3. The purified RNA of claim 1, wherein the at least one coding sequence comprises a IgE-leader sequence.

4. The purified RNA of claim 1, wherein the RNA comprises 5'-cap structure.

5. The purified RNA of claim 4, comprising:
   a) the 5'-cap structure;
   b) optionally, a 5'-UTR element;
   c) the at least one coding sequence;
   d) optionally, a 3'-UTR element;
   e) optionally, a poly(C) sequence;
   f) optionally a histone stem-loop; and
   g) a poly(A) sequence of 10 to 200 adenosine.

6. A pharmaceutical composition comprising at least one purified RNA of claim 1 and at least one pharmaceutically acceptable carrier.

7. The pharmaceutical composition of claim 6, wherein the at least one RNA is encapsulated in a lipid nanoparticle (LNP).

8. A method of treating or preventing a disease in a subject comprising administering an effective amount of a composition of claim 6 to the subject.

9. The method of claim 8, wherein the composition is administered by injection.

10. The method of claim 9, wherein the composition is administered by intramuscular or intradermal injection.

11. A kit comprising a composition of claim 6 and technical instructions providing information on administration of said composition.

12. The purified RNA of claim 1, wherein the at least one coding sequence encoding at least one antigenic polypeptide is at least about 90% identical to SEQ ID NO: 8027.

13. The purified RNA of claim 1, wherein the at least one coding sequence encoding at least one antigenic polypeptide is at least about 90% identical to SEQ ID NO: 6643.

14. The purified RNA of claim 1, wherein the at least one coding sequence encoding at least one antigenic polypeptide is at least about 90% identical to SEQ ID NO: 7335.

15. The purified RNA of claim 1, wherein the RNA comprises a modified nucleotide.

16. The purified RNA of claim 15, wherein the modified nucleotide is pseudouridine or 1-methyl-pseudouridine.

17. The pharmaceutical composition of claim 6, wherein the composition comprises at least one further purified RNA encoding a CCHFV antigen.

18. The pharmaceutical composition of claim 17, wherein the at least one further purified RNA encodes a CCHFV glycoprotein.

19. The pharmaceutical composition of claim 18, wherein the CCHFV glycoprotein is a Gc protein at least 95% identical to the sequence of SEQ ID NO: 1665.

20. The pharmaceutical composition of claim 19, wherein the Gc protein is encoded by a sequence at least 90% identical to SEQ ID NOs: 12,389, 14,032 or 15,675.

* * * * *